United States Patent 12,721,888 (IMMUNOGENIC PROBIOTIC COMPOSITIONS AND METHODS OF USE INCLUDING IN VACCINATION) - sequence listing, part 2

SEQ ID NO: 49 - DNA, 2096256 bp, Artificial Sequence
  Based on Lactobacillus reuteri
ggctaaatactccctagtgaccgatagtgaaccagtaccgtgagggaaaggtgaaaagcaccccggaaggggagtgaaatagttcctgaaaccatgtgcctacaagctgtcggagcccgttaatgggtgacggcgtgcctcttgcagaatgaaccggcgagttacgattgcatgcaaggttaaggtggaaaaaccggagccgtagcgaaagcgagtcttaaatgggcgtaaggagtatgtagttgtagacccgaaaccaggtgacctacccatgtccaggttgaaggtgcggtaaagcgcactggaggaccgaacccgtgtcagttgaaaatggctgggatgaggtgtgggtagcggtgaaattccaaacgaacttggagatagctggttctctccgaaatctctttagggggagccttgaggtaaagaatcgtggaggtagagctactgtttggacaaggggcccgtcatgggttaccaacttcagataaactccgaatgccattgatttatactcaggagtcagacgatgagtgataagatccactgtcgaaaggggaacagcccagatcaccagttaaggtccctaaatatatgctaagtggaaaaggatgtggagttgcatagacaactaggatgttggcttagaagcagccaccatttaaagagtgcgtaatagctcactagtcgagtgatcctgcgccgaaaatgtaccggggctaagcatattaccgaaactgtggatgtgcactatgtgcacgtgataggagagcgttctaagggcggcgaagtcagaccgtgaggactggtggagcgcttagaagtgagaatgccggtatgagtagcgaaagacaggtgagaatcctgtccaccgaatgactaaggtttcctggggaaggctcgtcctcccagggtaagtcgggacctaagccgaggccgagaggcgtaggcgatggataacaggttgagattcctgtaccagttaactgcgtttgacgatggagggacgcaggaggctaagcaaaccgtacgactggaagagtacggccaagcagtaagtcaggatgtgagtcaaatgtttacatccgtgttgacaagctgtgatggggagcgaaattaaagtagcgaagttgccgatgtcacactgccgagaaaagcttctaaggagtagttaactgcccgtaccgcaaaccgacacaggtagtcgaggagagaatcctaaggtgagcgagagaactctcgttaaggaactcggcaaaatgaccccgtaacttcgggagaaggggtgctggccgcaaggccagccgcagtgaataggcccaggcgactgtttatcaaaaacacaggtttctgcaaaatcgtaagatgaagtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcgctgtctcaacgagagactcggtgaaattgaaatccctgtgaagatgcagggtacccgcgacaggacggaaagaccccatggagctttactgtagcttgatattgagtgtttgtactgcttgtacaggataggtaggagccgtagaagtcgggacgctagtttcgacagaggcgctggtgggatactacccttgcaatatgaccactctaacccgcagcactgaacgtgctgggagacagtgtcaggtgggcagtttgactggggcggtcgcctcctaaaaggtaacggaggcgcccaaaggttcgctcagtatggttggaaatcatgcgcagagtgtaaaggcacaagcgagcttgactgcgagacagacaggtcgagcagggacgaaagtcgggcttagtgatccggtggttccgtgtggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacataccgctggtgtaccagttgttccgccaggagcaccgctgggtagctatgtatggacgagataaacgctgaaagcatctaagtgtgaaactcgcctcgagatgagatttcccatttccttcgggaaagtaagacccctcagagatgatgaggtagataggatggaagtggaagtgccgtgaggcatggagcggaccattactaatcggtcgaggacttaaccaaggagcggtaaggtttattggaagagaatagataggatttagttttgagagcacaagctctcgtccgaagggacaaagagtgtggtgatgatggcttgaaggatacacctgtacccatgccgaacacagaagttaagcttcaacacgccgaaagtagttgggggatcgctccctgcaaggataggacgttgccgcgcagtagtaaaagggtgtgtatcgttttaacggtgcatgtcctttttttagtgcgcccggcatgggtattagctaggtggtgaaagtccgctatgggccgtagtagtcggaaccatgagctgaggacaagggtgtccaccgtgaggtggaatctgaaagaagtctaagggcaagcagtcaataacagtacggattgaaaaaattgggatcatgagctaccgaaaatgataattcatgatcccgttttatttatggcattctgcttgaatttcttttgaccatggcaaataagcctcaagtcctgcgtccttgcggtttggtaagtgatcaaaaagatacttaaagtatttgtagatatttaaatggttctggtttgcagttgccaccaaagtatagaaaatggcatttgcctgagctccagcagagcttttcgcaaataagctattctttcgaataagagttgatggacgaatcgcttgttcaaccggattattcgttaacggcactcgaccatcttcaaatatttgatatactcgctttcttagcttcaaagcattattaatggcagctttcaaccgtccttgaggaaaactgatattttctaaataagtatataacttatccatcaaaggcttcacgtgcaaccgacgttgcactagtttttccttatgattggaatatgttaattgtttctcttcatgaaagatcggtcgcattagctgtaaaactcggtatgctttggagttcttcaattgctccttattcaataaacatgtaatgtgataaaattcacgtcgaatatgaactaaacatgacccaaattttgcctggggatataatcgatcactatatccaccataaccgtcacacgtaataattccacgatattgatgaccgataatttgaccaatggttttacccgcgcgggtattatagtaatgaaacatgataatttgatgcttactgaattcttttgttgatcgcgttacccaaaagtagccagtttcattaggctcatcaattaccttgaatggagtttcatccatatgaattaccgattcttttctgattaattcctgtaaataatcatataacagttcaaggtaggtttgactaaccttaatgatgttagtcgccaataatcgagcatcaactcgtaagccgacggcttgccaaaacttaatttgacgatgaaacggtaaagcaagattaaacttcaactctgctactttagctaaaatagtactcgaaaagtaactatggggtaaaagactctgtggcatcttactactgacaagtacatcgctaccattagaattaatacactcattacatttataagtttcttgaatcaaattcacacaatataattcagctggttttaaccgtgcttctctactatatacatgttgacccacttttttcattagttgatgacagtgtgggcagttagtatcttttaatggaataacttcttcaacctgtggtaaaccatctaaaaaagtggtccgctgaccagatcgttttgctttccggtgacgcaccacttgctttattttttttcagtcacttccgtgactgaaatatcaggatcttgaagttgatccatttcttgctcactaaataaggattgttgtccatcaacgacgggctccattacttcagtttttttcccaaatatttggttcttttgaagtttgataatagctgttaattgagcaatcttttcattggccatagctaattgttgtttaagttctttgatttgttcttccgctgtttgcttcatggtacgtcacctcctttgaattattctttggtaattatatcaaagaattcttcttttaaatagaggtaactcaataaaaacttcctggtcgaacagcttgaattttacgaattggtaatgggttcagtccttgcaataaccagtcgagctgttgagcagataattctttggcttcattactgtttctcggccaactaaggtggccattttcaaaccgtttatagagcataataaagccctcgccatcccaaaacaatcctttaaagcgatcattacgtccgccgcaaaataagaaaagcgaattaaattctaatccatagttctcagcgattaccattgcgagcccatcaataccttttcgcatgtctgtttttccacagactagatagatataatctgggtcatgccaattaacgagcataacgaataaccattttaacgatatccgaagctaaaacagaattagtccccttgaaaatcgttaattcgacttcattcacattaatttttacggcagggcgtgccgtaaaagaatgcttttgtaaattacttggcttgtttttgaaaactggggtaataatttcattttgttctgtcataaataaaaaatctccttactgatgatagtctcagtatagaagatccggggtagctagagctagacgtactgttattgactgcttactataaaggccatcttagttgacccagaaatagtaataaaacagcaaaacactaagctataattgctcattgattacagctcagtgttttgatagttagactttattgactggtttttgtaaccaatgaaagaaaatagcgcgctgactattagctaataaccaccatccactagctaatgaaaaggccccgatcacatcggaagtaaaatgagctcgtaaataaactcgcgaatacataataataatgatccatagagcgccgacgattcctaagattaccctctgccacttaactttacaatagggtaaaaggagggctaggatcgtaaaaatgaaaatagcagttgaaaaggtatgcccacttgggaaactatatccactaacatcaattaaccgaaaggaaggacggagacgagtaacactatacttgatgaggataactaaacagtaaccaataaattgtaacatgccataccaaacactatcagttgctcttccgcgacgccataacaggagcattaagccgattgttataatgccgactgtaactgggtcacccataaaggttaattcggtcaggatagtagtcttaaacttagacactggggcagtcagatcaaagccacctgcatcgattaaacgaacaaatggagatttagttaaaacattaaagagtaatactccgaataaaatccaacaaaaaagtccgaatccgatttgtgcttttttatgcattatttataggcctcattcatattcattattacatttaattatatcccatttattcttaaaaagttatcctctctccacgaaaacgtttacatttaaaataaatgcgatacaataaaagtaaaaaagaggaaggacgattttaatgaataaccaattatgtggatatgcaattgttgatcaaaagattacgattaattatcaaaacagtgctattgttttatcagttattacgcctgaaatcattcgagtatttcaagatcacggtgaaaaaggaacatcatatgctattgaaggcaataaaacaattaaaactaattttacagtcttagatcatggtgaccatcttgaattaactacggcagcgttaattgtaaaaatatacgacaacgagaaaatgaatgtatatgacaaggagggtcatccattagttattgattatcagggtaagcgaacaccgattgaccgtggattagataaggctcatgcaaaattagttgctgccgaaggtcatgatattgctggtggaagtgaccaagataagacatattttgaagtaattaaatctttagccactgatgaacagatatatggtcttggtgataaaactgggtacttgaataaacgtggctacgaatacgataactggaatactgataatccagcacctcaagtagaaagttttacccggctttataaatctattcctttcatgttaggcttgaagaacggtcacccatacggtcttttctttgataatccttatcggagccatcttgatttaggaaaagaaaatgctaattactacttttattccgcagtcgccggtaaccttgattattacattatcggtggtccgcacttgagcgatattgttaaaaattatacttaccttactgggcgcgttccattgccacaaaaatgggtacttggttatcagcaatcgcgttggggatatagtgtaagtcctgaaaaagttcaagagattgcgactaaactacgagaaaatgatcttccttgtgacgtgatccactttgacattgactatatggatggttaccgagtatttacttggaacaaagaaaagtttactgatcctcaagcatttgtttcaaagttgagagaccaaggatttagagtaatgccgattattgaccccggtgttaagcaagataaaaagtataaaatttataaagaaggaattaagaaaggatactttgttaagaatcctgatgggaccgtttatgttaataaggtttggcctggcgatgctgttttccctgactttggccgagaagaggtacaacaatggtgggctgataattgtaaataccttgttgataccggaacagctggaatttgggacgatatgaacgaaccagcatcgtttgaaggtgaaatccctgataatattgtctttagtgacggaaaatccccttctacccataagaaattgcataatgtttatggacataatatggcaaaggctacttacaatggattaaagaaatacagtcataaacgaccttatgtcattactcgggctgcttatgcgggaacgcaaaagtattcaaccgtctggacaggtgataaccaaagtttgtggcctcatctacaaatgatgattcctcaattatgtaatttaggaatgagtggctttgcctttgcgggaactgatattggtggatttggtgcagatgccacggccgaaatgctaacacggtggattgaggcagccttatttagtcctctctatcgtaatcacgcttcaatgggaacccgtgaacaagaaccttgggtattcggtgaaccaacgctctcaatctaccggaagtatttaaagttaagatatcgttttattccattcttatacgatctttgttacaaggagacaaagaatgggctcggaataatgcgtccgttagtattaaactacgatcaggatcctactgttcggacaatgaacgatgaatatatggttggcgatgaattactagtagctccagtagttcaagaaggccaaaatacacgagcagtctacttgccagcaggggagtggattgacttttggaacggtgttgaatatgcaggtaagcggtcaattttagtagaagcgccaattgataagttaccactattcgttaaaaagaatacgattattccatggggccctgaagtaagtcatattagtgatgaacctaatgaaacaatgaccttccgcttatatggacaacatgcctcatatactcattaccaagataacggccttgactttgcttatcaaagtggtgaatacaacctttatcaaatcaaggcttctcaaaatagagtaacaatagatatggctcataatggttatgataaaaattaccggaagatctttgtagaattaaatgatcaaaaattaacatttgaatttaatccccaaacacaaacatatgtccaacaataatctgagatagaagataagaccgaggaagaagtttagtgctaattcttcggtcttattttagtttacataatattcaacatagtgagagattgttgttatctttttacattcatccgtgatacactggaagttgatttatttttatagtcatgtggtaataagtcaagatggaattaccactggcttgattgctttgaccagatttttggcgtacttaaataagccttggttccaaggtgattttaaaactaagcgtcaaaaatcattttatcttcctataccaattacctcttttcttgataaatttggtgatttttgagtaggaagtaaatcaccctgattaatttacgtgcggtaagaacgagggctcgtttagaaggagtgtgttttacttctttgtatttacgctgataatactcgccaaagactggatcgtgcgttcgaactaggttggcagcttcaaccaagtaataacgaagataggtattaccagtcctctttaacggtgtgttatcgctagtgtaacttcccgattgcttttctctccaggaaagcccagcatatttagctaatttagcttcgttgtcaaatcgatcgatttgaccaatttcagctaaaataccagctgcatagactggtccgataccgggaattgagcgcagaatttgttcatcatcagttactttaacgactttctcaattgatttatcgagatccttaatcatcttttgaaatgccttaatctcttcagcatagacagagagaaccgcgtcaaccgaattagctacgactttatctagccggtacgaagaccaaacagccttttgaatcgttttcgctaaagcttcggggtctgcgaagcgacctcgaccgtgttcagccaaatagtcggttaaatcattgattgaaatattgagtaagtcatcagtagtcagatcttcagttaataactgcatcatggttgaaccaaatatagaagtattaagttcatcagagataacaagcttattgagcttatagtataagttttcaataaagtgttgtttagctcgaaccaggctttgaacaatctcatatctagaacgggttaagcgctgaagagcaatgtaattttcttgacgaacaattccaatcgaataatgaccaacacgtaagtaatctgcaatgtaataagcatcaatttgatcatttttgtcttcagcgaaaacatcgtgaaaacgtttagttttcttgggatcaacgacgactgattgagtattaaaagctttcagatcaatgtcttcttgaaagaacattgctgggtgaaaactataaatgaaagtagcttccattccgataataacttggtcaatttgatttgaattcgccgtgttaataatctgtttctttaattcagttgcgcctttcaaatcattgacaaagttacctcggaaaacaacttcgtggttttcttcggaaatcattgaagtcacaagatcttttgagctaacgtcaataccgacaaatagtttcattggaatggcctcctttcattaaaatttactggtcttaatctgatcactgcatgataacccctaattacaatcgctaaagacatcctcgcaagtatcagtatttcattggttagcgaatcaaagctgcacctaatcctactcagaattagttgattcactaatcgatacagcatgtgagttcgtaaattagctgattgcctgggcggcagactaattaagtagttaaaactacaggagacgataacctataccagttgaccaacgccaatgatgattagaggttatcatgcagtgaccagaaagcaagtagtaaagtatcaaaatccgtaaggactgatttatataatacgaggagacgagaagatgaaagaaacgcaagagaacactccattagctgttgcaacggttgttcttggaatagtcgttggttttagctcattgatccttagcgctattctagatttaacagagcactattttttaaactttaacgagacaaataagattccagttaatattaatatttttcctcttcatcgatttgtctcagtgctaataggggggataattgctacaattatttggtactttcttcaacgtcattatcacccggttagtattaagaatgccctgaatggtaaagagatgccgttaagaaaaacatttattcacgtggttacccagatctttttcgtagggactgggaattccatcggtcgtgaattagccccacgagaagcaggggctgctatcgctcaggaatggtctcgaatgcttaattcttatcggtggttgcaccttaatgatgaggataaacgtttattaatcgccgctgctgctggagctggattcgcgggggtctatattgcacctattacaggaactgttttctgtttagaaattttatatcggcgcattaatgcccgttcagtttccgttagcttaatcatgtcagtaatcgcaacgatgattggttcgattttaaaaggattcgaaccatattatattgttgggagtcgagatttctctttgctatctgttccattagcaattgtgctaggattaatccttggagtaaccggaacctggtttaaacaaggagttaaagcagcttctagtaaacgggcaacaggtaaaaatattttctggcaattaccacttttatcgttctcggcaggagcaattgcagctttttatccacaaattatgggaaacgggcggggacttgctcaattagccatgaatacgaccaccgtcaattctcaggtcctaggagcgctcttgtttggtctagttgctaaagtaatagttaccttatttacaatcaaatgtgggggctatggaggaacactgacgccatcgattgccgctggagcagttattggagtatttctcggtattccttatatgcacttcttcccggttgttaccttaacgcagtgtgcagttattggggcctcattatttttagcagcgtcacagcaggcaccgttaatggcattatttatgttatttgaagtttgtcaccttaactttacagcttttcttccgttggggattggagtcgcaatttcaattggaatttcaaaatggatgcaggaagcaaaagcaaggacaaaataacctttagtaaaaacattctctaataaaatagcaaggctgaaatttcttccaaccttgctattttttatttatacaaattcttcattttctttacagttgctgcaagatccttgctatcaaagactaaggaaataacagctagccctgcaacgccagtgtcatgaacaactttcatattttcttcatcgatgcccccaattgcaactacaggacgttcgctaatcatgtttaaacgttcaagacgattgataccaatagcagcatcagcgtcaggctttgattttgtagggaaaacgggaccacaaccaatataatcaacaaagtccattgtattagcacgttcaacttgttctggtgtattacaggaatagccgatgaacatctgatgacctacagcgacagatacttgttcaattttagtatcattttgtccaacgtgaactccatcagcgtttatttgctgagccaattcataatcgtcatcaacaatcaatggaattccatagcgcgtacataaggtccgtagttctagtcctaagtctactcgttcattaggccgtaacttcgagtttcccttttctcgatattggaaggcagtgataccactcttcattgctagctctactttttcaagaaatttaacaacgtcattatggacatcttgtgttccaccaactaagtatacttgtaacatttttggatcaaacatcattttagatcgtctccttcaattttaacccagtgattaagtggcccatgaccatgaccaacattaatacccttgctaatcgtcttttcgacatatgtcttcccaatcataattgcctgttccatggagtgacccttagcaatttccgcagtaatacatgcagaaattgtatcaccagtcccatgagtatttttagtattaacacgaggcgcagttaaccacatatcattgccatcttcaaataaaatataatcatcagctttgtctgaagattctgcatggccaccttttatgagaatattttttgctccacgcttttgtaattcgcgggcagcctttttaatatcatttttatcccttattgtgattcccgtcaactcacaagcttctggaatgtttggcgtaatcagagaggcgagggggataagttcatctcttacaattgaaattgcatcatcactaagtaactttgcgcccccctttgctaccatgaccggatcgacaataagcggtcctaaatcatatttctttaaatttcgtacaaccgttcttacacggagagggtcagccaacatccccgttttacaagccctaattttcaaatcaccagcgattgaagcaaattgctcattaattaatttttcaggcattggcagggcatcttgcactcctaatgtattttgcgcagtgactgcgacaactaccattgctgagtatactccgcgcatttgcatcgtctttacatccgctggaataccggcaccaccgccactatcagttccagcaattgttaaagcctggggataatcattaatcaaggtaatcttcctcactttcctcaaagaattctagtaatgctttcgtatccataatcgaaagctggtcaaaaaactgtacttgccacgaaccgagtccgactgaataacggttagctaatactccagcagcagataccaaaaccgttgcaacaatacaagcatcccaagtattagaagtgatccctagaaatgcagcgatgatactagaaagcatgtcgccactacccacattcatcgttaacatctcggcagaaaagggattttcatagatgacttgcccatcagttattatgtcagtttcactagtcaagactacaattgaatggtaacgtcgagcacacgttttggcaatttgaacctgattaggaactttaccagcgtcgattccatgactagtattgtcagcttctactaaagcagcaatttcactggcgttaccacgaataacatcaaaatgaaaatcatttagcaatgagtgggcaaactctaagcgagatggaatcgcacttaccgctaccggatctaaaacgaggggtttgagtggcgtggcagctcgcaaaaccgtcctaatttgtgtcgcctgatgctcattgattgttccgagattgatagaaagagcattggctagtgccaccatctcatctgcttcagtgggctcaacagacatgattggcgacgcgccgacagcactaacggcatcggcaactttatcaattgttactaaattggcgagattaaggacaatcgggtttttagtacgaactcgatcgatcagtgaccagttaatttgacgttgtaccataaaattagctccttaaataaaaaatactcaaggtaggagatacacctactttgagtattaaagtccggtgcattttcctacgcaagcgttaacttacaggttctagagtccatgcatcactgcatatctcagcccagcactatgggcacccctaatgcaataaatttagtataccgcaaattattctttatgaatattaataaagataattggcaaaatgggaatgataattgtaaaatgtaataaaccgcgttattagaaaacctacgggtaaaatgaattgatataggcttttttgacatcatatattcttagagaatgctataaaataaccaattagttaaaatgttaactccattcttaaatgataatacgtttaccccaaaaataaatttagagtatttgaatacagttcatatactccttcgaccgtactaaataacttgtaatatgcgtataaaataattgttagttttaatataaagtagtttatgattaatagcgctacattaacaaaattactttcggtaaagttacattctaaattgatttttatttatagttgataaaaagaggtctaaatttcattagggaagttttttaatggatttgaaggtactccatcaaaaattacttcgtgaatacttgttttatttgattatttataataaagctcgttattagagattcgaatcatcatatgatttgaatttatgggtggttttttaataaaagttcgaatatagagagttgtatatatgtttagagattaatattgctttgtgaacataattgtcggcttagtaacaaatagatgatgacacccctcacacaaatgtgaagggtgtcttttaataataagtatataaaaaatcggctctctaataattatcgatcatatattgtttattgaaaacgtacatcttcttctttgccaacttcttcgtcaaaataacctaatccatttacttcgagtgtttttagataagctaccaattcaattgcggaactaggacttaattcgtttactgcattcaaaccaagaccagttggaacagtttcgctcattgctgtaatttggttatcattctcaatatgaacttgtgagcaactaattgcccaacgattattgacgtttggagcaaaaataaagaagaggttgaaatcggctgaaagatatgccggtaagaaccaggcaatgttatctaatcgttctgggttgaggttaccttgaagcgcaaaacggttgatattttcttcacaagggattgctttgagcataaacatggtattttcaaactctctcatccctaatttcatttccggtgtaattttgggcttcatatcatctaaaatctcctaactaaagttttcacggtagtagttatacttatttcttatatcttggagcggggcgtccatcacgtgcattttcccatgggcatcaagcttgaaattgtttgcgattacctgattgaactgcaggcggagacgaggatattggatgaggattttctcaatgttagttgacataatatcaagagcggcaagatatttggggacaagaattttcttaaattcgttaaacgtatctgcaatcacctcagcataggcatggtcagcatatttcagttcgttttcctctaatttatcgtaatactccctgcttgtcaggccacgttcatttttaatgttgtattgctcatcgtattggtgggtaagataagaatcccagtcacgatagcaataagtaatcatttggattactaattggcgtccctcgtaattaacgtttttcggaatcatctttccctgtggatttaacaagtaaggtcggattagctgtcgcgttacaatatcataaaaggttcctggcacaagttccttatcttgactatcctcatataaatctccggaaccttcaagcttttttagtttacggagactttcacgagtttggttggcggcataaataacatcttcaatctcttgatcaattatttcacgtttactaatcttttgtaagaggtttgtgtagagccggattaaattatggagttcagactgctgattagggtagaaaccgttttgttgctgatattttctagtttcccgttccaattgttgctcaattgcaagggcctgatgctcaattttaacaggcaagactggttgcgaaaagctatctttagcaagctgctgaactgcttcacggatgattggtctcatttcacgaaaatccggaaaatcaaagaaattttgaaaatcattagcaaagtttaggtgtttatatactgctgatttaagatttcgcttcataaaatattcctccattttctttgattttaatacgaaaaagagtaagaaaatattagggaattagataaaaacccttattttatttgtatttaactcgcctataattaaatataaataaaatagaggagactataatgaaaaaattattgaagcttttagcaatctttttactgtttagtagtattattagcagttcggcgatggctagttcaacaagaaccataacggatatgacaggggagaaaataaagatcccaaagaaagttaaccgcgttgctgacttatggcatgctaataatcaggttgtgctgttattaggaggacaaaataagctagttgccactactcctcttgttaagaaacaacattggttcacaatggtagatccaaaaattgctaaagttgctgcgccattagcaggcaatcaaattcaagttgaagaattagtaaaaataaaaccggacgttgtaattgcttccgatcaagctcaaataaaggaatcccgtcaagcaaaattaccaacagttaacgcaatgtatactgattttgctgggttaaagaagtcggttacattaactgcagaaattttagggggaaattctccaaagattgctcggcaatacaataaagaattaacaaacaacattaatcttgttaagcagcatttgaagagccgaaaatcaacgccaacggttcttcatattgttaatgcaacagatcttaccaaggttgacggacaaaaaacaattgttaacgaatggattaaactagcaggtggaaagaatgctatttctaaaaagggaaatcaaatttcagttacgcctgaagaattgattaaagcgaatccagatgtaattatcgttggtagtacatctactgcccaagcgcgaaaagcgttacgtgctaacagtcagctaagtcaattgaaggctgtatgcgaaaacaaagtatacggaaatcctcaagggaccttcccatgggatcgttatagtgcagaagaagcacttcaagtcttatgggcagctaagactcttcatccccaagaaatgaagaatattaacatggtctctgaagttcaaaaattttatcaaaaatactaccactacaatttaacagttaaacaagcaaagcaaattttagctggtgaaaattagcataaaaaacatcccctaaactggatattaattatccaaagcaaggggatgtttttaattagagcttaatttgacaagtatatcgttgaagatcaggtagataagtaagagttagtggaacatgatagatcctttctagctgtttagttgacattaactcttcacatgatccagtaaccatggaaccttttgaatcaagaagaccgattgtagtcggtagcattaaagcatggtctggaaggtgagtagtaagaataatggtgattttttgctgggctaagtcttgaattagttttaatatttcgtactgtcgacttaaatcaagggcagccataggttcatcgagaattaacaagcgcggttcttgaagtagggctcgaataatcgtaattagttgctgttgaccaccgcttaatgagataaaggggtgatcacgaaaaggtgaaagatgaaaacgttgtaaataggtttcagcaagttgaacgtctttctgatgcggagtttggagaaaagaaaggtaaggtgcacgaccagttaataaataatcaagtactgtgagattggaattaatatgataatcctgaggaacataggcaacttgttgtgcaagcgttttgtgcttcaaatttccaagctcttttccgttaactattacggttccttcatttggtgtcaaaagtccgactaaacagtggagaagagttgattttccgacaccgttagggccaaggatagtaaatacttctccagcttcgagactaaagttaacgttgtgaaagaccggatgtgtttttgaataggcaaaactaaggttattaacttcgaggactttcaatttaattgcaccttcttcttaattagaatataaacaaataagggtgcgccgatgaagccagttaggatacttaacgggatttcccctgccgatagggatcgagccattgtatcgacaattaacaaaaatagcgcaccaataactgctgcaaggggaagggtttcttttgtattatccccaactaaaagtcgagcaatatgcggaattacaagtccaatccagccaatatttccgctaagacaaactgttgcagcggttaaaaacgtgctggcggtaattatcagtagttgttccatatccacattaattccttctaggcgcgcttgttggttgccaagtgaaagaattgtcatatgccagcgaaggacaaatagaattattgtacctacaagcaaaaagggaaggacagcgataatatttgaaaaatcaacttttgctaaactgcctagttgccagtagacaatactttgtaattgtgaatccggatcagcaatgtactttagtaatccaactaatgcctgcataaaaccagaaatcacaattccggctaatactagaattaaggttccgcgctgatgaaggatttgggcaatcaataaagttaaactgaccgcaataattccaccaacaaaagcaaaaagctgagtaagtccaatgccatagcctaagagaattgcactagcagccccggcggccgaaccatacgacacccctaaaatatcaggcgagaccaaaggattatgaaaaacactctggaaagaacaaccagccattgctagaccagcaccaattaacagcgcaccgatgattctaggaagacgaaggctaaaaataatgtttgctgcggctggattgctttggggatgaagtagcgtttgaaagattatgattggtgaataatagatccgcccacaagaaagagcgagaacgattgtaacaataaccaacaaaattgcagtaaaaagtgttagatgataatgatgcttagtaattagaatctcttccttttcttaagaaattagtgatttcatcagtaactgtttgctgagcggttggcaggtcttcatagtcgatttttaatgaagacgctaatggtgaagcaccatgttgacgcaattggtaattaaaaatatttactgcgttagcaaattttgctggaccaaaatttttatctcctacacctgcaatataataaaccagcctcgggacagaaaactgacaaagataattatagaacttttcttcagaggctgtgagttgtccttcgccataagtacagggacaaaggataagcaagtcaatactatccaattttacttgtaaggcctccttaaaagaaagaaaaatggcagacggaaggatagtttggtgaataaagtttcctaattcgaagttatgaccgtagagtgtatcgtagagaattaaagtattcattgattaatcgtcctttcattcaggtgctagtataacaagtctcttaaaatcctattattagggatttgactaattctaaagggccattatcgtgtgtaataataagcatgataaaggcgggtgattattgttgcattatttacgaataagcgatgagcccatcgatgtaagtgagatgtataaacagcttgttgctccagaatacggaggaattgatatgtttgtcggcactgttcgtcaatggactggcgagatcgagactactaagattgagtattcagcttatcatcccatggcggaaaaacaattagaaaaaattgcagcaccgattgaagaacaaggaggacgcgttgttgtcgctcaccggactggcgaattgacgcttactgatatcgcggtatttgtaggtgtggcggctccgcatcgtgcagaagcattcaaatggtgccaacatgtgattgatacacttaagcatgaagtaccaatctggaaaaaggaatatgatacagataaggtaaggtggggaaactaatggaaattaacgttaaattatttgcgtttttacaagatcagttaggaccatctattactcttgatgttgctaatcctattcgagtagatgaccttcttaagcaaattagccagcgggcaccacaactgacgtcaactttagcaaattcgcggatagcaattaatcaagaatttgttaacgcagatataattaccttagaggccgatgatgaaatcgcaatcattccgccggttagtggtggctagattactctagaagatagttagaattacataggaggaggacttgattatgtcaagtgttaaagatgttgctcatgggagtaggcgaaatgcttatactgcattgatcctctccacgcttgcaatgattgtttgttttatgtcgtggtctaactttgcgccacttgcatcccaaattgctgagatgttcaatttggatgtatcgcagcgaacgttgttattagcgacaccagtccttttgggatcaattatgcgaattccagtagggatcttaagtgatcgttacggcgggaaaaaggtttatttgatcttaatggcctttattttgattccactaattatgattccacatgttcattcatttggaatgttgctctttgccgcattgcttgttgggatgtcaggaacatcatttgccgttggggtttcttatgcttcagtttggtttccgccagaacagcaaggactagccctgggaatcgtttcaatggggaatatggggaatgctgtggctgccatgactttaccttatatttccaaggcagcgggatttgatagtgtttactactttttgattattcttacagtgatctttggtgttcttttcgcagttttttgtaaagaaatgccagttgataaaagtaaaacgattaagggcgcattgtctgttgccgcggacagtggaacatggtatctatcactattttacttcttgacttttggcttatttgttgcatttacaaacttaacgccaacattcttgacagggatgtttcattatactcctgttactgccggcctttattcagcattatttgctttcgtatgtacgttagttcgtccatttggtggttaccttgctgatagaaaacgccccatggcattattacaatgggtctttgtagcaatcgttatttttgctatttggattatgcttagttttcacaatcaattcatgtttatcgcagggattgttttggttggtctttctgcagggattggtaacggggttgtcttcaaaatggttccatatgtatcccaaggtaatacgggagcggttactggtttcgttggagcagttggtggcttaggaggtttctttccaccactaattattggttatatttaccaatggacaggtagttatgagcttggaattgcactcttagcgttaaccggtgtaatttgctggtttgctctatggaaacattacattcatggtgatgttcacatcgttaaataatacattgaaaaaatggagatgagggtaatttttccctaatctccatttttagttttaaattattctttttttaatttttcaactaatcgaaacaattcatcctgagtttggccagctggtaacactttaatatcaaggattagctgggagaagatatcatcaattagttgcttgacatcatcaattcgttcaagtgctaattgatgggcttgcttaaacatcgcttgtgaaggacgatgatctgaagcgaagaaatcactaaaccattgtggattctgttggcgcgcgaataaaagtgccaggggatactgaccactcgttatcatctttacaaatgagtcgggatcattactgagttgttgaaactcatatgtaatataactagcagtaccaaaggcttgaccaatctgtcctgcaagtgaaacaatttccctttttgctccgctaaggacggcactttgttttgcagtcattgttccaagtaatccccatcgtgctttaacatctgctaaatagtcagctaccttaaattgctgattatagttaaactgtagccgtcgaatctgtgcaagcatcacatctccagcgtcagttgtcaactcctcaattatttgtggaggattacctacagtacttagtgaacggacaaagcgattcattaagtagctcgcaacatatgaataagctttttgactagcgaatttcccaggagttaggttatttggctgaaaagaaggaggattcaaatgagttgctaatgccaatagttctggtagttgagcagctgtaatttgatcaattgtgagatctttttcgttgaaataactaaaagcctcaaaaagcgacaaccttagccgccgttcttcttcaccagtactcaagttaatcatttcgcgaaccattggtggatattgataaataacggttgttaatgcatctaccaaccgttcatctggcgttaaattcacagtatcagtccttaaatttatttacttcagcaattatttgttcagcaacggggatgaagatatcactgaaatactcattaaaatcaacattttttacttgcttctcagtaaattcttgtgcacggtgaaaagcatcattacgcatattaacgataagagcttctcgttgatgtttaagtcgcttatgtagcttctcgttgtcattgctcatgtagaaatagtaataaatttcgtagaaggtattatcaagaacccaaaagagggtgctccgtcgaatattatcgcttatcatttcagtaaaggaatttttaccaagaagctcatggttagcaaaggctcccgcagataatacgattgcttgaacttcatgcatatcagccatatagtggcagaattgattaatttcattttctggaacactaaatcccagcttttcttttcgttccgcctcagtcatcttagaaaaagtgatctgatactcttgcatcacattctgattatctgcaatcaaatccttttcgataatcgttagtaaagcaaaattatcttgcataaattccttaacagtttgccatattttttcaatttgttcattaaagtttgtgaaaagatcttgaacggtgcctattctttttttaaccacttcttttttctctacatgaggggcatattgaattagaagaggaatatcatcgttatgttcatctagaccgtgcttggaccgttgctcattttcataatttttaagttcatcaagatcaacaaggccgaggggcattacattaatttcaccatttgtaagcatgatttgtaaggcaaacggggtggttgtttcttgattctcgactaatgattttaaggcatcaaataattttctacgatttgcaagttcattatctggatctgcgtaaaagcctgcagtatagatcgatttattttcgtaatctcgttttagcttatcttgaatatccatcttaattaattctcctttgttgattgagcaagaagttgtgcaagcttattacggccgcgatcagttaaagcagcatcttttaaatttatctctgctaatgttgaactaaatgattcgtcaataactgctccagaaatatattggttttcaactgcatatttagttgttaaaaacaggttggaaacgggattaacttgtcgactattagtaaaacgtttgcgagcaatatcactaagaattcctcgtaattcatcatctcgactgaggtttgtcgccattaggaatccactcctttaatcgtattttctttattgtagaaaaacatcgacgtaaataaaatcggggattcttcctaattaagaatccccgcctagttaaaggtcaattaaatggtgatgaatagcatattgtactagttcaacccgtccatgtaagtgaagtttgcgtgaaatatttgctttatgggcttccactgtctttgttgaaataaacatcttttgtgagatctctttatttgaataccctaaagcaataagtggaaagacttctttctccctttttgaaagactattatagccctttaattttaaggtattaccagatgcatttatttctctaatatctgtcttactaacaatgatatttgcatcaagatatttctcgccatttataacatgttttagggcattaacaatttcgctatctggtgaacttttcaaaatataagacattgcgccatttgccattgccttgttgatatattcctgttcttcatgcatcgagagaatgataattttaactttgggaaacttatcatggattcgacgagtagtaattaggccattttcgccagggggcatacttaaatccataattaagatatcaattccgccttgttcaactcgaatatatgtatcagttccactcgctgtcccatcaaccaccgtaaaattcggttgaagatcgactaagtatgaaattcctgagcgaacaattgcgtggtcgtctgcaactaaaacgttatacatttgttctcaccatatccttatttaaagcattattatagggaaactttaccttgactgtcgttcccttattaatttttgatgtaattgtaaaggctccgttatatgccttaacgcgttcattcatattcattaatccaagtgaatgcccattaaatccactatgctgatcaatatcaaatccaattccattatcaagaatctctaactgaaggtaactattgtgatccgtaacaataatacttatttctgttgaatgagcatgtttaattgcgttattaattgcctcttgtgtaatgcggtaaagaacgttttgaatgtttttttgtaatttttcagcagaggtaagggctataacatcaattgtgattcctgtactattttgaagacgtttcgccaaagctttgattgccggaattaagccaaaattgtcaagaactgaggggcgaatatcaagtgcgagccctttaatctctttaagggtcgtttgtaattgcttttcgattgcagcactcattgattgaaattgctcagtatttcgttgcttttgcaccgttgctaatctttgaacgcccattattgcggcgtagattccctgtgcaacactatcgtgaagatcttgtgagattttttgccgttccttttcgtgtgcttcattgacatattgattgagaattcggtgctcttcaatctgcgaaaggcgttgctgttgctcacgattttcaagagtcagggcaaagacactttctttatcgtcaagaggacgataaaccattgaaaaatgaaaaggatgagtagcgttggagtgaaacgttatcggaacggtagctcccgttaaccgctttttaatcaagcatgaagcacaatcatcattttctagttgtgaccaagcgtttttaccaatttgcagtaggtaattaacatctaaattaagcatagttactaaccgctgagccggctcattactaactaaaagatcatcatttttaaataagaagattgcatctggtgattgattaaaatatttttgtatccaattagcagtttcaagcacgatctgcttcctccccaattaattgtctttataatattcctattttatataataacgttttctcgagttagaagcaacgctggcccacttaaaaggcagggctaagaaaagctctgcttctttagccctgccgtctgagttttaaggatgtcgtggtaatcccatcgatggtccctggaaatacttagttgcactaaaatcaaatttcggatcctgaaattcgcggtaatgatcaaaatcagcttgaatctgttgaatttggtcgtccagttgttctaactccgcatctttttccagcgaactcatttgttggcttacttcttgttcccgattttctagcattgttcgtctaattgttaagtcatttaaaacaagggaaatgagcttttgaaaatcaggatttgtcattgaatctttacttttcatttaaatcgacctcacgatagtttaaatttgaaaattcgttacttgagcgatacttaaggggtggcagacgcacttattagtgatgaaactacgtaatcgccagtcatcattattatcaacccaagtagtaacttgttcattgctaactgaaaaatgagctaatgaatagtgattgtgctgacttgttgcaatataagagttggacgtacgagcaagaacagcaagtacatcttttgtgatatatggataatcaacagccaaagttaaatagtcttgaacaacggaaaattgactagtacaagcaataattgctgaaaggggaccatgatgatcataaggggaaatatcacagataatctgcacagccggttcttgaccaaccaactttaatatatgcgctcgatttatttcattagcacaaacaacgatttgctgacaaaagggtgttaatttctcgactgctagctctatattggtagctggtaatcctggaacatgataagtagctttatctttcccaaaacgggtagatttaccaccagcatatactaatccaatcatcctgcatccccctttacttgttttaagtagtcatagcaccaatttacaattgcatcttttcctaataagtcagcggttgttccattaaagatactacctattttaagagggggagtatgagcaacattggtaggatcttcgccaggctttaataataaaatttgcggatattgagtggcttccttatgaccttcaatcaagacaaaatcattatcggtacttaataattcaaccatttccgttaaagacggaacattacttttttgatgaaagaaaaattcagtcgcagattgtaaaataacctgtttagctccagcactactcattctagcactgtcagtagttggcacatccattgcggcattatgggcatcatgtttaagagcagctactcgatacccttcttttgagagcctttcgattaaagtcgtcgtgataagagtcttgccgctttttttatgaccgattatttgaagggtaatagccatgcgtctgtctccgttccgaccttcattggagtagtactatgcggaatcagtgctaaacaggttgtcgtctggaggttagctaatgagccagatctgttgattccatttggataaacataaaattgattatctttgaattcataagtacaacgaagataccgatcaaagccgttagttttattatatggggccgctaatattgcccgtacttgcttaattcggctggcttggtgttgataacggcgaatcagcggttccatataaaggtaaaaaccagtaaaacaagctcctggattcccagaaagagccattattaacgtattattttgaacaaaggcagtcgtaacgcttcctggtcgttgtttaatcttattaaaaagcaattcatcagctttacgtgcttcatctccaataaaatcaaaatcaccaactgaaacaccaccatcagtaattacaatttcatgagttgctatttgttcttcaagagtctgcttgataagatcagcatcatctggtaattgggtttcaaaatcaacaatcccaccagtttcttctaccagattttttaacataataccattactattaaagatctttcccggttcaatcgtggcattaggtcctaataattcagttccagtggcgataattgcaatccgtggttttttataaactgttacttcttgaacaccaaaagccgttaaaactgctaggccaccgggatttatttcctggtcttttgctaaaacgatatcaccgctttttacatcagtaccagcttccgtaatgttagtcttgctttcagtcgtaataatttgaaccttattttcatctttagcgggccgcgttttttcaattcgaattacttttcctacatcaaaagggacatatgcaccagtcataattcggaccgcatcccctgattgtaatggttgatcccaagttgctccagcttgaatctctcctcggacgttaaattcgcgagggaagtcatgatcatcgctggctaaaatggcataaccatccattccagcccgtcgaaaatgaggataatcataattggcatgaacatctttagctaaaacacggtggtcagcttctgataacgggattgtctctgtagctgttttaaggggaatttcgttaatctttttctgtgcctcggcaacagagattggaattcttctagtgagcatggtgatgaacttcctttcgttgagaactgctttcaaataataaatgttcatattctggcaaaattagtttacttagagccgtttgacaggcattctgggaaccaggtaaacaataggtaagctgattgcggaaattaaatccggctagggcttgtgatgcaagcgcacgagtaccaatttcatcaaaagatatctggcgaaacgcttccccaaaacccggaattagacgtttgaggagtggacggatagccggaatagtaacatcacgctgagcaattcctgttccaccattagtaatgatgatatcaagagcttgttgttctagttgaaggtaggcagtttgaatattgacaatatcatcattaacgattacccgatcaactactgataagcccgcgttagccatctttatagcaattaattttccagaagtatcgctatctaatgttcggctatcgctaaccgttaaaattgcgatttttttcataataggtcttctttcatcaaaatatttaacgacttaaactgtttctgggcaatcgccgaagtaggtaagtcatacataacaatcttaccattcttgaatatacttactggacgattttcccatttaaaatgaagaaacaatcgatttgcgttgattaagagctcttttttagccaaaaattctttaagtctgccaaaattaataggtttctctttgatcgtataatatgcattttccccacataatatatgtaattctggtgctgattcttcttctaaagaaatactgcttggcttagcacaggcgggacaatggtaatttttattaatagcaaacttactaaattgcattgaccaattgtcaaccgcgatcaattcattaaaattaacctgtgttttgtcaaccagataatgaagcgctaaagatacctgtagtcccgccacaatcgggattaaagcagtattaaccccaattaaatcacaatcgttttgttttaattcattaatattaggaaaaagacagttcaagcagggatgattttgtggcgaaatcgccattacgttcccataggttcctgcacagctggcaaacagataatcaaagtttttgatgattgctaatttgtttaatagatcccgtgcttgataattatcaagacagtctaaacaaagggtaaactgatattcgtcaataaggtcagcagtaatcggcgctgggatcgcagtaatttgacatactgaattaattttatgtaaatgttctttagctgcttctaccttaagccgttgttggctagcatcttcttcggtgaaaagcgattgacgttgaagattagttacgtcaacagtgtcaggatcaatcaagataagtcttttaactccagcacggacaagttgctcggctgtataacttcccaatgcccctacaccgacaatcataatagttgcatggctaattttttgctgaccaatactaccaatttgatgtaccctttcttgacgatcataacgattcatggatattagcacctcatttagttcaaaatataggtatttccctagtcgtagtatagcagttatggtgctaatctttacattagggaaaagacttactttatttttaatattggtaagccattcaataaaggaggtcaatcaacgatgaagtcacggttctttaacaaggttgataagtttaatggaacctttacacaacttgaagaaaatagtcgtcgttgggaaaagctttatcgccagcgatgggcgcatgacaaagttgtccgaacaactcatggagttaactgtacaggctcgtgttcttggaatgtttatgtcaagcaaggaattattacttgggaacaccaagccacagattatccatcatgcggacctaatattccaggatatgaaccacggggatgtcctcggggagctagtttctcttggtatgaatacagtcccgttcgaattaagtatccatatattcgtggcaagttatgggagctttggactgctgccaagaaagaacatgaaaatcccttagatgcgtgggcaagtattgtcgaagatccagaaaagtctaaaaaatataagaaggtccgaggacacggtggcttaattcgtgttcatcgttatgaagcattagaaatgatttcagctgcttgcttatacacaattaagaagtatgggcctgaccgcattggtggttttaccccaattcctgcaatgtcaatgatgagttttagtgccggagcacggttcattgccttaatgggtggggaacaaatgagtttctacgattggtatgctgatctaccacctgcatctcctcagatttggggtgaacagactgatgttccagaatccgcagaatggtataacagttcttacattattatgtggggatcaaacgtcccattaactcggacgccggatgcgcacttcatgacagaggttaggtacaaaggaacaaagattgtggcagttagccctgattatgctgaaaatgtgaaatttgctgatgattggcttgcaccagaaccaggtagtgattctgctgttgctcaagcgatgacttatgtaattttagatgaattctaccaaaagcacccagttaaacgtttcattgattactccaagcgatttactgatttaccatttatggttgaattggaaccaagtacagcaaatggtgatcactatacaccaggtcgcttcgtccggattagtgacttagttgctgatgatacgattgtcaatccagcatggaagacagttgtttatgaccaaaataaccacaagattgttgttccaaatggaacgatgggacaagaatataatgctaaggaaaaatggaatcttgaattattagaccaaaatggtaataagattgatccggcactttctattaatgatcaagatggcgaaactgaacaaattattgctgattttccagcgtttagtaatgacggaaacagcgttgtgcaacgtcatttaccagttaaaaagctcaaattcacagatggcaaagaacacttggtaactaatgtttatgatctgatgatggctcaaatgggaattaatcggactggtaatgatgaacttgctgctaaagatgcaatggatgctgagagttactttactcctgcttggcaagaaagccgttcgggagtaaaagcagagcaagttattcaaattgctcgtgaatttgcccaaaacgcggccgaaaatgaagggcggagtatggtaatcatgggtggtggagtcaaccactggttcaatgccgatatgaactatcgaaacattattaatatgctgatgttgtgtggttgtgttggtatgactggtggtggttgggctcactacgttggtcaagaaaagctccgtccacaagagggttgggcaaatattacttttgctaatgactgggaaaaaggtagtgcccgtcaaatgcaaggtactacttggtattactttgcaactgatcaatggcgttatgaagaaattgataaccaagctcaaaaatcacctgtttggaagagtaaacattcctacttacataatgctgattataatcaaatggcaattcgtttaggatggttaccatcatacccacaatttgatcgtaatccgttatcttttgcaaaagattacaatacaactgatattaatgaaatttcaaagaaagttgtcgatgaattgaagaagggctctttacattttgctgctgaagatcctgatgctaaccaaaatcaacctaaagcgttcttcttatggcgttcaaacttatttgcttcttctggcaaaggtgccgaatactttatgaaacatttattaggcgctgaaaatggattgcttgctaaacctaatgatcgagttaagccccaggatatgatttggcgtgataaaggagcaattggtaagttagatcttgttgttgatatggacttccgaatggtttcaacaccaatgtactccgatgttgtcctaccagctgctacttggtatgaaaagaaggacctttcatcaactgatatgcatccatttattcacccatttaatgcagcagttagtccaatgtgggaatcaaagtctgactggcaacaattcaagctcttagcaaaaactgtttctgaaatggcaaagaaatacatgccgggaaccttctatgatcttaagagcgcaccactaggacataatactcaaggggaaatcgctcaaccatacggggaaattaaagattggaagaatggtgaaactgaaccaattccaggaaaaacaatgccttccttgaaattagttactcgtgattacaccaagatttacgataaattcattacccttggacctaatatagtgaataactatggctataaagtcgatgatcaatatgattatttaaaggaaataaatggaactgccagcgaaggcattggtgcaggctgtccgttacttgatgaagatgaaaaagtatgtgatgcaatcttacggatgtcaactgcttccaatggtaaactcgctgaccgagcctgggaaaagaagcaagagcgaacgggtgaatatttaacagatattggccgtggtcatgctgatgattcaatgtcatttaagcaaatcactgctcaaccacaagaagcctatccaacaccaatcggaacttctgctaaacatggtggggctcgctacacaccattctcattaatgactgagcgaaatattcctacatttactcttacaggtcgtcagcatttctacattgatcatgaaattttccgtgaatttggtgaaaatatggcaacttataaaccatccttaccaccagttgtaatggccccaggagatattgatgttccaccagtaaaagatgaagttacacttaaatatatgactcctcatggtaaatggaatattcatacgatgtactacgataaccttgaaatgttgacattattccggggtggtccaactatttggattagtccccaagatgccgataagattaaggtaaaagataacgactggatcgaagtttataaccgtaatggggttgttactgcgcgggcggttgtttctgttcggatgcctgaggggtcaatgtacatgtaccatgcccaagataacgaaatttacgaacctctttctaccattaccggtaatcgtgggggatcacataatgcaccaacgcaaatccacgttaagccaacacacatggttggaggatacggccaattgagttacggttggaattactatggaccaactgggaaccaacgtgatctttatgcaaatgtaagaaagttgaagaaggtgaactggagtgaagattaaagcacaaatcagcatggtcttaaacctcgataagtgtattggttgtcatacctgttcagtaacttgtaagaatacatggacaaatcgtccaggcgctgaatacatgtggtttaataatgttgaaactaagccaggtgtcggttatccaaaacgctgggaagatgaagatcaataccatggaggatggacccttaattcaaaaggtaaattaaaattacgtgctggaagcaaattaaataaaatcgctcttggtaagattttttacaataatgatatgccagagttagataactactatgaaccatggacctatgattataagacgttatttggccctgaacaaaagcaccaacctgttgctcgtcctaagtcgcaaattactggcgaaggaatggaattaaccactggtcctaactgggatgatgacttagcgggatcaactgaatatgtccaacaggatcctaacatgcaaaaaattgaaggggatatcaaaaataactttgagcaggcctttatgatgtatcttcccgattatgtgagcactgtttgaatgcaccttgtgtagcctcttgtccatcaggcgcaatgtacaaacgagatgaagatgggattgttttagtagaccaagaacgctgtcggggatggcgtttttgcatgactggatgtccatataagaaggtctactttaactggaagactcataaggctgaaaaatgtactttttgttatccgcgaattgaagaaggtcaaccaacagtttgcgccgaaacctgtgtcggtcgaattcgatatattggtgctattctatacgatgctgatcgagtagaagaggcagcatcaactcctgatgagagtaagctgtatgaagcacaacttggcttattcctcgatcccaacgatcctgaagttgtcaagcaagcactcaaggatggcatttctgaagagatgattgaggctgcacaaaagtcaccgatctataaaatggcagtaaaagaaaagattgccttcccacttcacccagaataccggacaatgccaatggtttggtacattccgccgctatcaccagttatgagttactttgaaggacgggactcaataaagaatcctgaaatgatcttcccaggaattgatcaaatgcgggtgcctgttcaatacttggcaagtctattaactgctggaaacgttcctgtcatcaagaaagccttatataaacttgcaatgatgcggctatacatgcgtgctaagactagtggtcgggattttgatagcagtaaactagaacgagttgatttaacagaagaacgggcaacatcactttatcgtttactggcaattgctaaatatgaagaccgctttgttattccaagtagccaaaaggcagaaatggaagatgcacaaaccgaacaaggtagtcttggctatgatgaatgtgaaggctgtgcattagctccccaacacaagagtatgtttaagaaggcagaagctggcaaatcaactaatcagatttatgctgatagtttctatggagggatttggcgtgattgattttagacgattgacagatttaaaggatacatttgccgttctttcccgtttgattgactatcctgatacagaaacgttttcaccagagattcgtcaattattacttacagataacgcattatcaacagcaacgcggggagaattattaagcctttttgatgaattagccgcactatcttcaatcgaagtccaagagatatacgctcacctttttgaaatgaaccgacgttatactctttatatgtcatactataagatgaccgattcccgtgaacgagggaccattttagcacggttgaaaatgctatatgagatgtttggtatatcagaggcgaccagtgaactttctgattatttgcctctattgttagaatttctagcatatggcgattatactaatgatccgcgtcgtcaggatatccaattagcattaagtgtgattgaagatggaacttatacccttttaaaaaatgcagtgacagatagtgatagtccctatattcagttaatcaggcttacacgttcattaattggttcgtgtattaaaatggaggtgcaagaagatgcataatggctggtcaattttcttatgggttatttatccatatataatgttggcatcatttttcattggaacatttgctagatttaaatattttcatccctcaattactgccaaatcaagtgaactttttgaaaagaaatggctaatgatcggaagtgttactttccacattggaattattttagctttctttggtcactgcttaggaatgtttatcccagcaagttggactgcttactttggcattactgaccacatgtaccacatctttggttcattaatgatgggaattccagcagggatccttgcatttgtgggaattgcaattttgacttatcggcgaatgacttgttctcgtgtttataagacaagtgatatcaatgatattattgtcgactgggctttattggttacaattgcattaggtctagcatgtactattacgggtgcatttattgattacaattatcggacaacaattagtccatgggcaagaagtctatttgttcttaatcctcaatggcaattgatgcgttcagtgccattaatttataaaattcatgttctttgtggattagcaatttttggttacttcccatacacccggttggttcacgctttaacgctaccttggcaatatattttccgtcgttttattgtttatcgtcgacgcgcaagggtttattaatatataagaagatataataaaagcatcagatttctttacagggaaattctgatgcttttatatgtgcgcccggcatgggtattagctaggcggtgagagtccgctatgggccgtagtagtcggaaccatgagctgaggacaagggtgtccactgcgaggtggaatctgaaggaagtctaaggcaaagtactgcaccgatgaacaagaagtagctataaggctggaactaactggataagactgcatgacaagttaaagtccaacactactcgaagttactttcagtaaagctaccggtgacatggtacgaaagttaatatccttacccggggagatctggcctacacgtttccgacaagaggaataagtttaatttccacagaaacaagcggtgcagtgatgtagcgttgagtaagccagaagtcagccgaggtcatagtagtctgagtaatcagatgaaggactgaacgacaataacttgtaacttatatcggaggtgtaatcaggtgcgacaatcgcagaaaacagaacaacaagctgaccgcttgtcgaggataggtttggaaaaccgaaagtacacaagggcgcgtagtaccgattatggtgaaggtaaaggtatgagtgtcactatccaagacttagtcttggaccgcaataaccttaatcaggcttatttgcgagttaagagaaataaaggggcagcaggcattgacgatatgacagtcaatgaccttctgccatatctcagagaaaataagacggaattgatcgctagtttgcgtgagggcaagtataaaccagcaccagtcaaacgggtagaaattccgaagcctaatggtggagtaagaaaactcggaataccaacagtggtggaccgaatggttcaacaagctgtggcccaaattcttacacctatctttgagcgtgttttctctgataatagttttggcttccgccctcaccgtggggctcacgacgctattgcaaaagtagtagatctttataatcaaggttatcgaagagttgtcgacttagacctaaaagcctattttgataatgttaatcatgacttgatgattaagtatcttcaacaatatattgatgacccatggacactaaggctcattcgtaagtttctaactagcggagtcttagaccatgggcttttcgctaagagtgaaaaaggaaccccacaaggagggccattgtcaccaatactggcgaatatctatctaaatgagttggataaagagttgactagacgtggtcaccactttgtgcgctatgcggatgattgtaacatttatgttaaaagtcaacgagccggagaacgagtaatgcgaagcattacccagtttcttgaaaagcgattgaaagttaaagtgaacccagataaaaccaaagtcggtagcccgctacggttaaagtttcttggcttttcgttgggtgtagaccacaatggagcctacgcccgtccagcaaaacaatcgcaacaacgagtaaagaaagcattgaggttattaactaaacgtaatcgtggaatatccctgacaagaatgtttgaagaaattcatcgaaaaatgcgtggatggcttcagtactactcaattgggaaactaactgactttattcaacgccttgacaagtggttgagggcccgaataagacagtatatctggaagcaatggaagaagcttaaaactaaggtaactaacttacagaagctggggctgtcccagcgtgatgcatatgtcttcgctagtacccgcaagggctactggcgaactgcacacagtaagaccttgagctattctctaactaatagaaaactggaacaactcggacttatgaatatgtccaagacgctccagtcaattcaatgtgattaagttgtcgaaccgccgtatacggaaccgtacgtacggtggtgtgagaggtcgataattgaactaatcaattatctcctactcgattacgattattcgtgatttgttcttgtaaaggtaacaattgcactagctaaaattactaaaattgctcctaaaactagagaaggagttacctgaacaggaaagaaaaatgaagagtaaataataacaattactggaccaagtgcacgaacaatatttgctttaccagctgtaataaactgcaagctagtatagaaaagaagtagtgacatgaaaccattaaagaatgctccgccaaagttaaatgcgactgcttgactagaaatatggctaaatgacgttcctgttatgagagcatagcagaaaagtaaaagagccgaagtaaaatggttaaagaacaagacattatttggctcttcatcactaactagatacttagccacgatattgttggcggcatacattagtgggtagatgaatgcacaaatcaatccaagaaggttatcactaaattgaagtcggcttcctgaaataaagaaagaaccgagaatgcaaagaataattgctaagtaatcccactttgtaatcttttcctttaagaagatataagataggaagaaaacataaactaaatacatccgagcgataagggtaacagtgattggacttaaggttgaaagagcaatatattgaagaataattccgattgcatttgttccacccaaaagccataaccacaggctcttaaggttggttaaagaaacatgctgacgagtaataaggattgttgcaaaagtaaaaattgcagcaaacgcactagtgaaaattcccccaacaaccggactcaagctagtaagtgaaaatttattaagaaccggactaatactactaaataggagagaaatcagatttaattcaattccccatagttgcttctttggtacactttttatattcatttaatcacatccaatactttttattactttaattctaatgaattatattcctaagtctattaggaaaacgattaaatattttagtttacataatattcagaataataactattcaaatttgaaattttgaacaactttatcaaggtcttcttgttcaatccctagatagtggcgcgtatttcgttcagaggagtgattaaataactgcgaaatgatttcaacgttaacacctttcttatagagttgtcgaccaaaagtttttctaaaagagtgtgttccaattttagcaacgattttattattttccgtttttctagccattcgttgcaacatttcgtaaaagccatgtactgaaaaatgaccttcttgtttcccagggaaaagataatcattctcgtctttataattcaagtcattaagataatcaataatttcggcaagacaattattccaaaagagcgttttagccttacctgttttttgctcaataacacgggttttagttttatttagaacatgaccaacccttaacgttacaacgtctgatgctcgcaatccgttattaagggcaattgcaattagtaataggtttcggttaaccaattcaggacgcgaatgcagcttaattgtctcacgtaactgatcatattcttcgagagtcaagaatttaacattttctacccatattttccgtttacccttgatttgaccattagttttatttttgggaatataaactcgttttttagttgacataatatttcttcctttgttaatttgcgaggtaatcaactaaagcagggacgatttcctctccttctttccgcccagtttcataaagtgctcgaattttcttaatatttccttcaatccgcttaattttaattggtttagagggagcaatattaaagatctttccttcacaagacaaacgattaatttcagcagtctgttggttgtagagaaggggacgatcaatccccgctttagcaaattcgggataatctttatataccatgtcgtacaacttctttacagcagaactagatggcttctttcggtagttaatatccctggtccgtacaacaacaatcttgtcatagccttgtcgttgtgcaatatcaaatggaattgaatctgtgatcccaccatcaaggcaaggcccttgagaagtttcctgtggatctgaaagaaatggcattgatgaggaagctttgagggcattggttagctcctcaccaacaggatccgtaaataaaactgtttttcctgttttcacagaagtagcaactgctgtgaaatgagatgctgaccgtcgatatgcagcttcattaaaattctgccaagaatatccgtgatcttcaaaaagataatcaagattaattatttgctttttaaatacgcgagccatcgagatatattggcgatcgtgccgatgatcaatattaatattggcagcgcgtccgtattgcttagagacgaaattaactccacaaagtgaaccagcagaaacgccaattacacttcgaaattcaatatggtgagcgagaaatgtatcaacaattccggcagtatattgtccacggaatgcgccaccttctaaaactaatgctgcattatataacataaaatgaaataactcctttttgtccgccaaaaatagcaaaaatgacctaatttttagtgagacactttttcaataaaattatacaacagtctcacacgaaaatataggattttaaaagcttgttatatcaacgtttattctcggttaccgtaagactcttttatcaaaagagtcttactgattttgaaataacgcaaaagtaggggcaaaaacggattttgcctctcagacgaactgaaattcattttgatgagtagtaggtcgttacaattcgtctcagaagaaaaacgcatattgatatcaaaaaatgagtaaatagacagtaaatatttaaatatgaactttttatgaagaaactattgataatttaagataatcataataaaatagtgcacagttaattgttaaacgtttagcaaaaaaggtaaagaaacggggttatttctatgctagaacgcaaggaacataagaaaatgtataaaagtggtaaaaattgggcagttgttacactttctacggctgcactggtgtttggtgtaacaactgtaaacgcatccgcagacacgaatactgaaaacaatgattcttctactgtacaggttacaacaggggataatgatattgctgttaaaagtgtgacacttggtagtggtcaggttagtgcagctagtgatgcgactaaaaattctgctaatgcaaatagtgcttcttctgccgctaatacacaaaattctaacagtcaagtagcaagttctgctgcaacagcttcatctacaagttcagcatcttcatcaactaacacagatagtaaagcagctacagaaaatactaatgtagccaaagaggatgatacacaaaaagctgcacccgctaacgaatcctctgaagccaaaaaagaaccagctgtaaacactaatgattcttcagctgccaaaaacgatgatcaacaatccagtaaaaagaatactgccgctaagttaaacaaggatgctgaaaacgttgtaaaaaaggcgtggattgatcctaatagtttaactgatgaccagattaaagcattacattaaataagatgaacttctcgaaagctgcaaagtctggtacacaaatgacttataatgaccttaaaaagattggtgaggctttagttgatcaagatcctaaatacgctattccttattttaatgcaagtcaaataaagaatatgcccgctgcatatactagggatgctgaaacaggtgaatatgctgatttagatatttgggattcatggccagttcaagatccagtgactggttatgtttctaattggaatggctatcaacttgtgatcgctatgatgggacggcctcatcacgaagataatcatatttatttactttataataagtatggtgataatgatttttcacactggcgaaatgcaggatctatatttggatataatgaatctccactaacacaagaatggtccgggtctgctattgttaattctgacaactctattcaactcttttatactatcaatgatacaaataatgctattaaccatcaaaaattagcaagtgctactatgtacttaacagccgacaatgatggtgtccatattaataatgtagagaataatcatgtggtatttgcaggtgatggttatcattaccaaacttatgatcaatggaaagctgcaaatagttttgctgacaactacactttgcgggatggacatgttgtacaaatgccaaatggtgatcggtatttagtatttgaaggaaatactggaactgaaaattatcaaggtgaagatcaattatataattggtcaaattatggtggtaacgatcgctttaatattgaaagcttgtttcatcttttaagtagtgatgttgattataaaaaagctatctttgctaacggggcacttggaattattaaactaacgaatgatgaaaagaacccgcaagtagaagaagtatatactccattagttacatcaaatatggttagtgatgaacttgaacgtcctaatgttgttaaacttggagataagtattatctattctcggctacacgtttaagcagaggaactaatatcgatactcttaataaagctaataaagttgtcggagataatgttgcaatgattggttacgtagccgatagtcttacaggtccatataaaccattaaatggttcaggggttgtagtgacagcttctgttcctgccaattggcgtaccgctacttattcttactatgctgttccagtagaaggaaaagaaaatcaattactcattacttcgtatatgacaaatagaggcgaagttgctggaaaaggtatgaattcaacatgggcaccaagttttattgtgcaaattaatcctgatgatacaactatggtattagctaaagtaactaaccaaggggattggatttgggacgaatcaagtaacaataataatatgttaggaaacattcaaacagctgctttacctggggaatttggtaaaccaattgattgggatttaattggtggttatggattaaaaccgcatgatcctgctacaccaaatgatcctgaaacgccaactacaccagaaacccctgagacacctaatactcccgaaacaccaaagactcctgaaaatcctgggacacctcaaactcccgatacacctaatactccggaagttcctttaactccagaaacgcctaagcaacctgaaacccaaactaataatcgtttaccacaaactggaaataacgccaataaagccatgattggcctaggtatgggaacattgcttagtatgtttggtcttgcaggaattaacaaacgtcgagttaactaaatactttaaaataaaaccgctaagccttaaattcagcttaacggttttttattttgaaagtttttattatcgaaaaaaacaaatcctcgttaatcctttaatgcaattgttgtaaaaccttgcgacagtaataacagtggatttgcccatctttgtcagctaacttccgtgcatgcattgcagaaaaagtatagtgctcatgacaaaatggacaaacatattgctttttcccaaatagtgaggtaataaagcccaaaattttctcctccataaaaaaattatacaccccttaacattatagcgaagattatctttatagaaaaggcttttattcatttgtttttttatatgaagtttcactaatttctttaagagcatcacgctgctgtttctggtcaacgtgagtatataaatcggtagcagatgttcctttttgtcccaactgttgggccactaatacttgatctttcgttacctcatacatttcagaagcaagggtgtgccgtaatttatggggagtaagaggatggccaaatgcggttgaatactttttgaccattttttcaattgcattagctgtcatccgtcgagtttgcttgtgataaacggttaggaagaaagcagtatccttttttaaagcgtggtatcgttgtgcacgaatcgcttggtaagtttggatataagtaatagcccaaggagcaattggtaccgaatccctctggccaccttttcttgttacatctagcagcgattgttttaagtttaaatcaccaaggtttacatttgccgcctcggatacccggacgcctgttcctaaaataagagcaataattgcaatatctcgttccttattgaccttataagaggggagagctcttttatcacatttattagggtattctttttcaatgaaagtaataaaatcaaacttcatttgtccccggtacatgtgtgaagccagcgtatgagcccgataatttaatgtttttgtatcattaagggagtcaattttcagcattacattacggtcaaaataagattcaccattattgttatctgcggtaactgttaaaaatttatacaatgaccttaatgcattaatagatcgattgattgaagtaggagaatttaaccgtccttgtgcattggtagtatgctgcaaataatcgatatacaacattacatcgctacgccgtagattcgccagtgtatcaattggtaagtccttattagaattaacagagacgagtccacttgaccgtaaccaatcaaagaatcgacggatttcagttaagtactgataggttgttgtgactgcatggttggtccctaaataatactcgttaacataatcaggaaggttctgaagctcctcttgaattagctttaaatatttatctgcttccatttttatatcctccttgatactaaaaagagtcgcttgaaagaaaactttcaacgactctctaaacctatcgggaaaacaggattcgaacctgcgaccccctggtcccaaaccaggtgctctaccaagctgagctatttcccgttaataacgaacaaatattattctaccaattctcaattaattagtaaaggaatattttaatttaaagtgattaatagttaatgattaaatgacataatagtaaaattcctattaattgcaaaaaaatcatgattaaccgaaatccttttctagcatctaatgaagatgataaataattttattttcgactagttataaaagatacctttccgaaaataatttgacattcaaaatacttttgaatataatttgattatcgaatattttgatactcgaaatattttccgaaggcaggtgaatctttttggcaataatgaatgcgcaggagattatggaattaattcctaatcgatatccgatttgctatatcgattatgtagataaattagttcctgaagaaaagattaccgcaacaaaaaatgtcacaattaatgaatcattttttcgcggtcattttcctaataatcctgttatgcctggagttttaattatcgaaacattggcccaagctgcttcaattttgatattaaaatcaccgcatttttataagaaaacagcttatcttggcgcaattcataaagcaaggtttcgacaaatggtccgtcctggtgatgtattaaaactaaacgttgttatgaaaaaagttcgatcatcaatggggattgtagaaacacaagcgcttgtgaacggcaaattagcttgtagtgcggagcttgtctttatcgttgctgaacgagaagaaaagatttagcacggtgaatcattatcatttataatatattttgataatcaaattattcgggctatagaataaaattgaagggaagaaatatattatgagtaaagataatgattacgaaaaaattaataaaggattaatcaaagtttattccggaattctatggattgaagaaaatgaattgcggaaaagtacattcaatgatttaacaattaaagagatgcatgcaattgatgcaattacgatgtataaccatcaaacaatttctcaagtagcagaaaagcttcatctaactccaggaacaatgacttcaatggctgatcgtttaattcgaaaaggatatgtggaaagaattcgtgataaagatgatcgccgcattgttcggttatgtttaaccaaaagaggccgggtactatatcgtgcgcaccgggcctttcataacatgatggttgaacgttttcttaaaggaatggatgatgaagaaatgaaggttgttaaaaaagccttgcaaaacttagaagattttgtggatgagcatgcttagagataaggattgacaaacattgcaaaatttaagaattactagtactgcgagttatcatccaccccttaaaattactaaccagcaattatcaactattatgaatacttcagatgagtggattaagacgcggactggaattcatcaacgttatatcagcaacactgaaaatacttcagacttagctgtcaatgttggtacccagttattgactaatgccaatttaaaggcaactgaacttgatttaatcattattgcaacgatgtctcctgatgcctatactccttcaactgctgctattgttcaaggaagattaggtgcgaaaaatgcaattgcgtttgatatctcagcagcttgtactggttttatctatgccattaatacagctgaattaatgttgaaaagctctcattggaaaaatgcaatggtaattggtgcagaagtattatcaaaactgattgattggcaagatcgaagtactgccgtattgttcggcgatgggctggcggagtgttacttcaaaagacaactacaacaacccctttaattctcggccgtgatctccatacatttggtgacttaggagataaaattattgccggaaaaacaacgcctaaaactggcttccctaaacaactaacatccctttcaccatttacgatggccggccgtgacgtataccgctttgccactcatgaagtaccacgatcaatcacttctgccgttcaacaagctaatttgaaattagacgatatcgattattttttattacatcaagcaaatgaacggataattacccaaattgcaaagagactggcgcaaccaattacaaagtttccaatgaatattagtgaatatgggaatacagctgccgctagtgaaccaattttattgactcaagctattgctcatgaattgattaaaccaggtaacattattgcaatgagtggctttggtggcgggttaagtacaggaacaataattttaaactattaatagagaaagaagaatggatatgactaaagaggaaatttttaatactgtaaaaactattactgttgatgaattagatgttgacgaaaatcgtgtaacaatggatgcacgaatcaaagatgatcttgatgctgatagtcttgatgtttttgaaattatgaatgagcttgaagataagtttgagattgaattagatgccgatgaaggaatcgagactattagtgacgttgttgatttcgtaaagaaacagttggatgaaaaataatgtactacggaatattatttagcggtcaaggtgcacagcgatcgggaatgggagtcgagcttatggccgactcccttttttcaaggattgttagtcaggcaagcgctgtttgtgaacttgatttgctcaaaattatgaaaaacgagcataaggagttgaataaaacagcatatgttcaaccagcaattgtaacagttagttatggaatctaccgaatgttaaaacgggatttacctcaactaccaattaaagggatgattggcctatctttaggcgagtacgctgctttaattgctagtaatgcactttcatttgaagaaggaattaaattagttgcggaccgtgctcactttatgcaacaagacgcggatagagaaataagtacattagcagctgtccttgatcctcaacttcaagagataaaagaactaatcaccgctcaacaagaaaatggtcagcgagtttatattgctaactataattcaccacgacaaatcgtagtgggcggggcattaaacgctttaaaggctacccttaaaaagattgaagaggacaagcttgctaaaagaacgatcctgctcaaagttaatggtgcatttcatactcccttctttaacggtgcacgtcaacagatgcataaccggttacaagcagtcgacttccatgagccacagattgaagttattagcaatactactaacagcttgtttcattgtgaggatcttccaggaattcttgaaaaacaattagctgttccaacacactttggagctaatgttaaggaattagtcaagcacgcgaaaattgacacaatattggaaattggtcctggaaagacgttatctcgcttcgctcaccaagttgaccagcacttaaatacccaacacattgaaaatcttgctgattatgaaaaatttataaaggagcaaaaagatggaactgacagataaagtcgtttttataagcggaagcacacgcgggattggggcggctactgcattagagtttgctaaggctggtagtcggctaatcctcaatgggcggcaggataacttaccaaaaacgtttaaagaaaagctagatctactaggggcggattatcactatcttaagggcgatattgcaaatgaagaatcagttagtgaattagcagcagcggcttggcaaatatacgagaagatcgacattcttatcaataacgcgggaatcacgaatgataagttaatgatgggaatgaaagcgagcgattttgaccaggtcatcaatgttaatttacgcggaacatttatgttaacgcaacctatttttaagaagatgctcaaaaaaagagtcggttgcattatcaaccttgctagtattgtgggtctccatggtaatacgggacaagctaattatgcggcaagcaaggcaggtatcatcggccttactaaatctattgcccaagaaggagcacgccgtggaattcgttgcaatgcgattgctcccggaatgattactagtgatatgactgaaaaattatctgagcgagtaaaagaacaaattctcagtcgcatccccctcaaccgcttaggacagtcagaagaagttgctaagaccgcaaaatttttagcagaaaacgattatttgactggtcaaaccattgtagttgacggtggcatgacaatttaggaggaactaaatgacaagagttgtaataacaggaatgggtgctgttgctcctaatggtaacggtattcaagaatttataagtaatagttttgcaggcaaagttggaattaaagcgatcaagaaatttgatgccaagtcgacaggaattaccgtggcaggtgaaattgacgattttgaccctaatgatgtcattggaaggaaagccgcgcgccgaatggatctttattctcaatacgccttacaaagtgcgattgaagcaatggaaatggcggagattaacgaaacaaataccaagccagtcgacatgggtgttatctatggatctggaattggcggtttgacaactattcaagagcaaattatcaaaatgcatgataagggtcctagacgggtatcaccaatgtttgttccaatgtcaattgctaacatggcagccggtaatatttccattcactttaatgcgcaaaatatttgtacatcgattgtgactgcttgtgccactggaactaatgcaattggtgaagcctttcgtcaagttaaagcaggtcgcgctaaagtaatgatcgctggtggatcagaggcttcggtgaatgagatcgggattgctggttttgcggcattaacagcattatcacaagcaactgatccgcttaaagcttctttgccatttgataaggcacgtcaaggatttgttttgggtgaaggcggtgcaacacttgttttagaggatcttgagcatgcgcaaaaacgcagtgctaacattcttggtgagattgtcggttatggtgctacctcggacgcttaccatattacatcccctgatccaactggtgcaggggcggcaagagcaatggaactggcaattaaagaagctggaattagtcctagcgaaatttcctatattaatgcccacggaaccgctactcatgctaatgatgaaggcgaatccaaagcaatcaatcaggtatttggttccgatagtaatgttcgcgttagttcaacgaagggaatgaccggccatttgcttggggctgcgggcgcaattgaggcagtcttaacagtagccgctttacaaaagggacaattaccgttgaatataggttgctttaatcaagatccaaaatgctcggttaaccttgtgacggcagaaaataggaacgcctcaaccgcccgttacgcaataagcaattcttttggtttcggtggtcataatgctgttttagcctttaagaaatgggagtgatctatcttggaatttaaagaaattcaaacattaatgcaaaattttgaagattctgatattcgtgaattagaaataaatcaagattcctttcagctctatttaagcaaaaataagcaaacccacaagcatgaaaatcttataacaaccgaaaaaacagagcaaacgacttcagctaagaaaaaagcaaacgaacaactaactttaccttcgcaaaatataactgcgcccctagtcggaacagtctatctccaaccaacccccgatgcagatccctatgttaaaagtggcgaccacgtaaaaaagggggatgttgtttgtgtgattgaagcaatgaaaatgatgacagagataaaaagcccttttaacggaaccattacttcaatttgtgtaagcaatgaagaattagttgaagtagaacaaccgcttttctcagttcaggaggataaagacaatgcctaataaaactttagatataactgaaattcaaaaaatccttccgcatcgttacccgatgttgctaattgaccaagttgatgaattaatccctggtaagaaggccattacacaccgtaatgtcacgattaatgaagaggtttttaatggtcatttccccgaaaatccagttttaccaggagcattgattgttgaatcattggcgcaaacaggtgccgtcgctctcttatctcaagaagagttccaagggaaaacagcctattttggtggaattcggtcagcagaatttcgtaaggtagtccgtccgggcgatacgttaaggttagaagtcagactagaaaaagttcacaaaaatattggaattggtaaaggcattgcaacggtcgatggcaaaaaagcctgtacagccgaattaacttttatgattgggtaggtggtttaatgttttccaaagtactagtggctaatcgtggtgaaattgctgtcaggataatacggtcattacgggagctaggaattaagacagtagctatctattcaactgcagaccgcgaaagtcttcatgttcaactagcggatgaagctgtatgcgttggaactgcccgggcccaagattcatatttgaatgcgaaaaacattttagaagctgctcttggtacaggtgcccaggcaatccatcctggctttggctttctatcagaaaatgcggaatttgcgacaatgtgtgaagaatgcggaattacgttcatcggtccccaagcctcagtgattgacttaatgggaaataaggagcatgcacgggagcaaatgaaaaaatcaggggtgcctgtgattcctggaagcgatgactatattaccaatgttaatgacgctgttgaggtcgcaaacaagattgggtatccaattttgttaaaagcagctgctggtggtggcggtaaagggatccgacgaattaacgatcataaccagatgcggcaaatatttagcgaggcccaaaacgaagcccgactttcgtttaatgatgaccgaatgtaccttgaaaagattatggagaatgttaaacacattgaggtccaagtatttcgtgataattttggcaatgccgttttctttcctgaacgtgactgctcgattcaacggaataaacaaaaattgattgaagaaagtccttgtgtcctagtaaatgaacaagagcgaaaaacgctaggacaaattgcaatgcgagccattaatgcgattaactaccataatacggggacaatagaatttctaatggacaaggaccatcacttttactttatggaaatgaacactcgtatccaggttgaacatacagtgacggagatggtaactgggatcgacttagtgaaggcacaggttattgtcgctgcgaatgaaccacttccctttacccaacaggatattcaggttcatggacatgcaattgagtgtcggataaatgctgaaaatcctaaacaaaactttatgccagtgactgggacgattaattacttatatcttccagtcggtaatttggggatgcgcattgacactgctatttatcctggcagtaagatcactccttattatgattcaatgatcgctaaggtaattgcccttggtcaagatcgccaagaagctattgaaaaaatcaaacgacttttaaatgaaatggtaattacgggcgtaacgaccaatcaaaatttccatttagcaatcctaaacaatcctaaatttttggcaggaacagcttcaacaacgtttcttgaagacttcttcttgccacaatggaaaaaggagctgacagcgtgaaattatatgatcaaaataatactttaagtgaacggcacatcaaagcagataaaaatgctgatgaaagggtcccagatcaaatgtggttaaggtgtccacattgtcatcaattactattcgccaagcagttaacacaatatgctgtttgtcccaattgtgactatggattacgaatacctgcccgccatcgactctcgtggttagtagattcatttaaagaattcgataaggatctccagacaaagaatccgttacattttcctggataccaagaaaaaatcagcaaacttcaaagacaaactaagctgaatgattcagtcctaactggtgaagcttcaattaatgatcagctattttcactaggtattatggatccaacatttattatgggatccctcggaactgttaccggtgaaaagataacgcgcttatttgaatatgcaactatccatcgtcaagcagtagtactattcactgcttcaggcggggcacggatgcaagaaggaattatgtcgctaatgcagatggcgaagatttcacaagcaataaatgagcatgctgctgccggccttttatacattgtgatcttaaccgatccaacaactggtggagtaacagctagtttcgcaatggacggagatattattctcgctgagccccatgcacttgttggctttgcaggccgtcgagttattgaacagacgattcatcagcaaattcctgttgatctccaatcagctgaaaacatcctgcatcatggatttattgatcgaattgtaaaacgtcaagatgaaaaaaagctgcttgaatggctattaaaaacagggagcgttgctaatgaatgaacaattatcagcaagcgagattgttaaacgtgctcgcaatgacaataaaattacggggatggagattattcaaaatgttttcccagattttgttgagttgcacggcgaccgggcaggcggggatgatcctgcaatcgttggtggaatcgctactttccatcagcaagcagttaccgtcattaccactgatcgaggaaaaacaacagaagaaaaaatcataaagcattttggctcaccaatgcctagtggttatcgcaaggcactccgcttaattaagcaagcagttaaatttaagcgacctgtattctgttttgttaataccgcaggagcatttcctagcaaggaagccgaagaaaatgggcaaggaagtgcgattgcccaaaacattttacaaataagtcagcttgccattccaattatcacgattatttatggtgaaggaggtagtgggggagccttagcattggcatgtggagatgaagtatggatgttagaaaacagtacttattctattttatctcctgaagggtttgcctccatcatgtggaaagatagtacgaaagcagataaagcggcagaattaatgcaaatggtgccgcaagctttattaaaacaagggattatcgaaggaattattccagaaagcgaagagcatcgtaaaacttgcaaaaatatcgagcaggttttactaaagcgattaaacaagctgcaagaattaccgccaaaccaacttctagcaaacagaaaaaaacgttatcgaaagttttaaggaggataatatgggaaatatattaacaggaaaaaagatcgttgttatgggagtagctaataagcgttctattgcatggggatgtgcacaaatgatggctgaacaaggtgcccaagttatctatacttatcagaattccagaatgaaaaaaagcttacaacggttagtagatgatgaagatcaattaattgaatgtgatgtagcagatgatgaaagtattgaccaagcctttacgattatcaaggaacgttttacaaaagtagatggaattgtacacgcaattgcttttgcaaaaagagaagaattagctggttcaatccttggtgctagtcgcaaaggttatgcaattgcgcaagatatttcgtcttactcccttattgctgtcgctaaggttgctaatgagttaaatctattaaataatcctgcaagtattgttaccttaacttattttggctcagaacgtgctatccctaactataatgtaatgggaattgctaaagctgcccttgaagctagtgttcgctatttagcacgggatttaggacaaaaacgaatccgtgttaacgcaatctctgctggcgcggttaagacattagcagttacaggtattaaaggtcatgatgaacttttaaagatgtcccaagcaagaactgttgacggagaagatgtgactattagcgaaattgggaatgtgtgtgcattcttaatgagcgatttatcaactggagttactggcgacaccatttatgttgataagggggtacatttgatttaaaaatataaattttaaagactgagaaatgagtttttttcagtctttttgctgtcttttagaaggaaaacataacaatagcaagaactttttttaattttttctaaaaagttcttgctattttatagctcagttggtattattaataacgttgtgaaagacgagttaataattttgagaaaaattgtttaatatatttaaaaatggcccgttagtcaagtggttaagacaccagcctttcacgctggtatcgtgggttcaaatcccgcacgggtcacttttgcggaagtagttcagtggtagaacatcaccttgccatggtgggggtcgcgggttcgaatcccgtcttccgcttagccagttctattatgccggggtggcggaattggcagacgcacaggacttaaaatcctgcggttagtgataaccgtaccggttcgatcccggtcctcggcactatttcgggaaatagctcagcttggtagagcacctggtttgggaccagggggtcgcaggttcgaatcctgttttcccgatctggctaaacagctaagaggtaatcttcttagctgtttttttggatatctgtcaactggtatggttgactaaaaatttttttagtgcgcccggcatgggtattagctaggtggtgaaagtccgctatgggccgtagtagtcggaaccatgagctgaggacaagggtgtccaccgtgaggtggaatctgaaggaagtctaaggcaaagtactgcatcgatgaacaagaagtagctataaggctgaaattaactggataaggctgctagacaagttgaagtccaatactactcgaagttggtctcagtaaagctaacgatgacatggtacgaaagctaatattcttacccggggagatctggcctacacgtttccgacaagcagtactaacgcagccattaattagttttttgaaataaaataaacttttttgaaaaaagtattgctttttataggataacttgataatataatattcgtcgctgatatgcgggtatagttcagtggtaaaaccacagccttccaagctgttgtcgcgagttcgattctcgttacccgcttttaattaatttaatatggcccgttagtcaagtggttaagacaccagcctttcacgctggtatcgtgggttcaaatcccgcacgggtcatttttggaggattagctcagttgggagagcatctgccttacaagcagggggtcacaggttcgagccctgtatcctccattgaacaattttaatagttgttcaacattttaatataattgggctatagccaagcggtaaggcaacggtttttggtaccgtcatgcgctggttcgaatccagctagcccaattagtctaaaacagtgagtaaaaattactcgctgttttttattagaaaaaataggcaatctaataacgtaggctaaaagcgaacatcattggattgcccaataattagcataatttattcacgtcgtaacataatatgccagacaaagaagccgactccaataattaacgccaaccatgcccatagttgcaatggaagatagatagtacacgttaacaagcctaaaacccaactgattagcatcatcgataatccagcaatatcgccacctaaaccatcaataccacaagtagcgatatagacgattcctgatgccagatataatagcgaaacaattaattcggctgttccggcataaataggaattgcaggattaggattcccaaaacctcctcaagtcttattctacccggatgattagaatttataaagaattacagtttttctatttacaaatagagcagggggaacaaaaaatcaaaccagaaattatcttctgatttgattggatcttatttagttgtatcttttacttttttcaaggcttctaaaaatacttcataaggttgtgcaccagtgattgaatacttattattaatcacaaatagcggtgcacttggcattccaatcataaatgcgcgccgttcattttttcgaacttcatcttcatactgattagattcaagaacttttttaacatcagcaacaggtagtccgatttcattcattgcaacagttagagcttcatagtccgcgattgattcattatcattaaaataaagttgataaagacgtttaacagccttattaagtaatgcttggtcatttaaactctcaatgtattttattaagcgatgagcagctaatgtattaacaggaatcgcattttccatcttaattggtaaatcaatatcggcagcaagttgatcaattttatgtatttgtgtaacagcttcttgcttagttagttgatgagtttttgcataatattctgtcattgataaatcagttgttgttggcaacgttggatctagttgaaatgacataaattttaatggtgtctgatcggcaatctttaattctttaagcgcccgttgtaattgtgtaattcccatatagcaatatgggcacgcaatatcagcccagtattgaatttccatagatgatcgctccttataaatatatattaatttaatctaatcataaaataagcgaagttgctagtaaatacgtaaagagggaacgatttattttaaaattaacatgtcattaaaattatagttttaatgcgactgaatttaaaattccccccagaatatcaatttttagctttctcaaaagaatttatttaatgcttatttttaactttaataaaactttttctaaacaaaactaatacttttgatttatgttttaaaagatttatgtaatactattgatgaagtctatgtcaaaagtattttaaaaggagtttttatcatgaaacatacgcttaaagttgatcaagtacgtgacggtttatggctagattcagatattacgtatacgcaagttcctggatggcttggtaatacaacgcgagatttgaagctttcagtcattcggcattttcaaactaatgatgatacacgttacccagtaattttttggtttgctggtggcggctggatggatactgatcacaatgttcatctgccaaatttggttgattttgctcggcatggttatattgttgttggtgtcgaatatcgtgatagcaataaagttcagtttcctgggcaattggaagatgctaaggctgctattcgttatataagagctaatgccaagcgctttcaagctgatcctaatcggtttattgcgatgggagaatcagctggtggtcatatggcaagtatgttaggtgttactaatggtcttaaccaattcgacaaaggtgctaatttagattactccagtgatgttcaagtagcggttcctttttatggtgtagttgatcccttaaccgctaaaacaggaagtgcatcaaacgattttgattttgtttaccgtaacttgcttggcgctgaacctgaagctgcaaatcccctcacgtatgtaaattctacttctacgccctttcttatctttcatggtacggaggatgtcgttgttccaatcaaagatagtgaaaagctttatgatgtattagttgaaaacaacgttcctactgaattatacgaaattgaaggtgcaagtcacatggatgtaaaattccttcaaccacaggtatttaaaattgtgatggactttttagataagtatttaacccggccatagatcatttcttgcctttactactaaaaagcaaactaataacaatccaactttcacattattgacaaaatcaaaaagcaccatgaaattactttttcacggtgcaactattgttaatatttatctacttggcttccatcaatggagaaatagacaacttgatttgcaaacctaatccagcagcatatttatttaatgtaggcagcgtagggattgaatctaaattctcgattttagccaattgaggttgtgtcataccgattttttttgcaaattctgtttgcgaaatgccctgtttaattctttgtacttctaaaaaagacaaggtatcaacaatcgataattcttcttttgttgcagccgtctgatgcttatctatatcttcccattttctcattatttacccttcctttcgtaccaatcgtcaagtagcgacaaggctctttctatctgacgaggatctgtttcatcctttttcttagcataatgatttaataatacaaaattatttttcttccatactccataaaatactctttctggcataggtcgtaactcccatagttgatgcctataaccctttaatttttttgcttgtggtgtatgcaacacaggaccaagagcttgtaacatcttaatttgatggcgcatttttaaataaattgctttatcttgcttttgtttactttgcgaaattttctcgaaataatcaccaatttcactatttccatttttatcttcgtaaaaaactacttcatacatgcactatttcctttattatagcttatttattactaattatagcaagattgctatagctttactactattaaaatatattccataatcaaaaatttttctattgaaagcacccgcacactcaattaaatcaaataagtttacggcaatgattatttttggtgcacaaaaattgccgatgttccccagctttacaaactttcaccatttcataccattttaactaaacaaaagctccggtaaaatgccgttatatcagcattttatcggagcttcttttttatacaatcttaaaaaaatgcgtcccccgagcatagaagattgttgatatatcaacgttttgaaggagttagtgtgccaaacgtgtgcgaacttaactaaaataaaaaagagcgcctatcagggcgccccacgttataccggtacggatcaagtaacgaactgaatccaatttgcgtgccgatacttctcatctgatatttaaattataacataattattttatgatacaataattaatgcgtgtcgggagtaacgacccaaactatcacgcaaaaggggtgaattccccgtgacatttatacttctcattctgatcgtgccgaacgggctcgtcaagcaactgatgcattatgcaaaggttgtaatcaaaaaggctctcaaacatctaattgatgaattacttggttaattctgataggaaatgtgcgagatgctatttcagcggtagtgtttgctatcgctgttttttattatactttaagaatatagtcatggtatttttttaccttagtaactattcagtttaatgttactctattaaattttgaattcctttacatccttaacctctatcatattacaatctttatcttcaacgtagacgaattctgacatatcatcaatatcattgaaatctttattagctgcgagttctgcagcatccttaaaaaaattaggccttttttcttctattttgtccatcggtactaaacattttaatatgtaagttttgaaatgctcttgttcccatcttgtttgaagaggcccttttaatggcctacttctaatattatctaattcatatatggcactatcaaggtaccttaaaatttcaggacacttataaatgcaagaataatcaaaatgatatggtataaaaaagccactaattccgttatcattttccaaacgtgctgcaatatcattccaacttccaccagattcaatcaggtatgagtgcccattatatgaaataaaaggattattatttttacagtagaaacgaatattatttttttctaaaaatgatcctaacaaggtactagaatctgttataactttgctaagtggttttaatccatcatataaatagttcctttgctgtgaagaacaagttgtaaagtggtaaaaatatgcattttcaatttcatcttttttatatagttctaatgatctttcagccatttcatgagtcgataaatcaaatatcttgtattttttcttttcagacaccatggttttctcctttttatgatatatctaatttagattactatatgacaaaacaccctagcaaccattaatcggctactagggtgtttattactataatttttcacttaaatctgaattgtttgaccaatgaaaatcatattaggatttgcgatgccattcttttgagctaatgcttgccaggtcttgccaaacttagccgcaattccgcttagtgtgtcccctgcttggacagtataagcattggattgtccgttgccggctaagtagagtttttgcccaacgtagatcacattcgggttagtaatgtgattacggcttacgaggtctgagacagtggtgccgaatttggtggcaattccggataacgtatcgcctgattgaacaaagtaagtattttcgtttgatacttttccggtgactttgaggacttggccgacattgatctggtttggattaccaataccattgattgctgctaggttctgataagtagtcccgtatttttctgcaattccactcaatgtatcgcccggctgaacaatgtaggttccagtagctgggtgaccaatatgttgaaccggctgtggtgctggaataacagcttgcggaacattgcctgatactaaaccagtcgtaaaggcaccgtcaaagtcataactagtatcaattcccatgatgctatgatcagaatattgccaagcacttgcattatcaatccccagttcagtcacaccatagccagcaatccaaatcttccgggaatcaaagccatgtgaattaagaataccgccagtgaagaaggacttcatggagtaaatcccagtattcttgtaaccaagagcttctacttcttgaagaaaggctaaggatactgattgataatctgcagttgaatgaacttccgcatcatcaatcatcaaagtatcgtcatacataccaaattgcttagcgattttaacgaagaatcgagcttcattttgtgcatcagtcactgatgtataacgagcaaagtggtaacaggaaacgcgcaagccaaccgctaaggcattacgaatttgagcggccgcacgtggattaacataagccgaaccatcttcggacccttccgttaacttaacaacgacccctaatgcaccctgagctttagcagcttggaaaaaggcaacagtatctggttgataacttgaaacatcgatgaattgattacgcatattattcttcccctttcattggatcgattgctggtgcttggccggctggaatagtagcgggtttagttggttgtgatgtcggatcaacggttggtgtcaatgcagacttttcataagctgattgcacaagcgtttcaatagcgttaaggtcaatattcttaataccctgcttttgaagtgcttgttgaacaatacctgttgcttgatgaaatttctcatgaccagccatgtctttgccaactaaggaagcaacggcattatctgcaagtcgttcagcacaagaccaagcagcacgagaagtttctgttttggcatgagtgactttagcgtgaataaatgtctggctttgctttaaggcaaaataaaagaccgttgagataacggccgtcatgatataggttggaattgcattaatgattgtgctcatgttgtttctcttctttctctacataatctttgctgagcttgtaaatatgattctttacccaagatggtaatggtagtcccatttggccccagttttcgataatcgaaactaggtaaaataggaaaaagaaaaagacaagcgagtcgcctgcctgtcctaatccgcataattctaacattggataaacggttaaagtcaaaataataactgcagcatgtttcaaaagtccacccgttcctttactagaagttgttcggtgcgtaatgatacttttgaaaaaacctgtcacaatatcaatcacaatcgcccaaactaaccattcaatgagcacgttgtcaatcatgctggcaaaatattgaatgtatagaacgtgttgtggcggttgtgtcagtagtaagtgcatttatagtggtcacctccttataagggtaaaataaaaacgccctgtagaggacgtttaaaattatttaatttttattaaaagattcccaatttccatcttcattattattgattttaattattaagtcgttaagtttattatcaatatcattagctagcttatacgcacttgaatcacctcgtactctagtaatttcatatatttttccttgacgaagttcttcagtcaaagatttaatattatctatttcgttagaatatttctgtttgagattcactttatccccatctccttaccgctaaaataaaagtgttatattacgctgttactaaatatggaatattattatcagataaccattgaactgcattattattaatttttacaacatcatctaaaattttatctaaattaaatgaataaccaaatataaaaaattcatgcttatgaggatcgtatactcttaaagtttcatcttttgtaggagtgaacactttgtctccaacttttatagtttgatacaaattaccaattacttgtttttcaaccattatgtgctgacgtcggttaaatttaataagtccttcatcaatatgttctaaactattcctgaggcctcttaaattttcattttcgaccctattaatatagaaatcatcagttacattcaaaatttcccttaccttttttcgatcattactatttttagagttagaaccccatagaagcttagctatatctgacgtatacaatgcaatattttgtaaattataccaaatcatattatctttataatatttttcatgtttggtattatatatatttttaatagcaataatagtaaaattacataacagataagtttcactaattgcatactcctcgtctttactattcatagtataatgttgcataatatttaccattccccttattaattgtttagtaatattatcgtatcagtaattgaaataattatgatattattatgaaaaattgaagaaaaaccaaaggctaataattaatttacaaaagtatggaatcaaaattttaataaaatgccgcccataataaaagccccgctcgtttgagtgaggcttatttatgtattgtgtatttctaaggcgactataagtaattaccgttaagctaagaattcatttaattattagccattttctttagcttttctttatcttcaatctgatacaagcgaatcttagtaattaatccctgatacgcttttacttcattgggaaaattattagcaggagtaaatttatcatcttcttgggacaattcagaaacatagaatacatttcgataataacctatataaagtttatggttcagtttcctatataatttatttttttcaataatttttgcttctttaggagtataaccatcttgttttcggtcaaaataggcttcccatttaatgcactgttcctgtgaattaatccgatttgtttttaaaccaaatgctgctaatggatacccacctaatttgggattgttacacaattcattatcatattcgtaagcagtattaacaatatcttctaatgattttgaaatattcaagataaccacctctattttatagagtatcactaatttagactactaaacaataacttaaataattttattgtcatgatttatgctccttgaatttcgtaattctgaccggttaccgtcttatattcatctttagtgatcgctccgcatcgtacataaactttgtagaattctaaatcatggttaccccagtcattccaaaacatttgaagcatttgtaattgtgtcatcattatgccgttacctccttagatttttcgactgcctgttgctgattaacagtcataaacatttgttgtaattgcttgatttgagttgcttgttgagcattagtagcctgcaattttgcatttgattggttctgttgcataatcattgcttgcaaaatagtgatttgttgattggtattcccgtttgaatgcgaaataatcgtcacaggaatttgactatcattcataataaagctctccttagtatatttttgtttgataaaacactgttacagttacccctgtattttgtatagctgagttatcaatgtttctaacgattaatccatcgccgtttccagcttctgaaacactcaattgccagcggtcgccttctgcaacatagttaagtattttcccagtaactccaagttctttattgatagcatccattggaagtgtcttgacctcttgcgaattaagttgatcaatagctataaatttagtaatcgtctttaaattagaattgtaatctgtttgatgatcttgcaaactcattcctagcgatgtattgcctaaactaatgagcgaagttggcgttttatcagcataaattctcccagcttgaaaatgggctgagttttgatcgtaaaatttaactccagtattaaaagcctttccacctaacttaaagtgatccacatctagatatgttccagtcgtactaggcccaatatatagcccattcatgctttctctttcagctcctagcataatctcgtttgctgtaaactcagcgttagtttgcagagtgagcaactgatcgcattttcccccaagtgcaaggtaatcaatgtggccctttgatagcataatttttagattagcttgtccacttttatttgtaacaaaatggctttcccaatgtttgatagttagatcgtaagttgaatcaatcactgatccaatagcattgtctgctatatcaaacgtttcctcccacacaaaagaatattcaccgaaaccggattgttgcgataccgaatgctgatacaatgtttgatagcaattatagttccaaagtttgattttgatcccaatattatgtgtgttatctgcatctgtaccagttacgtttaatatacatcctctgaaataataccctttaatcgaaatattactatgaaacatggtatcaaaagaaaccccatacttagctgcacctcgctctagcataatttgaatatcattttgatttccatttctaaatttgaatgcaatttgatccacgtttagtgctggtgttaactttaacctcaacgaaatatgagactgcttcaagtcaatagctaatggactttcaattagataacatccattcccatgaacacttttattattatcaactgcataggttagaatgctttgaaggatttggtaatcatcatttttaccatctccatgtgctccccatgtttcaggtataatttcattttcaataagttccgctaatagtcctgatgctaattgttctgcatgtttagttgttgtatctgtgacataaaaaagccctcctcctccatcatttggttcataatagccaagagttcttgcgcacatatctttgcttaaagcactatcagctttcatggcagctacatttggatacacatgtgcatagttaatcgcaattgccttcatcatttcctgcttaaacgcctctgcttccgcctgggtaaacaaattgtcttgcttaatcttagcgtctagtgcatctaaaccattttgaacagtaacgccaagagctttgagcgtgttcattgattgggtaaacttatcaataaagtcactggtcatcttggtgagcttgtcggtactgtcttggtacttggcttcgatttcgttaattaactcttcgacgggtgaaatatatgttcgtggtaccaagccatcaatgaccttatcagcaaggacatcgaggtcgaattccaaggtagtgatagagttaccgtctttgaggatgcgaaaaaaggcttggcgataggaaccagcgactgtaaaggcatggccgggcatgtcgaaacggaaacgtccggcggttgggtcaagggcaacgtagcctttatcatcaattactcggaagtcgccggcggaattcttaggaagtaatccttcaaaccagacgttacagccagttaaatctagtggtgtcccgtcttcgttcttaatattgacaaaaacttgacgcatacttcgctcatactgacgcgcttggacccagttagtattactgccatcaaagttaaccttgaagtcttgtacattgtcaacatgcggacgccggtcttgaccgatcacataagttaaagtttgtgacattaaatcattcctttctctttcaaaatctgcatgacagcttgttcaaccgtttcatagtcggtccctaaagccacatgctcaattttctttttccacgcttcttgagcctcttttagttcatctcgcgtggctttttcttgttcgagttggtcgagacgagtattaatctcctcgagtagcctaatcaattctttatactgcctgtcacggagattatcgtctttgttatcctcattttgaattatcgttaaattatttattaattgctggcggaattttcttccactctgcaaatctagattagtttctaaatccaaatgaccatccccctcctcacttcaaactactccaatccgtcactctgtaacctagatttacctgggcccgtgatacgtatgctttatcagatccggaaacattaaaaaccagccttcctttagtagtgccggctggaattttaatgttaactgtgccggcggattgccaggcgccattattgacgatatagacaatattcgatttgccggcagaactaccatcgctcttcaagaactcgacataagtagtagcggaacttgaattatcggtcgcatttaacttagccatgagacgacttgagatggaggagacaccgttgaggttaaattcattgcttctgagagtgccttgctctacttcaattactggactgtcattatatttttcgctggaaacagttccgccagtcatcatagttaccaaattatgctggccattttgcatccagtaaatattctggtctactgcttccatattcttatccgtctctttcttatcattcacgacttgcgttaatgacttggattgctgatccatgctatttgctaatccactaatccggagtcgttgttcttcaagagcttcttgtagacgtttagctttctgattttgataatctaaaatagttgtttttgaattatttaacgttatttgattatcttgtcccttagcttccggatatatcgtataaccgacagtcttataactacctgaatatttatctcgcgcaagtactcttaaaatttcaccagcaacaggtacaaatgaatttccctgaagcgtgacttcaatatttaaatctggatcaggtttaagagtagttaaggcatatttacgcattgcatccgcatcttgaaatctttcatcaacaagatcaggtccaggatgttctccccattcgtcaattgacttttgatcaactaccataaacggttgaaaataatactcttcctgtgattctgtggttgtatcatttccgacagtatcattggtttctttaccaccgataccatcacgaataacttgtaagggatcaagccaggttccatcatttgaccaggcacttttcaatgcagtcattaaattcttttgcttagtaattccaatatgaagatggctagtatcacggtggccaataacatcccccgtcttaatttcttggccaacttgaacagtaatatctcctcgattcaaaaatgcttcttggtagcaaattaaataatcattcgacacaatagttatatagttttccagtccagcaatgtatccaatatcctggactttcccaccatgaatcgcatgaacatcgcgtccaggatgatcgacagaaccaaaatcaaggccatcgtgaaaaccattagttcgccccactccatcttgagggtgtgttccaaaagtttgccccaatgaaaaatgaccttctccaacatctgggaaaggccatccccacggattaggtggtgaaatgatcaatttatctttcgtgattggggcaccatgaggactccaaccagtaacaccattaatttgtcctagtgcattaggaatattgaagaacgcaattaactggtcaaaaccctttaagatatttgtatagggctcccgacaataagtattaaaagttcctcgcttaaattgaagtaacccaagcgccggaccagaaccatcgccatcgggatcagttcctggttgcggaatcgtctcgtttccacctgattccaaatgaatttgtgcccgtaaaacattaagctgctgagcattcggttttattccataaaagctagcagcatactgaataactggtgtccaatcaccgttgactggctcagttggtccattagcattagttccacctgtcccggtataaacagtgtgctgaacctcatgcttaccaccaacacaacgaatcatattaataattgattgactgtcccgagtagttttaactgactttgcatcccttggaaaatcaatcactcgaccattatccttatagaactcatcttctgaataaactcgtatcttcttgttatccggatatataactgcacttggccataactcagtaatcttactaagcatctctttaccactgccgctatcgaacttagaagttgactgcttatcaaaattaccatgaacttcatagctaaagcctagcttatttccatcaatccaagcctttagtaagtcctcaactccataagactgatccttactagcattactatcctgattgttatttaaggtaaggtcacttcgtttataaattcgactaatctcattatagacatgccaagcagtgatatttttcgtattagtatcaaagttttcaacacaattttttacaatatattcctgtccctcaagcacaatcgaactttcaacatctaatggatcatacaatgctgaatcgtaatcaaatactgaaaaagtcaattgaaaggtcgaattcttagaccactcgctttgcattgttggccagagaataatgtctccgattggctccttagttgtctctttatgaggtgtcatcaatactaaactaattgtcctcacctcctaaccaagatacataaatgggaaactgaatgtaatttccaaatcatctgcaccagtaacttcaaagtcattctttccaggcgctaaagtaatatacccataatcggtattggcactgtctgggttattattcttaaatgttcgccgtccctttagcaagagagtatcgtttccagatagattttgattgtacgtccaagaagtattagtagttgtattctttactgtgaattttccaccattatgcttaatagtaatttttagatcatgacgctgttcaacaggatcgattgtaatatcactatcgttaaggatagaaaacttattctggcctttgaaatggtatgaaggagtttcctcatccatgttcatattcaagtctaagaaatcctcatctttcatctcatccgtatgcaatttactaaatcgcattccgcttggattttcaaaaggcacttcaaacgtacaatagttaacttcttctggttcgcttttaatctcaaaggaactagcccgacagtaacggacaatatccggctcaactcctgttcttaacctaaagattcctttttgtgcaaaaacgcgataaatctcatgctttgccatcttaaaatcttttcgatcaaagaactgcaataagaacttagcggtgatcgtcgtttggccataacgggaataactccaaatttgaccatcttgttgggaatcatcacgataattattaataacactaggcgattcagttaagccaagaaaagttaagtggtcagtaatatctgtgctggccacttctttttgatcatcaattttaatgtaaagaatgtttacagcgattacgaccacctcctaaagatgttgattatcaaataatgcttgatcagttccttcaatcccataaaactggttcttgtcaaaggcgccggctttaattgcagaaagttgagctgcatttaagcccagcattgtcccaaagcggttgagcatctggtccatccgatctaacatctctttttgcattccattattactttggccaccgttattataattatttacaacttgggtgctttgcatattgggcttaaagttagttaataccgaaacagcatcatcagtaccattagcatattgtggtaagtgcttaaacatcttagcagtatcgctagctttaacaacttttgttcctcgtggtgctggaaagactacattacgcccataaggaataaatggtgtttcacctgggaattgaactaactcacgaaagacggggccaggttgatcattaacttccatcaatccacctttatggtaattagttccctgagcatgctttgatttatgaaaaataacattaactgttttctcaatagtattaggtatactcataaaattatggattgcatcaagtgctgttttaattggcccagaagctttatcattagcttttgcaatttttgctggtcccgtatttgatccagcaaaagcatttacaccattgcgagcactatacattggtccactagcattatcaacggctaaagcatttttaggagcgccaggatttgaactagcaaaaacatcgacaccaccagtagcatttctcatcggaccactagcattgtcaattgccagtgcattctttggttctcccggattagcatgacgccaagattgaagggcatcgttagcagcttttagatttccactagctttatcatcagcaatgatttgttttgcagcactaaccggcatccccttccacagcccataatcagtgatcagttgctgtagttcgggtccacccttagcatttacgattgcttgctgttgcttaggactaagttgattccagcgaccaattttattgagcgcatccattaatcgaccagcaccctgagtagtaaccaaagcacgttgttgcttaaacgaaagactattccaaacaccagcctgcactaatgcatcaactaattgtggagttcctttagcgtcaataatcgcttcctgttgttttaaggttaaattattccactgtccggaactttgcaaggcttcataaattggcttagttgccttattagtaattactgcttcctgttgttttaatgacaaggaattccatgcaccggattcaagcagaatgtcggccatttcttgcttacctttagccttaacaattgcttctttggtcttaagatcaagattattccattctcccgacttctctaaagcttgaacaattgtttcactaaagccgtctttcaaccaagctttctgctctttccaactcatgctatcccatttaccattttcgattaatgcagctgccaccatttgttgagcattggtacttaacttaccttcctttttcagaagtttaatttggttccattgatctttagaattaacagccttattaacttcctcctgggcattagtccgaactttaccagttttgggatcgaaaactaagtcattccacatatcagcggcttttttagcttttccacttaatttagtagtatttaccgctaagctttgtaggtttgtttcggcagctttggattgccgcttaatctcatcagtgccatctttataactaagtcccatactttttaggtcattcttaattaatttagtactttcaccattagcacgggccaggcgaatatattcggcagctgctttattcgtgtaatctgttaatgctttcttattagcacgcataccgaccttatacagttcagaatcttttccgtagcgtttagcaagcattgaagactgcttcttgtattggttttccatttcagcagtttcactggttatatctcccatttttgttgagcgttgttgcatagacatatgcttaatatcgttattaaggacagccattgctttagcacgcttacttccacttaatttaagaattttcatctcatcgttaagcatttcctgctggttgttctttaacatgactcgctgagtatcatttaattgtgaaacttttttattgtggtcagatagaattgtttgaacacgctgattggcattatctgcatcattcacatatgaattatattgttttttctccttttctaactcatcgtcaatagctttagatatttctggagacagacctttttctgcctttttggcattagcaaaatgttgttttgcactattttcaatattagtaaactcacggtcaaaatcagcagctaatttctttgttgaagttgaggcagcaacatccatatctgacagagtgttctgaattccttgagaagtcgactgcatttttgataaagccttatcagcagctgcaccaacatcagatccccaacgattcgttcgttgtgatgattcgacagctttcttaccccaaagctcccaaacagtaattccaccggcaatggctaaagtagcaactccagcaacagcggcaactgttcctaaagatactccagccgcagcagtagcagcacctgcttcacctgcagctacaccggtaccttgtaaagcgacagtcgcagcaccaacaccgttagcagcttgaaccgcccgaccacctgcaccagtcatggttgttccaaactttgcagcttgaaatgttgattttgaaaaagctgagccaataacgtctaacccactggctcctagtttcattgcagtttgtacacggccgattccggaagcaatttttccaaaggcaagaactgtcttcccagcaccactagtcagtttacccaatgctaggaacaacgggcctgcaccagcagtgaacagggtagttgttacaattgccttctggacagctggtgataaatcaccaaagccatgtgcaagtctggaaaggccttgaaccattggaataatagatggtaagacgtactttgccatatccattccagcgttagttaaagattccttgaagattgctaattgtgctttaggagattgaaggtttttctgtgacaagtcgccgatataatcccgcttggcagagttttgaacttctttattaagttcacgtaaccgattagcgttttcggttaaaattgccccagcttgttgtccagttgttccaaataacgcatgaaaaatatcattcttttggtgaccagataagcctttcatatggtcatttaacgtcttaaaaatagacgacattgattttaactttccactcttagtaagaaaatctttagtacttaaattaatacttgctaaagctttttgaccattagcggttggcgtaattagtgaattgataacctttcgtagaccggtaccagctttgtctgcttctagaccattattagacaagatccccattgcactagcagtttctgagagactaaaacctgcttgatgagcagttgagccaacatatgacattcccacaccaagtgattgaaaatcagttgatgtggcatcggcagcataggctaactcatttaatgttttagtagatctacgctgcatgactgtagcattcttgattggacgtcctgctttatcagtagccagtccaaaagattccattgtctgcgaagcaactttgattacatcattaaagtcatccccagtggccacagatgctttaagttcgttccgcattactccaattgctgctttagatgtataaccacgctttactagatcttgatacccggcagcaatcttttgctgactaacaccgtactcgtcagaatactttcgggcatctgcagtcatcgttttatatgcggcattcgtttctgcagctgattctccggaagttcgaataacgttcttgacctttgtcatttgatcttggaagtcaacgagtttcttagcggaatatgttaaccctgccgcaattggagctgttaaataagtcgacatccctcgaccgacacctgatattttagaaccaacattggtggccacatttccaaaatgttgagtgcgattagcaagttgtgtccacttattcgactgcaattcaatatcacgattaagagcttgcattcgtccacgtaattgttcaatttgcgcagacgttttattatattgggttgctgccttagttcgtgactgctcgctcctggtagtatcatccattgctttcttagcattctggagttgcgcattataattgcgcatttgttgactcatagtcgcataagcagcacgcatattattaatacttccaccggatgctttcagtgccgcttcttgcgcacgcaaagcattggctgttgatttaatttgcgcttttaaaacaccattagccgctttaaacggatcaatatccaaactaacagttgctgccaaatgtcctaatgattgggtcattatttaacctcctttcctagaataagaatgggaatgctttatcaatggttgtctgcttttcttcaaagacgtaattcattaatttcaaatctgaaagtgttagcttactgacctcattccatttatatccatcgcgcattttatttttaatgaaatctgtgagactcttgattgaatcatcaatcatctcaacagttatttttttggcttttcgttatcctttttctcttctaagtcatcttcacttagaggagaaccgagagtttcattaattgcattaacaatgctaattaacccttctatagccgtaactcctgaaagaacatcctttttagtcaatccattcttccaaaaattagcagcaaactcagcccgtaaacttaataatcgttcattatctttatctgttggcaattttttgggatcagagtacatcactatttcttgacgttgaacctttaatgcatctaatagattttcaagcattggggcttcttttcgttcatagattgtttctttgccatctgtttttacttttaatttatatggcatttccatatcctcctcatcgtctcacttaactcgtctctgtctgattaattagttaccctttatcaacaacagtttctggtttagtatcttttgtattggttggatcagttactggagcttcttccccaaagaccattgcatggaacttagcaaaatcaaatccttcattatcttcccgaccgattaaaaggatggttccagtatccgcatccccacgcggaacgaaattaccttcaatttcatctgcttctgggtctggagcaccgtcctgagtcttgattgaaatacctggtaaggagaacatccccttggttaaaccaacccaacaatgcttcccgtttgaaagctttgtccggaacatagtagcaacataatttggtacaagattcttagtataaacttctgtaccgttctgaatatcaattccatacaagtctttcttcatgatggaatcaatatcataaaggttgatggtttccttagcttcggtaattccaccagaaagaaccaagtaagggccgtcatcggctgctaacgtctttaattcgttagtcagctccagcttaacttcacttaacccgctcatctttcgggtatctttaatcttttcgttctcgtctagcaccccatattcaaaattagaggccccaaacttagcaacttttgcatttggtgttcccattaaatatcattcctttcttcaaacccttcaaagttagctgtgaccattatgcaattatccaagtccggatccggataagaattcttgtagtaacgttcaaagccatgactgtggagggtttcatatattcgttcttgaatatccattagccggtcatcattctcttcacgaatccaaaaatcaacttgtacacgtgggtattcaaaaaagcgagcattgtcactgtaaattgcatcatccccaggtaggggggtgatccgaatccacggtgctgaactcgctttaataaatggatcatcaggcgtactagtaaaaattggaacatatgataatttatcttgtcgcaactcatccatcatcacgactaggcactcatcattcgttagataatcggctacttgcatctctggagttttcatactttcaagtcctcaataaatttagccaatattttcttcttagcagcatttcttgaatcttcaacaaagtgttgtggatcttgcttagcagttccagcatcggggaagtgagcaatccatcctttatctttgtcataaccaacatcgacagaataatctccaccgttagtcttgagattaccgtgtttagtatgatcttttaaaggagtcttgcctgaatgatcagagcctttagaagccacaggcgtccattttcttaattcttcttgaaagactttagcaccatcacgggttgcttttcgtgccttcttttcttccgtcttttcaagtttagttaagttagcaatcagctctgcttcaccggtcactgccattttggacaacctcctgggcggtaatttttgttagatctcgctttgcataatcaggatccattcccgtgatttcataccattttcctcgccagttaattaaccaattcgattgaatttccttacgagttttgaaagcaattaaaaacgtgggtgattcttttctgaaccccacgtttgaactgttttggacaaattcacggactgacagcttaggaacttctgcccacacggtaaattccttaactttctgatccttgatcggtcgatgagtttccggattgatccccatttggactgagtaaaatgttatccgttccgtcatgttccgtagtttcatcggtattcacctcactacttatttgattaataaggccatcaattcctgatgaaagaactggtcggtaactatctgcagtaattcctcgctcgtagaagtcttctttcacctgcttcataagtgcaattttgaatcgcggttcgtcagagtagtcagcaggcttactctcccatttaattgcccttgcaatcatcaatgcggcagcatcaacaattattttaagaatttcatcatcaaagtcctggtcaattttgcagtagttttttagattggcaaagaattgttcatcactcgagaaagtgtggtctgtttccatcctactcacctagctttgctaacagttgatccttagtatcggttgaagtataggcaattccatgatcatctaagtactttttgattgtgtctaccgtatcagcactagtcggtttaacgtccgccccgttgtcggacggcgttattttgacgctgctgatggaccagtaacaaagtaaccagcgttttcatcggccttcttcacatctaaacgaagaaccgcttggagatattgaccataaatgtcattatcaacccaccgtacctggagatcttttcgatttgctaaaataattgcacggtatggatcaccaacaaaggcatgagcttcaccctttgctccaaataagtcatcttcaattacagcaacgttgattccagagaccgctttaccagacggactagaaatactatcttgaagtaagtaacgtccattcttatctttcaatgtatcaagccagttgtagaagctttggctggcaataatcatcttattgtaagccacatctaaatcgacattccaaattttctttaggtcatcgattgcattagagccatcaacggtcttagctgaaaatcccttaaaaattgtagcaatagccgcattctttgtatttaaggattgttcttttgcgtttcgagcaactaatccagttaaatcaattgctgaatcatcaatcgattcttgtgaaataggaattgctccacgataggtctcaatttgccatgctaccttaagaaattcaggtttttgaagatcaggattctttgcaagttcttcaacagtatgcatttgagcagttgcctttttaagaattggataactaccagaagcagttgtggcgttaaatacttgaacaaattggctaagatcagttactgttttaatttcattttcaggattgtaaatgattgattcaggaatagtaacgcttgcgtctgaagaagtaattccagtagtaccatcacgatgttcttggtgaagatatgcgttgaaattacgtttttcttcattttcgtcctcgttattttgagaacgcttatgaggatctggagctggattacccttagctgctttacggtaaagcttaaggtcatcttcaatactccgaacttccttttcagcagcttcaatttcagaacgtaatgacttagctcgtgttaagtcttcatcagttgcgtcttcatttgagagcagttggcgcatttcattagttttttcgttaattaatgctcgcttaccttctttttgagcaagcaattctttaattttttcgcgaaacatttaatttcctccttcgagtgtcttcaataattcttgtcgttctaattcacgtaacatctttttacgtttctgatcagtagcatctctattttcttggctctgcatttgcttaaccatattgatcgaacgctgaccgacctgaacttctgtatccggataagcaggtgttgtaactactgatacatcgaacaaacgatcaatttgtcgaatggttcgttcataatcaactccatcctggtcagattcttcccaatcttgggcctcatctgtgttggccaccgtaaaagcaaagctgcattgattaataacgcctgccttgatattggcgatcaaatcacgcgcaaatgatgtatcagttggcttaacagtgaatttcaagccaattgcatcagaagataaagtcatgttcacccctgatcgtcccagtacctggttaggatcgtgattgatcgtcgctactacatttgacatatcagcgtcatcgaacgctcctggagcaatttgctcaataaagcgagtaaagccacccaaaacttcggatggcttattgtatttggctgcataaccttcaattactggttcatcatcttcatcagttgccgttctcatctgaattggcatcattaactgtcgagtttccaagtcgcttgtcatcgattccacctcccttcgctgttgattgtttctgatactcttcttttttatcaaggaagacagtattcaaggttgattggaaacggtctaagtctggattgtcagatttgactaaccccatccgaactcgtccttcattaggagtaatgacgttatttgtaactcccttttgtacatcgtccattgacatccctgtttctttgcgtgtatcaaattcgatgtggcagttatgacgttgccgatcagtcagcattgtcatttccaaattacttgcaatcggcttgaagtaataaggtaaatcagaagtaataaagtcttcatttaattgtttaatcgattggttaggactattaactgctaatttatatgctggaatatgcaacgctttggcaatttgagcagttgaatagttgttgctgttaattagttgcaaaacattggtatcaatctcaattggcgagtaatcgaatgtatcatcagtaacgattgggctaccggcattgctattagcttgtgcatattcaaacgcctttctagttttaagacgcgcttccggacttaacttacctttagcctttagtaatccacctttaagacctgacttaaagaaccgccgtaaagtcttaattccatcatcctgtaatccaatctcatcagccaaagacaacaacggcgaccggccatgaataccatcgtaggtaaagaacataaaatgaattacatcttcagccggcacaacgattgtttgaccaccgcctttttgattgataggtgtaaattcgtatttaatattcgttacatcagaatcatcaatataggtttgcgatggtggaaaatattgtatttctaacggtgcttttgtatgaggatcacgaattattcttgaaaaaccatccccagttaaaattgcgttaactgtcattaggaaacgccaatgataagcagataacatatcgtttgggtgcttattcagcaaataatcaacacttttgatattctttactgcatttttaccatcatccaaaatgacaatcggaaatcgagctacattactagcaacatgagagactgcagtcagcacatcagagtttctaagagcaccgattccactataagatggcatattgctaaaccccggaagaatcccctggtcaatataatcttgtgcccattcgcgtttctcggtatgaaataacactcagcttcaccccctttcataagagataaaagccattacgaataattcaattgaaataattagtaagccaatcttcgtggaaaataaaaagcctgtaactgctaaacagatacaagctaatatgaacagcaaaaccggttcgtttagtttccagaatttcatggcatcacccggagaagaaatttcaagtcttcatccgtaatctcaaatttctcaatatacggggcaagctttctcagtcgttccaatcgtcccttgatttcattaagtgcgggagttacatcaatcttcattccttcttcaccgtcgtatagatacttagccatgtctattcctcctcgattcctttgataaattcaattgcttccttagttaaggccaatggatggaaatattctccatctgaacagtcattgatgatcttcccttttaataggtgctccacatcatttttagtgataaaggtggtccagttgctatcgttgccatattcatctagttgcttaatatcatggctaaatttatctttttcagaaaccaaagtcatcattaaacacatcctcatctgttaaataatcatcaatattttcacggaaacaaattgcatatgcgtctagcaatgcatcggcagcatcaatcttatttgaataacggttcttatcaatccggacaccattgttatctgatttaaggatcgcgttagccattgcgccagttaaaatttcattgtcagaatgtcgaactcgcttatctaaaatatcatccctaaattgcttggttggcattgaaagagttagtgttccttgacgaacagatatctgttgccattccggatgacctttttcaatctgagttaacaaggttccatattgtgcggggtcataacaaattgcctgaacatcaagattgtgttctctgacaaagccatccagccattcatatacccgttcaacatcaataactccagattcaagcttcgtaatttcacactggcccatcccttgcaaccggacataatctaaccggtctgctttaatctttgcttccaaaccatatttagtaccgacaaacgcataagaatccgcataccaatacccctcttgaggaattaaccaactaattgcataaaggtcagatgatttaccaacgtcaatcccaaaccaaactcgttgaccatcaatgtcaattggatcaatttgagctgcattccaagtatcaatatccatataactatcctcttcggcttgtcgccacatattaaagttcttaactagaacagaattctttgtccctttctgtttagcttctttccaccgctttgccaaatatccatatacctggtcttgcaaagccgggacactcagaattggattggatttaatccaggtacttttatcatcaacttctgatacattatcttgttcagcaatgtaggcaaaataagtatcatcagtaatttcacctttcaaaaccttcgttgcatagggatattcaattgtatgcattggaacattcaaatcaaagccggctgttgaaataatcatgataagtgagttatgaagtaaggcctgaccggattctagtaattccatcatttcagtggtcttacttgcagcatactcgtctaggattccaacatgaggttcaaaaccatcaaccgttcccgtttccttggaaagagaccgaacataagaataatcatcaaggttactaattaaatcacgattaacttttgtcccacgttttgtatcaccatcactggaacgtagagcattgaggcgtttcttaatcatattaaaaacgatgttcgcttgctttttatcgttagcggtacaaaatatttgccgggagaattcaggtgagttacccatcaagaactcatacaatgcaattccggaaataaggatcgacttaccattttttcgtgccattgataacattccttttcggaagcgccgttcagatggcttgtcttttttccaccagccatacatattagcaataatgaaacgctgaaaatctgctaaaggatacgcccgcatcgtttttggatccggaagtatttccatgaattgaataaccttattagcacgttcattatcataaaaatattcaaagtcatcgttatccgcctttttaagatcatttaagtacctttttgcagctaaaatcacctttttaccagcaactattttgccggccacgaccttttcagcataatctttagcgtaattcatcatgaaatcctaaacttatcacgcaaggattgatgctcttccttgtcagtttgtggcatgttcatctgcagccgcgaattaacattaagcccaagatcagatgcaagaccctttattgccctggttgctttatcaattgtcttaattgcgttattgattttagcaatgttctttcttttcttggactgttccttatttaattgaacggaagcatctttataaatgctgtaccaggtacaatacaattccaattcgctccggtccaagttacgcaatggcagctttccgatagaaccaataattcgccgatattccgctttggccaccttatctaaatgtgccggcggagtcttttgcaactcaggtaaaccatcggcagccataaattctgccttatattttgcttcttgttcaaccactctaaggtggcctgttgactgcgataataatttttgctttcttgccaaaaagctcacctccgtgctatgataaaagcatcaagaaacgcatatcctcaagcttttaacagcttggggattttttagtatcgggcctaaaaatgaaaaattgttggaatttatcgtgcaaaaaagtcgatgtgcgttccagcgttttgaaaaatctaacccccgttcaaaatgaaggggggcttatccattcttgacgacccggtagccggtaaaatcagccgttttgaagccattcaaaatcttctgaaatgaaatttgttctttccgttcacataatcgttcctcacagacgtttggatcagtcatgataacaatatgattgattcgatgatagttactaagcaatgtatcaatccgcttatctggtaacgtcttaatgatccaaacattattgaatgtctgttctgcctttagctttcgtaacatctgatcaaagaatagtgtaatgtaatcgtggatgtcgtgattgctttgttgcattggtaaaccagataacgcatgcattagctcatcataatcataaataagatcatgctcagtcatgtgtcgatttacatatgttgtcttgccacttgcaggcaaaccacaaacaatattgatattcatataacgttccaatcctttatgatgtttcatccattcacgtttcgttttaatcttatgacatccccgacagagtgattgtagattgtcattattaagtcgatcactccaatcgtccttgctggggatgatatggtcaaccagttctgcatccattccacaacgctgacacaatccataatcacgttcaagtatctcttgtcgcttatgcttccattctgttgagtgatagaacttaacgtaatcattctcttcaacattacgatggaaattatatgctttgtcgttatccttgcgaactatcttgtcataggataccagtgttggcttcccattgataaaggttagcttggttggtttcaatatactcatcccctttctaatatgtatgagggcaaaataaaagacggtagccatttgctatcgccttaatcatttaatcttttatgtattagttcgtctaattctttcaagtcgtcatcagtagctaaatcacggataaacttacgagcatatgaacggtaacgatatatccgattcttatccttgttcttatcgtcccacttcttcttggctctttgttgtgcttcactaaccataacatcgaccttctaacattaatatggtatactatatatgcaaaaggacaagagctgctacctctcgtccctttgcgatccagaaaaacgagtttgctggctaaccgctatttgcgattagctttttttattatcgcatatgcaattgcaaagttgatacttgcaactgatattgctacgagagcattaacgataactgcatcctcaggtttccagataaactctttcatccattgaactcgcctccatccggatagaaaggctgtcgccggatcgctgtagaatattgataaggtcgcgactccttacctcatctacatctattattataccttattaacatataagaaacaatagcaaatcaaatctttttgagtataaatttagccgacaagcgttgacctgtcggctttttattttgtattttattcatgtgtcgttcggctctacacagcatttgatattcctgcctagatgctaccaagccaaaccgtttagtctgaaacattttaatcctccaaacaaaaaagccagcaaacattagcctgctagcttataaatcatttattaacaccattatctatgcgcaaaatttttttaattctattgataacttcctctgtcatctttttgtatccgttgtaattttcttcatagatgatcgtatattgcgttgaaatgtcaaatggtaaatgatttttgtaatcagtttctaaactcttcttactacataatgtaatcacgcttttaccgatagtgtcacatattccaagctcatagaaaacattaggatttcgattgctaatatcagcaataataaaacttgaagcgcaaatatcttgccaaatattttcgataatattattaccacgagttggatcaaatcgatcttcagactttatcaattcacattcaagcttgttgttactaatctcatctttaatcgcttgcattgcattttcaggcccgtcctcaaagggcaaaacataaaatccttgattaggttttacaacgatatctctagcctgaaatcttgggttaaaattcattattgatcttttcctttcaaattcatccctaatttgttgacgcgctctcataaaacaatgaagaaacgaaaagcttgatcctgatacattaatactttcattttttaaaatggcttgcattaaatcaaacaaaccactaaaagcttttagcttttcagttctgcttttatcaaaattttcttttacaaatgtaagactgttattaaattgactaatattcacatcaaagtagcagtcaaatttaaagcccagctgttgtattcctatattgttagcgtcctctaacgaaggcaattgtgtttgttcatgtatttggtatgcaatagtgttaagctcagctattgctttttcatcccctaagaacacccgaaaatcaactttactaaaggacacaagaacatttttaggagtcataagtgaataattaaactcccgtatatcaggatccaatgctaaaaacaagaaatctaagaactcataaagtcctttgctttcaatgtcaaagaatttttctgaatccttaggcttatgcaaagtattaaatgtacttgaataatatgtcaccttattttcacctcaacactataatacaaaaggccagccgtaaagactagcctgaggtaaaaataaaatgtagtagtttaacgtcgttgcggacaatcaaggctaatggaagaaaacatctagtaagtaggtgcttcctcctttcgttgattgttgttaaaagtagatgagccttgaatgctgatggacggaatcgaaccgccttctccacgttgaaacggaaacaactgtggtgctttaccattaagctacgtcagcataatacagaaatgcttgcatccactaatcgtttttgaattttgttactcattgcatctctgcattaaatcacggcttagacaaaaaagactatgcaattacgaaagaggagcgttcatctcctatcatagttaaatttgccgtgataaagccgagaggtggattcaaaccacacttttgccacacaagaccgattgtgtgcccatcttggatctcagcaagcagtgcgactcgtaaagcactgcaattgcgaatatcgggaactgccccacaaatattggaccactccaggatacttggcatctagtttgcatattcgcataatcaggaccacgcaatcaccgcacccggtcgtagttttccgcctactcctgtaacggtattgctgtccattcatacggtaatcctttagccgttgagttagattacgtactcttctgccgattacagcacggttgctacgagactatcagagtagtatgtaaatttaatgatctaaaggagatcttccaaaacgcacaaaccaaatttaatcgttaccgtaaatttattttgaagttagttaatgatagtctcaacgtggattatggggctcagacccatcagtcagtcaaacatctgatccacactcaagcttaacaagagatcccgtgtggtattaagcatagaaatctctttccttaaagccagaatcctaaatttgagtagttaaaggcttgctcaggcacaattgggggtcacaaggctacatcgctaaccttccgacaatatcattttcgcacttaaaaacgggcttgaagttcactaatagttcactgtttgttcactcgttgttcacttttttcgtccttatatgcatgaagatcttctagtaagtcagcatccccgagcaaactagtatatctttccagcgtatccgcaaactcactacaagcaatttttaagtaatgatagtagcgcgttttttcataaccaatttgattagctacttcccaatcttttttattctgaataaacttagcaattaatattcgcctacttctaagactacatgcgttgagtgcttgagcgattgtctcaaccaagagatggtaattagcaactttaaccatttgattttccattgaattactagcagcacttgctcttggcattccgtcaatttgtggggacgttagcttaattcctccacctgctaagcgacataagcgtgcatattcgtccttaaagaaatagcgaacattatcagtagttccgtcaacatctaattcttttaaaagccccacttttagcactctccccattttgatataatatttatgtttgataatttgaaggagcgtgccattactgtggtgcgcttttttatttagtatctagataatactagaacaataatcaatgacactaccgaaaagattaatgcaaaagattgaagattcattattgctcatccctcagataaataattcttgcatccaagctttctaaataagcttgcattgaccttagctgtgcatttagcattgttaattctaatggggatgaaagctttggtccctctttaacaataaattgagctagccgatctatcttacctaacagatcctttcgctcctttgataattgctgaagtacttttcgtttacttgtcattgtattttctcacctgattagttcgccgttcctcgaagtttgcttgttttatcgataggacagttcctaagacaaaaccaacagtaaaaatcaagacggcgccgataattaatagttccgtcatttatttcatcccctcttctgctttttcttcaatttttctcaattcccaataaagtgaagaattggctaaccagtgttttttgccacgatactttgttcctttatagaacggtagctcaaatcttcttgctaggtctttcatcattaagcgattaatctaatacacttttcttctctcatcgctcttcattaatttttgatactcaacaaggattttatgtaaatttcgtcggttaatcttcatggcttgcttcctcattaaccaatagcaacgagtttagccatatcatcgtaattaattctgaaacgctctaagtggccaagattaaaccgagtaacaataatctcgtcaccgtaaagtgattgattaatgatctccctggtagtttctcgtactgataatttaagaccgttatgaaaaattatttgtgtccgcattaagcaatcaccggatacttaatctcgccaaatgtttcttgctctagttgctgaatgtgcttcttaatattattctttgcttctacttgccactggttgttatcagccatgaataatgctgattgcatcccctcacgcattcggaagataaatttgcttgctggctgatcaacttcctggaatgtccggaaaggaattagctttactggattaggaaccttcacttcatcaacactagcaacaccagaattaatctgaacactttggcttacaccatcatcggtttgttggtgaatgctttcatcacgaagattgctaacaactttcagaatgatattccggtcgtcattctcctcaaaatgtgactgcagcataataatcatgctttcctgatctaagtaactttctaagttaagactatcaacgactgcccgaacctcagcaaaacaaggacgttgaccatgaccatttaactcgccgactacttctactttagtcggactaacaacatgaattttgatactgtcataaattgcttgagtctcactttccagccattcaatcaagctagttaactgattcaattggaggggatgggcaataatcggatcattaagcaatgctgcatccccatcgtgatcaagaagatattgccgtccatttaaggcagtaaaaagattgttgccattagcatcatttacgagttgttcaaattgggttaattcaccgttaatctttgtttccatgagttagttctcctcctcgtttcgttttatgatttgtttaattaattccatacagtcatccatgacggtctgctgactaaagggaggctgtccggcatgagcggtatcaaagccaatgaaacaaccgtttggcagattagctaatttaccatattcaggagtccatgttatgcctccatatacagataagcatgattctgtttctgataaatggttgtaatagtagtcacttggcaataattcaacgtacccacaatagtaatcttgaagtggtgagaatgaagtaggtattccagcaaattgacgcatttcacgtataattactcgtcgacctttgtattctccctcaaaaactgttttattaatatttggctcttgcatcagttagttctccttcttttgtaaatcaataaccttccgcttttcttctttttccacttcttctactggttcgccagtgtccatcttagccttaccatcatctggatcgatgtaagtttgacccttaatgcctgacttcaactcgttaacgtgaactttaccgttagtgtcacgacctagaagcatggtagttggtacaccaacctctggagcaagggtggtcttaacttcaaccgtgacatctgaggcatcccgtttttcattaggggctaacgtgatattaagttgtaccttccgctttttagttgggtccgtgtttggatcaaggatattatctgctacttgttgtaatgcacggttaagcttaacttgcacaccgccatctgcaatttccgataaatcaaaattaattgctttcttcttactcataactcttctcctccacttcaataaacatttgaccatcttcacagtaataattaagtttccagccattgcgtctcatcaaatgaattaacttctctgcaattttttgcccgtcaatgccaagattaaacaaatgataaagttcaggctccatcacgaagtcatcacagcccagagcttccatatcaatggggagataaagccgattgtaatgacccttatcgtgtagctgatgagctagattaacctgcatgatatcgaatagctgatcttctaacatcttttgatctccctgccgccgtttagcaacatattcgtgtcgtaagtagttctttaattccattactcctcgcctaccttttttctaaatttaagtatttcttgtagccgccaatcatcagccggcaaaagttcttctgctctcagccgactgtatttccaaaattttccgtcaaatgtgtggtaattttctagttcatcaagggcatcacttaatttgtctgttatgaaatcagtcaaacttatcaacccattcggaaatgttataaagctcttttagctccgtagtgtggggcattttggtaactccactaaacgctaaaaagtcacttgtatcattgcaaataaaataaacatcctttgctttcctgcttaacgaatcacattggattgctactccattcatccccctaattgccatattgaatagcaagaaggggattgctctatctgacatttcttctacctggtaccaataagctctagggtcataagtgaagattgacaagaattttaagttagggtcagcatgtaatgaattaccaactcgatcatttgtacagtcatcccaccagcgcttgattaaaattccaccagtccccgcagctatctcaaaatagtggccgttaaacttatcactatcaactaggctattaagcaaggtcgcaatgctatcaggggtaaaatcctgcttcttacttttccgttcagcctgttcgtcttcaaaatattcatggaaccagtcaaactttaggtccgttgaaacttctaggaacttcttaaagacttctggacgtttctgattatcaagcattagctgcagcattctttccggggccttatatgactcgtcaatttctaatagcttattaacggtttttgtatcaaactgcattattccacctcaaattcccgtcattacagacataatcttgttgttatcctcgtttgctagcttgtctagcaggtggatatatactcgttgggttgtttctgtattgccgtggcctaaccgtttagcaacactttgaattgaaacacggttagcaattagtagggatgcatgagtatgacgcaaaccatgaactgaaattggtggtattcctgcctggtcacacatttcctttaactctttattaaacactgaattataaatgtgattaccacctcgggtattagtacgagagtcactagcataccaatgagcccagattgactcatcttcttttactccatccaggtggcgttgtaggtcagttaatgccttaaaatcaattaggatttgcctaacagaatacttgttcttagtcggcataaagtccccaggtttaacttgagagtaatctattttcttgtagttcagtgtcttattgacgtaaatagacatgttattcatgtcaacatcagctggggtaagcccaaggacctcagcaaatcgcaagccagtacgtaacgtaaaatcaaagaagtcaccatatccgctttgatcagcattaaagacttgttcaagtttatgaacttcatcaatttctagccatttcttaagtttctttttcttcttaacttgagaggtaatacggatcttgtagcatgggtcacgagaaatccacccctcatagaccgcatctctgattggcgcttctagtaaacgatagaaattacgaacagttactttttcgtgcgtttgtccataagcattgatgagcttttgtatatcagctcgggttattttatctagcattaagtctggagcaagtttcttaatttgtttacctgtcaaaatatatctttggtaagtgacatcacggacatccccgtatttgtaagtctcataccattctttgtaatatttccagaacttaatagctctcttttttccaacttgtaccatcgatgcttattcccccagatgataaacaggaatcttaggcttagcaccagtaacaacaactgacttaccgttataaacatcattatcatgttgaacagccgcaagattagttaatccctgttgctgataacgatttaagatcgaacgtaagtatgcaaatgttggacgatcagcattctcaaacatggaagtgatggcaaatgctaccacgtcaccaccaagttcattcacgaacgcttttaattcgttttgtgattttggggattcgagctttttataatatgaattaagagtagtactagtagtagtatttaaattatctttactcttacttaacttaactctatccttacctaacctaacctgaggatccatttcggttccattctggttccaatttggttccatggagttgaagccttgtccctgttgaggttgagagttttcacttgaaatttgatttttatttttggaaccgctttggatacagtttggttccattttgtctccatcttggatacattctggagacatttcgtttccaacttggttccgttctggttccaaatcggatacaaattggtaccgcttattcttatcaagaccaattaatttcatatcatcggtatatatcgtcggagtgtatcggtcctttttgacgtagttggaaactaaccaatccttaataacgactacaccatcatcaaagacaattaaatagtccttctcaactaatgccttcaagtcatcttcactagcaccaatcatccgtttaattgacttaggattgccaacaaaaccatcatcgtcagcattcatccccaaatggaaataaagcgattgagcagtaagccccatatcaaggaacttatccgtctcagtaaccttctgactaaacattctgcgttgtgccattgtgtaaccccctagttataaatctgcttaactaattcatcaaagtcttgagattcgcttagccgcttaaggtggtaagcaatatcttctgctaacttcatatgatggctgtacgtttctgcatgcttaaattgatcgcataaattacaaataaaaatagcttgatcaatcacattgttagcaagtttttcaacttctgctgcagtatctttttctgacatatgttataatctccttgtagatttcttatccagttattggattttgccatcggtgttaccagcgccggtggctttttttgtgtgcaagtcccatagcattagtgaatagaagaacagcaagaatactgctccaccatagtcgccaacgcctacacaataagcaatccaagcacccatcagcattgctaagagcttcgaattaactatttttgttaacgtcatttgtttcacctctttttaatgtttcttctgatatttttctttcagcagcaatggtttgttccgctcatacagcaagctgtacaccagtgcatataacaaacacattgcaataattaatattggtaatccaattagaaatgccacttaatcacctcttattgcggtaatgatttattccagtcaactttatcttcatgttgtgctaaccagcgtgtagcctttcccacatcaattcgtactggatggccttttccagcgttcaatccatagacgcctggcatcttgggcaacaagtacaactttaaccaagctggcgacttatcatgaccatacttatgacgaaattctttaagactaattaacattggtttatattgtttaggcaccaaatcatactgttccttaatacgtttgagcacttcattagtaattgtttggtaatcttgttcatctaaggttgcttccatcagtaatcacctaccttatttataacgatgagacctgtaaatcttcttaattacggataaccacctgtgccagcaagtagttatctaaaaacgtctaaactaacattcaacgcatcagcaatcttacacatcagttcaaaacttggcttcttaatatgaccgtacttaaactcatacatagtcctattagaacgtggtaaccctgctttaatagttaactggtaaatactcatattttgctttttaagttctttttcgacttcatcccacaacatcttgtgatacatctctctgattaatacaatatattgacaccgaaacatattttcgatatacttggcctcgtacacttagcactctattcaaacgactgctaaatcattaagaaaggtggtatttataatgacattaactaactggatctctgtagttggtattctagtttctttaggaatagcctgttggtcagcctatcaaacaaaggtagctgctcaacttgccagtcgtccgtatatttctatttatcttgaagcaattgatactgtctacttcagtaaatatcttgtaattaagaactttggaaatagcagtgcaattattaaaacaattaactttattgaattggataaaagtaataagtactcccaagatatccaagaaggattaaacggactaattaatggaagcatcggtccaaagcaaaaattaacaatgtcgctaaaagataattacaaggttccaatcaaattaagtgtcacttatgctgattccaacggtaaagaatatagagatacgttccatatcaaaactgatatgatgtcaaaaatgttgtggagttctgttactacaggttccgactctaaagaagcaagtgctataaaaaatgcagccgctggaatcataaaaaccattaaataatcataattttgtaatggtaataacataagcgattgcccaaactatcgaagaaacaattaatccatcagcaaaactttgccaatccatattagtcatctcctttcgaggtggctttttctattcttcattactgccatcaaagtgaatttgaaagatcggatagatcaactggctgataaacttcatctaaaatgaaatcgattagttttgatagtcccactgctaacaccaatagcagcagggcttttttctttttcttcttcatccatcattgccctcctccttctagaagttttatgcttcaactgtcaaaagctactctctttcttctattttgctatacttaattcatctccctatgaaaggaggtgattacatcaaggcactcaaacgaatactattacgttttcttgtcagaattggtgcattgttttgctgcttagttttgctactaactggctcttattccgtagcccaagtgtattcaactgctagcaaaggttctgcactttatgaaattgaacactcaaatttgcttataacgataattgcgatgctcccaatctacctagtttggaatttatttgtcatattgattgaagttatatcaatttccatcagcaactataaactttcagaaaagttaacaaatagattgtatagattaggaattcttatctccttggtagtatccatgctctatacagaaacagctgaccagtttcagttacttgcgacacttatctcgttttgcttgatattccaatttcttatcccaaacgactttcaaaatcttcttgttgacataaagagaaacgctcatcaaaagcgggcaaaacacaaaaataagaaagaaaatcaatagcaaattaagcacttagtcacctcccttgggtggcttttttattttgctcgctcaccattgctaccctcctagtacagttttctgtacatattctttaaaaaaataagtgctaattttagcatcaggaattgatagaaccgcactaattgccttaatttccttttgggtaaacgaactatgattgttaagcttaatattcaaagcagttcgactcatactaatagcttctgcaagagccgcttgtgacatattcttttcccgcatacgcttttctaataatgaatagtcatatttgctcatggacacactcccttctgttttttgttcatttttctgaacaactatattatatctcaatctgtcacggagtcaagataagttgtacatttttttgaacattagataatgcgcgtccataaatctgtgctaaaatacaataaaggggtgttaaaaaatatgaacacttttcaaaatagattaaaagaagcattagatagctcaggactatctcaagccgaattagcgagacgagctaatattggccgaaattcaatcagtgactatctaaaaggaaaatatgaagctaaacaagataaacttcatgccctagcacaagtcttaaacgttgatgaaggctggctaatgggctatgacgttaaacaggaaagaaaagttacttctgaaactaacttgccaactaacatcgtttacccgctgggagataattttgagcgcatcagcatccccctcattggtgaaattgcctgtggtgatccgatcacagccgaggaaaatattgagggctacgttgaagagatttttgaaaagcctgttccaaaaggcaacctctttgctctacgttgcaaaggtaaaagcatggaaccaaccattcacgacggatcaattgtaaccattagagaacaacccacagtggaagacggtgaaatcgccgctgtccttgttgatggtgataatgaagcaactctgaaacgtgttaagcaccaaggaaatctaattatgctaatgccagataataaagaattcgacccaattatcttagataaagataatccaggccgaattgttggtaaggctgttcacgtttcatggagtattaaataataatttacgtccaaatactgattgacgttaaaagctgcgataatgttgggggatatgtatgtatactgtcgatactacaggtcatgataaccagattaagaagtttatatctgagttacgagaatggttcgataaagatgaattatatgatggtctttctaatcaagacattcttgaatatcattacgatgaaaaagtttatcaatttggaacacatcctttagactcatatgatataaaaacttcaattagtaatactgacggccactatagggtttatcttagctttcgaaacggtaagggatttaatatcgggaccatcaaggacgatggcaaacttattaatcgccttaatgatgataactacgaaccccgaatctatgttttaggtgggcgttataagaaagtaataattgataaagatggtgccgatcacattaaaagttttcgagaaccatatacttttcaaattgattttctgaaaaatgaaaagccaaaagatgttacatatattaatgacacaacagctcagcaaatgttagaacaaaacaaatggtatcaagccagtcaaaaagcagaaaaaataggtaatacaatgcaatctgctggagatagtatggctggttgcgggtgtcttattactctactagttacaataccagtgattataattataattctatttctaattctttaggactttgggggataaataattgaaaaagaataatcaaaatagtgaattgaagtttaatagaatcatttatgcaattttagctgttttactacttataggaggaactgcaatatttatataccatgctcagcaaaatgaccctgactcatctgagtatgctgatcctagcagtgacgatagttcaacagatagtacagaagacgatgatgttgacgattcttctgatgacgagtctgaaagtagtacagaaacaagttcagctagtgactcgaacgttgatcaagtagtttcaatgatccaaagtcaatttaaggataaagctatagtttcatatgataaagacagcaaagcaattttaatcatcccttctgacagtgaattcactgacgaggttgttgacgttgcaaacggggacggggatgaagaaacttggaataagctaaccgattcaatcaacgatgtttcatctcaaatggttagcaagtatggcgcaaaggtcgcattagccatcgttaatccgcaaaatcatgacaaggttttatacgaagctttagatggtaacactgtttatgatgttgtgactgatgggagtgacgaataagcatgaaacggctgtttcttttaattattgtgctttttagtttttcgattgttgatggtaactgtaattctccgtgtgtatctgcaaattcaattattaatcaaaataaaacagtaactacaacaaaagctaatcatcaagctaagagaacaaataaaaatacttcaatcaatataacgtctataatagcagttggctcgataatcatatcactactatattatggctatattattatgaatttaaattatttagaaaaaagattattgagtataaaaaatcaattctatattatagtttcaattatagcaattacaattttagcctatattcttactattttttcaattgtagttgatgcggaaatacgacgaccaataattatcttactttctgtatattcaattgcattaataataattactattatcgcgcataaacaagccaaaagtgtaattgtaaagttcaaatataatgataaagagtttcaattcctacatagaatagatgatacaacaatcagtgctaaattattagattcgtcatcagataatacaaacgatgatatctatactttttctatgagtgatttaagtaaccaccgtatatatacaaaaaatacgaaaaatttgaaggaagtgtccccgttgaatttaaaaccggatgaatatataaaaaatagattggatgatcaaataaattggtacgataaaaaaagtgctactcaaaagaaatgctattactggtcaaaagtagttactctaatttgtacagcctccatccctgttatatcagtagcatttaggcaccaatcattcactgttatagttactgctttaatagctgcaattgctactgttacagaaggtattctgacattaactaaatggcatgaaaaatggattgcatatcgttcaaatgcagaagccttaaaacgtgaagaatattcttatctaacatcttcaggtgcttattctgaactaaacgatgatgaaaaatttcatactttagtggatcgaacagaatatattatctctaatgaaaacaccaattgggcctccttaggaaagaagaaaggaaaatctatttaatgaaacataaatgctttatctcatttaaaccagaagatattttgtataaagaaaccattcaaaatgacttagatgtcgatatgattgataaatctcttaatgaaccaattaattctgaaaatgaagaatacataatgcggaagatacgagaagattatttaaaagattcaacagtcactatatgtttaattggaaaacatagtgcggaaaataatctatacgaaaatcaacattatattaaacgagaaatacaggcaagcttatataatgatcccaatggtattctcggaatagttcttccagaaatgaccgataaaatttacaaaggcacttatacttgcgagacatgtggacaagaacataattatgttgctatcgatgataatacagttattaaagaatttagtacaaattactatattcctgatcatgaaggttgcgcttggggaattgatgacagatattgtattttagttaagtgggaagactttattaattcaccaaacttatatattgatgcagcctttgataaaagatcagctcctgtaagaaaaaagattactgtttttccgaaataatacgatatgttttttcaaatatttctttttttactggccactgctctccttcaacacccgtaacaatccaatctcctgcattagcatgcattactccttcaagcgttcgaatatctattggcttctttgtttgataggcttcaactggtatgttttttttaactactttatataatttcatattatatacttcctttgattcagcgaatttataattattatatcattaaattaatacttgatttctaagaatcgtccaaagcctgatgacgtaaaaagctgacaaatgaaaaaagcccatcccctactggcataggagatggaccagggttgaataagatttacaggtctcaattcaaccctttcattatacacaatttaataatggagggacaagtatggcttcaataataaaacgttatggaaaatggcaagctcgaatttcatggtatgacagtgaaggaaaacgacaaactaaaagtcaaggcggttttcctactaaagtattagctaaaaattgggcagttgaacaaaaagccaaactaaacaaaggaatcaacattaagaaaactatcaaatttattgattattacgatcaatggattgagacgtataagaaacctaaagtagctgaaattacttataagcgttatgaatttactcgaaaggcattaaatagcttctttgctgatactgaattcaaacatatcgatcgcaaaatgtatcaaagatttattaatgagtatggagctactcacgccccacatactgtcaaagaagtaaataacattgttcgcgcttgtgtccggtcagcgatgttagatgattatctgattaaggactttactcaaaacgttacactggtagctaatgaggataaagaagtaaaagttgattatttaaatgtagaagaaattaaaaaactgctagaaaaagctgaagctgagatcagtcagcaagatatttataccagtcgttatatgattatcacagccatttatactggaatgcgactatctgagattcaagcattaacatggaatgatattaattggctacaccaaaccattactgttagcaagtcctggaatatgtacactcattctttcaagccaactaaaaataaatcgtctaatcggactatcaaagtaaatcaaactcttctacaattgctttctcaattgaaggaaaagcatattagtaatatggtatttatgactcagtttggtactattcctactagcaacgcagtcaataaaatgcttcgacaattgttagatgaattaggtattcaacgcaaaaattttcacttccacagtttgcggcacagccacgttgccctacttcttgctaaaggtgtggatatatatccaatcagcaaacgtcttggtcatagtgacatccgtacaacaatgaatacttacgcttatttaatagatgaatacaaaggaaaaactgatgacaagattgtcaatgctttgaaccaactttagtttggtacactagtgtaccaaaggtgtaccgactttgtactttttaatatttttccatacttttctaaaatactaaaaaatcctacaatcattgatataacaacgattgtaggatttttatacttcatcatattttctcaaaaatgcgtcccccgagagtcgaactcggatcatgaggaccgaaatctcatgtgctatccattacactaaggacgccttatattcctattttagcgcatttattaaaaaaataaagagaatttgtcaattttatttaaaaatacaaatacatatgacgcttatttattcccccttctcctttaccagcatttcttaagttaatataatagatatgttacataaaacatgagggggaattttccatgaaaaagcaatctacaaccattgcttcaatcgttattctgatcataatcgctatctttgcactattaaatacggcaactgtagtagtcaatctttttggagcacaagtaaaaatgccactagtgctgctaatctttatctgtttacttattggggctattattatttacttgctatcattttctaatcacctcaaaactaataagcaattaaaagaattacaatcatcgcgtgttagtaaggacgaattaaaaaagtatcaaaaaaagattgaccaactgcaaaaagaaaatacacagttaaggcaacaacttaaaagtaaaactactgtagaaaagccacaagattcttctacaaattaatatttcagagaggaaatcaaatgggaaaataccgttttattgcgatcgatgttgatggcaccttactagatgataatgataaattcgacgttaaccgtttaaataaagatattgaactattacaacgacaaaactatcactttattattgcaagtgggaatagttacgatgcattgtcaacgatctttcaaccgtgcccacttgtaacagaatttgtagcagaaaatggcggacgactgataataaacggcaaatctgtatacggcaagactcattcaattgcgacgttgcaacaactttatgcttttattaagcatacgttccctagccctgacatcctatctttatctggcgaaacacaaacaatccttgccgagcagtatcgcgatgttccagtccctttttatccccaccacacatatttttctgaccttcaaaaaatcattgagccaatttataacttaaacattggttgggccaaacgcaaattatcccaaactattatccaaggatatgtaaatcaattaaatgagcagtttccaaacttaattcaagcgacttatagtggagcttatggcattgatatcctgccggcaggcgtaaataaagccttgggattaaaaagactagttgaaaattacttgaacggaactctagatcaagtagttgcttttggagatacttcaaacgatattgagatgttatcagaagttggttatggatatgcaatgaaaaatgctactgatgacctactaaaagttgctgataaagttacaagatacgataataatcatactggtctattatcagagattgaatatcaatttattaaccgttaaagatattatgtaaactagtattcaaaaaaagatgtgcgagttgaaatcgcacatctttttttcttaatatactccaccatcgtagaaattgtaagatggtttattaaaatcgtaattaggaagttccgacattttaatgaaattatctgcaattccccaactcattaaattaattggtttaccaaagtcttcatcaggaatcactaccataatatatttacctagtgcgcgtgccattcctaattcaacacccattcctacatcttcttcttcaggaatgtagactgctaaaagcatatcagaagttgaaacacctactcgatcaccattgtaagttgctgtactccattcgcgatcttgcaaaagctctggatgttcatcaacacgtaatcctttatattggtgttgtaatggcacataagaattctctacatctactgtagggttatccttaattgcattcattgcatcctcataagctttattttgcttgtcagtaaaccacccggcacagaaatatactgtcttacttttttgatttgtcattaagtgaactcccctttaatttttgtacatttaagattctatcatggaataataaacttaaccaattaggattttttaatcttttctgagagctgtgttaattaattgcttggctgcctttgaaactgaaataccttttttatctgcatactcttttaattgttggtatatagctaagtcatccggcccacgccatataattcctgttacttgaccatgttctttattcattttaattccttccccataaaatgttagcgatattgtttaaaatttttgtgcggcgatgtaattgaaaatgagtagtttttggatatactttttgatgatacctaatcgatggatgaactttaattaatgattttaacatttccgattggatatgaggaacagctccatcagttgttttactgccttcttcactacccattaaattataaatttcaactggataatttaattgccaatttttcatctctaaaaataattggtgaaaattcttgtctgtcgatttattaactaaatgatagcgatattttaactgatcgctaagactttcttcaactggtacccctaaaaagactactttatttaaccgcatatgatcttgaagatattttgaacccatataagcatgaatgaattctgtgcctccatatgagtgggcaacaacattaattttctgcatatggtagtgtttctgcaaatagttcaaaacagtcgtcagttgcttgatttgtggatggtaagtaccattatagttccaagcaaataaaacttgaattaaggcattcttttgcccatgaaagtctccttcagtccagatacgtctgttaggggcaacccagatcattaaaactttttgtgcaatgtttttctgctgatagtacttaatcatcttattataagtaaccgtacttccgccccaaccaggaataagtaacgtaggaacagaagaatactctattttatcttggtaattttgtggtgataagggttgtccaggtgttcctcgtagtaagaaaccctgaataccaaaagcaagaagaattaggctaccaatactaattccggcaatttttaaagattttttcatcaaatcatcttcttatcatttcattttgtattttactcttattatacgcttgaaaattataaagaggatggtcttttaagcttttggatatggtattaaagttaatttgccattaatatattcgccaagatagatatcatcaacactgccatatcctgctttatggatttgttcaaatacccactgttcatcatgatggatcaattccattacgtcaatattgatctgtccatcattaattagtgggaagcgaacatttgcttcatcattttcgatgattacaagttgaccattttgttctaaaattccactcttgaccttagcaacttcataaattccgtgaccacgaagacggaacataaggtcattagcactgattcctgcacgcatacaattctctactaataattttccgttctgaattaatatttgcgggcgcccatcgataattcttcttacccaaatattatgatctttagcaaatttcacaataaatacaattaatgtccaaatcaaaaggaccattataaactcaagaacagaaatatcactattgtagataattccgccaataataccacctaaaacataattttgaacttgatcaatggcggatgttggcgcaagattccctttccccaataaattaatctgcagaatcaaacatagcataccaaggacaaactttataatgattaacgaataagtatccattcttctctcctacttcattaaattaacctgatgattaacaacatgtgctcgtgtaagggtataattatctctcgtttgacttaaattgacacggtaatcccgatcctcaattcgaacaagaattccatccgttaaagttgtggaattaacaactactttttgtggagaaacattatgatcccgagcaactgccttaataaagggaatcatctgagttgtttgggattgctgtgtggtacttttttccatatcggtaacttgaaaaccaataaaaagtaacaatagcaaaaagaaaattattcctaaatcacgataacgggtaataaggcgatgccgtaaatataaaaatgccattactgcaatcagaaggataaagatgataatagcaatataattgaatagttgattcatatgttggtggtttgataaatagctaattgtataaaatgtcaatttatttctctccttaacttaaatgtaataaaaacttaagcagctccccacccttttttcatacgctcatgatagaataataataacgatagtatgaaagaaaggaggaacttttaatgatcttaaaattagtattaaaacttggatggatcttgttagggagcatttcattcgttggtgggataattgggatgctcctccctgtaattccgcaggttccattcttcctcctcacaatatggtgtatcactaaaatttcaccacgttttcataactggctccttcgtaatccactctacataaaatatgcaaaacccttggtaaatcggcttgaaaatctgaaacattatccgaaacaaaaggcacaaaaaattaatagtaaataaaaaggtcttgaatgctatttgcgtcccagacctttttatattagccaaataatcgtgcccagaatcccttcttttgttctttaacaggcgattccgtaactttttcagctgtattcgtagttaacgtttcttcattatttgcttcgttttccgcagtatcttcagcatatgggttgcgttcaccaatccatttaaagaattcatcagctttaatttccacaaatttgccacgcttgccattgataccatccacacagagttcaattggcagtgcattccggtacttttcaatactatcggcagtaaaaccattgaaagtattaagcttcgagatatcaaataacaagctatgatcttgttgccggtatttaaagtcttcttcctgtgttaggtaaagtttagcccaccggttacgcgaactttccttaaagtcatcacagatttcatccgcaaagtaaggaggtacttccatatccgccatttgatagtaatcgcggaaaatcttacgggtatttgctaagaagtcaagcttaccagtcttttcatcgaatgcgcgccatggcgtttcatcgtcctctagtaagcttgccatccgcattacaaagtccttaaacagcgtattatttaaggtttgtcgtacattatagatatatttattggcttcacctttttgctggtcatcgataaccttatcaatttggagataataagttcgccgtgcagtttcacgtagcatagtaaaaccagaatcatagttagttgttccgattaatggcgcaattgcatgtggattgttgaccaattcattcatcgtatcaacaactaagtgccgactatattgatcttgttggaaaaagtatggttcaatctcatccattaaaacggggtatgaacttccaagcttcatgtagtgctcaattgcatcaacagtttttgcttttttctgcggtgtatctgtaggatagatagtcccaaaatcaattaatgaccgatcagtgttccatgtcaattgattaataatccgtaatagggttgactttccagaaccagcagttgctcctagaatcaagaagttaggaatatcattcccatcttcaggattcaaactagctttcgcacgaatttcccataaaaatggtgccgtaaaactatataaaatagcttcatagaatcgcttaccataatcatcattgtagtcaacaacgtattgctgatacccttttaatactgcatcaatactctttaagccatcacgaatttgactaatagtcgcaatctttccaaattgaattgggtgcgtgcctgtatcattcggtacgtacaggccactattattgttaaccagatttctttccatcggacgatcatataagaacgttgtatacttcttctctgctgaccgttgttgtggtgtcataccgctaatcaatgcatcctgaacttgtttaaaaatcttttcgcgcgatttcaattttggcttagctgctcgtggcgatacagctgttttttgcaaagtgtaaattgtatcgtgttgttgaatttgtcgttctgcttcttctttatcttgagagcggttagtcgtaatatctcgcatcgacttagtaatcattgcgggaattttattttcatcaatttgtttttgaacgtcatgactaatcaagtcggtcatatctgccgctgcgatttgatcggtaacttcattatcaagaattacaaccgcattcttagttcctttagtatctttcaagctctcatcaatttgattttgtgctgcatttaaaagattttcagtaaaaaatggtcgtaatactggcttgatgtcattcttatagtggttatcaagattttgaaatagccgaatgtcatcatcaaagactaatatttcttcatattggttacgctctttatcaaatgaagcactgtccaagttaagacttcccaaaatcacacgagtatcatgagtctcggaattacttaggaggtaaaaacgtgaatggatagcctgagttggtgcaattgcaacttgaaaaagattgttcaacacatttgcttgattgtcactagttaatgcttcaaagactttagcaggctttttattagcagcagatagcaatgcattggttaaagctaccttagtgatcacttcatcaccagttttagcttcataattttcagggctgctcagtgcaacttcgactttaatgaatcgacttagatactgattaataaagtcggcagtcacgttaccagtaactgctgttaaacgattgaacttattagcatcaaaaagctggctaatctttaatggtggagtatcctgaccattaaaaacaatatgaatcttttttagatctaaatctgtcattggcgtagtccttttctaaacaatattaactctttttattttcgtttatttaaaccaattttgcaagtgaccatcgaaatattttgtttctacgctagttttatatgcagatgataaagaacccccaatactttaatcaaatgaagtattgagggattattctaattacatagttttttaattcgtgttcacttgcgttactgcccctgttgcataatttatactaatattgttttgcacattgggcacgaatacattgtattgcaaactgccatcctttgacttggcctcaatatgggcacccgaaggcactaaattattaccatcatatacgtcagttacccgataacgaacttgtttattttgatccagagcttttcgcactaagccttcatagtagttctgcccggttgatgtactgcttcgagcttcgttggcccaagcagtttgagttgcaatattagcgggatttgactctgaagcatcaaaaccacggataccacctactaatgcatatcctagtaagtgtccgcgatcataagcatgtgagataccaccttttaagttatgggcttgtaaaaatccagctggcttccaattagtggctccattcccagtttcattccgattacggtattggcgtgttgtacgattgagccaggcgtctccctgccatgctcgtccacgcgaatcacgtcgattaacagcgtatggcgcattattaatatttgcgtttagtgccgtctgattgttatttaaaataaacgctccgtaaccattccattttatgtcagatgttcctaactgctgacggacaccattagaaagaacacccgtagcctgctcttgggttggcggcgtaaaagaagatgatcgattattattgctggaatggcgccaagatgctacccgttggattccctgtggtaaggtacttcccttgtcagatggctgggaaaaactaccaatgccgagaactgctactaaagctaaaagtaaatactgagtctttttattgaatcgaaatcgcatgtttctaaaatacctttcctcttaaacgtatgttcgtaaaagtattttatcattttaattgataaaagaaaatactcccaaaacaatctgtttcgagagtacttattctttatgctaatttatcttggcgctgagttcttaacttgtagataatgctcataataactaagaagactgccccaacactgactgaaatccgtgtatctgggttaaagaacataaatagtaagataacacttagcgcaatcaagctaaagtagttatatgctggataaaatggcatcttgaatgggtgatcctttaattcagccggattattacgccggaagtttaattctgaaatcaaaataataaaccatggtaccattccgggaaggacacttgaactatatacaatcacgaagatattagcagaggctgcattaaacattgatagaagcatgttaacaataaagccaaggaaaatccagaatgaaattgttaagatcgcaacatttggtacaacccgctttgacaatttactaaagaccttaggaacctcaccaccaactgaaagcttgaaaagcatccgactagcactatagattcctgagttggcaccggacaatgcagcagtcaaaacaacaaagttaatgattccagctgctccagtaataccaactttagtaaatgtctcaacgaatggtgatccaactgcttttaattcgtcccatggataaatggaaacgataacgaaaattgccccaatatagaaaattaaaatccgccaaataacagatttaactgacttaacaattgcatggcgtggtgaggccgcttcaccagcagtaataccaagtaattcaattccttgataggatccagcaatcacagatagtgagaacatgaatcccatgaatccaccagtaaagaatccaccatgtgaccataaattggaaattccaaccggatgccaattgttacccaacccaaggacaattactaacaatccaagaatgatcataacaataattgtaacaactttaatcatcgcaaaccagaattccaaccggccatatgccttagcagatgcaaggttcgcaagagttaagataatgatcattactaacccagaaatccagtctggcaagttaggccaccaataattaaggtattgactcatggcgataatatccgagataccaacaatgataaactgaaagacattactccactttgtcaggtatccagctaagggatgaatatatttagacccatagtccgcaaaggaaccagttcctggactgatatagatcatttcccctaacgcacgcataacaccatacaggactaaacctacaaaggcatatgctaataggacagaaggaccagtccatttaatagttgatgtggctcccatgaaaagaccactaccaattgtcccaccaattgcaatcatttccatttgtccgggagtcattgtccgatttaatttaacttcatttttctgattatccatcattctaacctcactttaaataaaaaagctacccaaaatgtccctagccaacccttgtcaatttttgataagtggttgagacatcttgaatagctattgctaacagatttaagagatattaaaactactcaaccacggtaattgttgttgtggttgaggtggaggttaggtgatgaataatcgatttattgtaaatttgcattttagtttcctccatttcgtttttcaataacattagaatactattagaaaattaaaaatgcaagtccttttatcaagtttttttgttttatttctttttgtgcgctctatttagcgaaaaaagactcatccccgcgaccgttaccgttattcccaagccaagaaaagtcgttaaattatcagtctcatttcctgtctgtggaagtatttgctggtcagaattatcgtttttacgtgaatcccgatgtgaacgatttagtcgattattaatacctgctatccgttggtgcacattttgctgctttcttgtattatttacctcctcataattttccgtgacctgattatcatcccccagaccttctttcatggggtaattgtcctgtgaatcttgcttttcctcttttttattctcctttgcttgcccctccttttgcttttctgctaacgtattctctttgctgtctttttttggcccttcatctttattgaggggctgataataaacatttactgcgctttttaattgtgataaatcctctatttctgtaacagttggaatcttatccattgatggtctaaaaccggcttggtcagggacattaacttcttcaaaaggttcaataatccaaattgcctttttggttggatcattcggtacttcacggtgagcataagacacttgttccacttttttaacttcatttaagagatgaaaataaattacacgtttgatttggacacattccttctggttatttgcgttagatacgggctgcgtaattagctcttgagttgtagctaaaactggtggagtatttaacgacagcgaaaggatcgttgacgctgtcgttaagcctactaagcaagtgtttcgcaatacacgaaggtggtttaaatggttcatattatctcgctcctcttttatatactctttaatatatatacgtaaagagaagcaattcgcattttttaaatcgaaaaaagctatcacctacaagtaatccttacctgcgatgacagctctgttaacttatagtgaatggataacctgctcaatatcatccacaatttgtttaggggttaagtggtaccattcatatagtacttcggtaggaacattatccgcaaattcccgtggtgctccaaagttcaaaactttcattccctttggtccatagtaacgagcaattgtttccccgaagcccccactaaggaccccatcctctagcgtaacaactacatcatgattttctgctaggtggtgaaggacatctgaatcgattccagttacagactttggattgatcaatgtagcatcaatgttaagcttgtcttgaagttccttccttaccctttcaccaagttcccagaagtcaccaacagccataattgcaacctcacttccgcgatgagcaatatcgtacttaatcgtactgtagtcatcttgtgttggcgtcccgtgaagaagaggcttttctggttgacgaattactactggttcatcagtttgattgattgcccaccgtaacatcgaaatcatttcttcgacgtttgttggtgctaaatattcaatgtttggcaaatcactaatcattgaaatatcaaatgttccttgatgagtagcagagctttctgaaattgacccgcctcgcacaatcattacaaccggagcatcatttaatgccatatcatgaattaattgatcatatgctcgttgcaggaaagtactattttgaaatacgacagggcgtgcacctgcttgcgccattgcaacagcagtcgtaattgaatcctgttcagcaatcccaacatcataataacggtccgggtgcttagccttaaacttgccaagatcaaacgcaccaggaattccagcattaatagcaacaactggcttatccgctgcaatttgcttatccaattcagcaaggacagcatcgctatatgattctccacttactttaaccttatcttcaccagtctttaagtcaaatggagtgcgccaatgatacttcatcttttcttcaacagcaggctcataccccttcccttttaaggtgttaacatgaaggacgattggatgatcaatatccttgatttccttaaaggtgtcgatcatcgtctgcaaatcattgccatctgcaacgtacttgtaatcgagccccataaacttaaaaatattattgggagattcaccattggtatcccgtagttcttttagtcccttgtatagaccaccttgattttcgtcaattgacatttgattatcattaacgagaataatcaagttagaattaagcttagcagcattgtttaatccttcaaaagctaatccgccacttaaggatccatccccaattactgccataacgttattatgtgattgcggcttcattaaatcacgcgcttgagccatccccactgcaagtgagattgatgttgaagtatggccgatttcaaaaaagtcatgagcgctttcttctggtgacgtaaatccggtaatatcttcataatgatccggatcaagaaaacctaactttcgacctgtcagcattttatgagcatagctctggtgtgaaacatcccaaataactttatcatggggcgaatcaaagacatagtgaaaagcaattgttagctccattacgccaagattagggcccacgtgtccaccaatttttgcgtcacgttcaagaacaagttgacgcatttctgttgctaattgttttaattcgtcaagtgacatgtccttaatatcgcttggttcattaacttcatttaagaggtaatcaggatgcagattcatctattccactccttcttgattttacatttaataattagtaatacttaatgctcttattattctaacactttctaaagcattgagtaaattactctcaagttcaaattgacgaaattcatgcatttcgataccattaaatagagtaattcgttaaaagggaaataattatgaaaaatatagacaacgctgcaactaacaaaatttcaccatttaaaaaattaacgacagagcaagaacaactcgtcaatgatattatttcatttactaaacaccatctaacacaaaatcatcctgcaatatatacagtctacggagatgctgggactggaaaaagcgtaatcttatcacaattattcgttcacattcaaaaagaagcgcggacacaacaaaattccgttctttatcatactaataattattttcttgttaaccatccagaaattctgaaagtctataaagagattgctgggccgataaaagagttatataaaaaggacttcgctcggccaacttcattaattaatcaattggataagcaaaaccaaaccattgatgttgctgttattgatgaagctcatcttttattatccaaacccgatcattataataatttttaccatgataatcagcttgtcgagattattaaacgtgctaaagttgttataattgtctttgatcaataccaagtcttacggatgaaaagtctctggacccctgaacgacttcaggcaattacaaaccaatatccccataaagattaccatttgacccacatgtttcgcatgaatgcgagcgatgaattagttaagtggtttaatgaatttactaactataaattaaccgctttaccagcatccgcccgtgatcattatgattttcgcatttacagtgatgctgaggaaatgaggaaagcaattgttcaacgtaataaagaagtaggactttcccgcattctttcaacatctggatatccatcaacactcgatggtggtaaacattacattgaggaaggcagatttaaaatgccctgggatcaatataactatacagtcaccccctgggcagaattgcctcaaaccattggtgaagttggctcaatctacacctgccaagggtttgacttaaattacaccggcattattatcggtccgccaattagccaaacacctcaaacaaaccaacttcaagtaaatttagatcgttatacagatgttgaagcattcaaaaaacgtgacgacctaactgatccagctgaaattaagagtttagaaaaaagaatgattatgaattctttgaacgttttatttaaacgtggtgtatatggaacttatctttacgctcatgatccgcttttacgacattctcttacctccctttttgagaaggctgggtttacgctaccaaaggaggaacaataatcatgaaagagcgtaaattaagtaaaacatggctgatcgttggcgcaattatcctcgccgtcatcgttctctacttcatttatcgaacatataagccagaaattgacctactactagactttaatgcccataataaggctaagcttctccatatgattagaagtcatggttttacagatatctttcttcttgtagctttaatcggtatcctaaatgcgattccgggaatgtcgaattccgttgtttgtatctttgctgggttatgttatggaccaattgttggttttctgattaattgggttggaaacattttaggaaactctactgtaatgagtataattcgtaaaattaacctctccaaacgggtaaagaaaagtaagatccttcattacctcttgcagcaaaagcatccgttaattgcacttacaatcggctttatgattccggttatccctagtgtacttgtaaactacgctggtgcccgtttaaatgtgagttggaaacgctacttggcgatggtaaccgtaggaatggcaccgacctcctttctctatgcctttggtggggatgctattttcaaaggcaacattagacgactgatcggtgtcgcaatcgctattttaattctaattggctgttatttactcgttcgcaaaatctggcaaaaccatgaagaaaaagcagcaacaaaataattaacttgattaaaaacaaggctccaaacgtccggcaaatccgaatgtttggagcctttatctttaattaaatcttgaccaatattctgccaaatacttgctggttaaactttctggtttttgaataagggctaacggattaccctgagccacaatttccccaccattgctgccaccgcgcggacccatatcaagcatataatctgcgttaataatcaaatttaagtcatgagtaatagtaatgattgtcgctccccgatcaagtaattgctgcattaccgctaaaagggttttaacatcaaggggatgcaagccaatagtcggttcatcaaatacaaataacgtttcactttgattatgattaaggtgtttaacaagttttaagcgttgcgcctcaccgccagaaagactaggcgtactttcgcctaagtgcaggtatcctaggcctacttcatctaataattgaagttcacgagcaattttcggaacttccttaaatacactcatcgctgcccgaacatctaattttaagagatcaacaattgaatatccctgccacttaactttttgaacttcttcattgtatcgacttcccccacatgttggacaagtctgttgcatatctggcaagaattgaatatcaagagttacgaccccgcgcccccacacgttggacatgctccctgcttattattataagaaaagtaagaaggtgtatagtgtttctctttggctaagggctgggctgcaaataacttccgcagattatccataatactggtataagttgcgactgttgaacggttagttttaccgattggcgctgcatcaacacttactacttcttttaacggacttgacaattttcgaacttgcgaaggtaatttagccccacttgcttgagcatggatagcaggaactaaactatcaaggatcagacttgttttaccagcacccgaaaaaccagtgatagcagtcagccgattaaccggaatctctccatagacgtctttaagattgtaataatcttttacttcaaaggtaatctcttgactagctggttcgtttgctatggggcgactttttaatactgctgtcccatttaaataaggaccaattttagactgagggttgtcagcgatttgcgatggtgttccctccgtaagaatttctccacctttttctccagaacccgggccgatttcaataatccaatctgcttctttgataatatcaacattgtgatcaacaactactaatgaattaccttgggccactaattccttaaatacatttaagaggcctgtaatattatcaggatgtaagccgatggaaggttcatccagaatatataagacaccagttgtttgggttcgaagagttcttgcaagctgaatacgttgtaattcacctgtcgataacgtatttccgtttcgcgataaagttaaataatcaaggcctaattccagtaatggtcgtaaattatcatcaaactctttaaataatgaggtcgccatctttttcatatctgaaggaagagcagctaaaacatcttgcttccacttgctcaactctccaagcgtaaggtcactaacttgcgcaatatttaaaccaccagctaattgttttaataattctggctttaaccgtgttccatggcaaactgggcacgttgaataatggaaaaattcgctaattcgtttttgtgctcgttcgcttttactgcttttggcagatgctaataccgcttcatgagcgttctcatataaagcattaaagtcatgaaaaacacggcctgttccagagcggaagtccatcttaaacttcttttgtggaccatttaaaacaaaatctttttctttaggggttaaatctttatatggaacatggattcgaacaccggcctgttcagcaacactcggcataaagtttcgtccaggcaaatgccatgaagcaactgccccatcagctaaactaagattttcatccccaataagtttactttcatccagttcacgaacttttcctgttccatgacatcgtaagcaggctccgtcagaattgaatgcaaagtcttctgctccataggcataaaactttgtgccgcaagtaggacaggttaattgtcccatttcatcgccgctcttactcattacctctgcgatttcaaggcttggttttaaacgatgcccatttggacagaccggttcgccaagccgcgaaaagatcagcctaattacgttcaacatctcactcattgttccaacggttgctcgttcagatggaattgcgggacgttgcttcaatgctagtgctgaaggaatatgtttaacacttgtaacatcggcttgagcacctaactttatccgccgtcttgtgtaagtagaaagcgcttctaagtagcgtcgagatccctcttcatataaaatccccatcgctaatgagcttttcccagaaccagataatcccgaaattgcgacaaatttatgtaggggatattgatatcaatgttcttaaggttgtggactcttccaccttttacttcaatttgcgttggtagtctggtttctgtcactattttttactcctttcatatcatcattccacagatggtggcaataactccaccaagataacttaagccaaaataaacagcgaacattccccatcgcctttcatccatcattgaaattagttcaacgttaaaagtcgaaaaagtagtgtaacctcctaataggccaatcccaaataatagcatgagcgatgaattactagcaaaatttttggtaagaatgcctaataaaaaactaccggtgatattaataaacagagttgctaggggccaatcaattcttaactttttccaccagcttgtgatgatataacggatcacagccccaattgctgctccaagccctacattaatcatcttgccgcgaacctccgtattttcgtgccaacataaaaccgagcagtgccaaagccaagccgccaagagagctcacaagaaaataaccgatgctagcaattataccttggttttcaagcttaacaatagttgtggctaaacttgaaaatgtcgtaaaagcgccaataaaaccagttcctatcccggcatttagccatgctgctaatagtccccgctcaataaaataataagttataaaagctaacaaaaatgaaccaataaggttggcatataaaatcccatcgccgcctaataggacactaagttcataacgggtaattccgccgaggaagccgccaatcgagacactcattattgtttttatattcataaaaaatctccttagatctgcaatcatttcattatacaacttttgctatttcaatttagaaacttgtataatgatattgatttaaaaatttaagggagacttagataatgaaaatgcgacgaattgatcacgttgttttaactgtaactgatttagagcaatcaatgcgcttttatcacgaagtatttgatatgccggtgattaaagaacaaagtaatgacgacttaattacaatgcggtgtgggcatcagttaatccgtttacaaaaaattgaccgaccaactactttaaaggcagctgatccgacaattggttctgctgacttatgtttagttgccggagatagtattgacgatattgttcaccatcttaatagctattatattgatataattgctggaccaattgtaaaacaaggggcggaaggcgaaatgacctcgctttacgtttatgatccagataataatctgattgaaattgcagtatataagaataaataaagtaaatatgagcgagagaaggttgttttccacttctgtctcgctcatatttcattttcaaaataaattcaactaaaagtaaaaagagcgtgctaccgcaaaatacccaccaatggtcacggataatcccgagatagtcacgaataaaagttaatggacagtatcgccaaggagtcttgctactaatgaatgaccagtttaaccccatcctccttgcataagctctcgcacgaagaacatgaaaatcactagttactactacaaccgtctcttgcggcttaatgagttgactagcgaaggctaaattttgccatgtattaagtgccttgttttcgcgaattatttttcttgctgggattccgtgagcaattaagtaagcagccatgacttctgcttcagattcttttgctttctgtactattccccagaaacaataatttttgcagattgatgagttttccaacaattaatggataatctccgtaacaactaaaagaataataattatgattgcaataatatagccagatactcctaaacgatagatatgtgaatcagctggtgttccctggactaataatgatgatcctaagatgactgctgctaaaataattgcaatcatgaaacggttcattaaccgttctatctgctttagcactcgttgctcatttttatactgtagatcaactttggcatccccacttacaaatgtatcgatcaattcattaattctttctggcatcttccccattgctttgctagcaaggaaaaaattgactaggttattatcaagggcagaacgccaattaaagtttcgttttaaataacgccggccaaacgattgggcaacctcaagcattgatatttcaggatcaagtttagcaaccgagttttcaagagttccaaatgccttaattagcatcgttacctctcccctcatttgaaggtggtttttcttacatagctggacaatttggtatagcattttcacgaaatcaatattgccaaggccggttgaaaaatagggttgcataaaggcgccaagttctttataaaatgcattttcgtcaacttccccggttcgattacaaacatttaaaactgcttttccaatttttcgcgtatcctttgtgttgatagtaatcacaatattcgcaatactatttgccatcgctggacttaaccttcccatcattccaaaatcaaggtagatgatccggtaatttggtaatgcctcctgttgatcataactaatggttgtattataaatggtcttttcatggtgtttggtcgttgcgtattgctttgctgattcatccggacgtaattcgtgaattaatatatttcctggatgcggatccgcatgaaagtaatgatcaacaaaaacttgttttaaaaagttattaacgagcgtagtagcaatttcatgattaacggtcgttgcctcttgatcattatcattcggctgcttaaaccgatatcgaatgctttccccttccatcgcttcattaacaagaatcttaggagcacaatacttcatatatactttaggaactaagataggtccgtcaccattatttaatgtataaaattcttccccattttttgcttcttcaagagtattgacctcacttaataatgaagtactgagttcatcaattactttatccaaatcaactactgcaatgtcttggggaacatacttaaataagaccactgctttccgtaacaaggctaaatcagtattaacaagcttaccgacttctggatgttgaactttgacaacaaccggtgtcccatccttaagcgttgcatggtgaacttgcccaatcgacgcagaagcaaaaggtttttccgcaaagctagcaaattcgtcattaattttcttcccagtttcttcttcaaaagtttgctctacggtcgcaaagctatcagctttaacctgatcttgcaagtggcgaagttctttaatatatgctggggagacaaggtctggacgggttgataatatttgaccaagtttaataaaggtcggtcccagttcttgcagtgcctgacaaatagcttgtggattagtttgatggtaaaaattgctaacaaaatgatattttcgcatcacttgcataatcttacgcaagcgtgctgacttcttgatttcttcttcattagtcgtcatgtgtcttctcctacttattttcctttattttagcattttcacttataaaaaaataattaaactcccctttcactacattttactgatacaatagtagtcgataaattttttaagaaagtttaggtgaaatttttaaacgatgaatggtttatgggattcatattggtttaaattaattatcattattttaattctgctgttagctgctttatttacactgctggagtattcagttgttaaagtgcggcctagtgagttaaaggagctccggcaaacgcgaaaagtcaaacgtgcggaacacatggtagcaaatcttaatgagtacctatcaacagctcaagtcggtgttacgatgacttctttagttttaggttggttaggtgatgaatttatcacagatctattgctaaagattaatattattccgcacgatgttcttcaagcgattgcaccagttatcggtgttttaatttttacattcttccacgcggtatttactgacttagttccgaaaaatatggcgattgatcgaccggtaccaattctcttatcaattgttcacccggtacaattcttccatactgttttttatcccttcgtttggttatttgcggtagtcgctgcggcaattacgaaaatgttaggatacaatgttcagccagaagaagacacatattcacaaaatgaaattatgaccttatcccaacaatcggaaaaagctggggaaatggataaagaagatgttatcttcatgcaacgggcttttgaaatgaatgataaagttgctgaggatattatgattgatcggacacagttagcggttattgatattacggcttcaattgaagatgcagctaaactttatttcgaaaaaaaattcacgcgttttccagttgttgctaataatgacaaagaccacattcttggttatatttttgcatatgatattatgcggcaaaaccaaatcaatccgcaacaatcagttcgcacaatcatgcgccgaattccaatcgtttacgaaaatgaacaacttaccaatgtccttgctgagatgatgaaaaaacaagtgccaattgtcgttgtccaagacgaatacggtggtacttctgggatcattactgataaggatatttatgaagaattattcggaacagttggcgaagaaattgatcatgctacctctgatatgattgaaaagaaggatcctgatagcaagggtaatcctaccttcgaagtttcaggtaagatgccactagatgattttgaacgttactttgatacaaacatcgagcaatttgacaactctgaagtaacaaccttaactgggtttttccttgaacggcagtatgacttaaaagttggccaaccaattagagtcgataatttctcattcacacctcttgatttgaagaatgcctatgttaataaattcaaggtagtttacattaagcctagaaagaagaagccattagctgatgaggatcaaagcaaggaaaaatagatattaaaaaggctcgccgcaatttaggaaagatttcctagttgcagggagccttttcattagcagttcatctgcatatcaggaatgcagttacatttgacgtggtccggcgaattagttgctttgcttgccaataattcttgtaacttagcaatatcatccttgctaagggttacattattgatcacatgttcaagggtgcttccaacgtgtcgttcacaaatattattaaataggttgtccgccgcttggtccattgtttgctgttcgggaactaagggctcatagataaatccacgtccttgacgagtggcagataaggcttttttatcaaccaagcgtcgaagtaaagtcttaatcgttgccggtttccagtcaacttttttctgtaaaatttcaataatttggctactggtcgtttgccttagactccaaactacccgcataatttgccattcagcgggagttatttctaaattaatattcatctaattcctcctgcgtttacacatgtaaattcttcgtaactatattttatcattaatttacttacttgcaaattcctaatgtgtattgacattaataatctggctagtaaactcaatactgtttgactaattttaaggagcgctatatctactaatgaaaaatcaacgcatcagccatgcattagtaatcatggtatttggtacatttttcggtcttctctgttcaaccttaatgaacattgctctcccaacctttatgaatgtctttcatatcagtgaggctcaggttcaatgggtaacaaacgggtatatgcttgtcaatgccctaatgattcccgttagttcattccttataaaaagattccctttcaaaaatctttttattattttctctggaatttttcttctaggaactattatcggagcgattgcgtggagcttcaatctagttgtaattgctcggatgattcaagctctgggtgcaggaatgatgatgccactagtaaatgtcttggcaattcgttacgcaaaaccgggtaaaaaagggcaaattatgggaattattggtcttgcctttaattgtgcccccatcttaggccctgctatttctggctttctattacactttttctcttggcgataccttttcctattaattattccctttgcagtaattacattactactttcattcttcctgcttcctaaaatcccacataatgaacatccccgctttaatacattggcccttattttaatcacaggcggattatggtcattattaatgggcttatcaaatgtttcgaacagtcacttgctttcatttaatgtcgcagggtatgtccttatcggcttagtctttctcttccttttctttcttaaccaacgtcacagtaagcgtcagttaatcaactttaggatcttctcccacaaacaatttgtttttgccactgttattaatatgctaattacatcaacaatgtacggtaatgcaattttgattcccctgctcgtacagattgtcttgggcaaaagtacggttatttcagccatcgctgtccttccggggcaatcttaacgggtttactatcgacaacgagtggccgcttttatgacatttatccaattaagattctcgttgggactggtctcataatcgatatcatcggaacaatcggtcaagccgcaatcggtgcgcgtagttctgtcctcatgatcactcttttccaaacaattcgccagtttggattagtgacaatgttaatacctctgcaaacacaagcattatcattgctacctaatgagatcgttcctgatgcagttgctacctttaatacgttacgacaaattgcggctgcctttggaactgccctcatcgtttcaattgttggtattgttaatcacttagttcacaacccgtcctcacacctcggtattcaagccggcttccttctatgcttatgcctgctattaacttcgctataccttagcactaagctataccataaaatttcttcgcaagcgcaattagaaaatgcgtaaaacaaaaaccaagtaagatcccttttgacctcgcttggttttttgctatttaaaaatgcaaattcaatagcgttacaatacaataggtcatcccactcgcgataactggaccggcagcaattcccttaaacgcaactactccaataatcgttccaagtactaaggcaaccgtgacttgaggaacagctgccaactggttgactccatacttcgataagatggcaactgcaatacccatgccgactgcaatccaaccagcaggggtcttaaaagccgcccataaatcatcaaaaccaatttgccccgtcgcaattggaatcaagatcgcaactgaaatcactgttacaccccaattaattcctttatgctgtatcaggggcaaccacttggcggtataagggatcagtttcaaaaccattactactactgtggcaataatcaatgacgagttatgaccaaagattgcaattaataatactaaagctaaaaaaagccagctttccatgtaatctcctcctcaaactttacctagtatatcaaagttgaggacgaggacaaaggaagctgactaattaactaatcagaaaggcggctgtgagtagcgtcatctacttcttcgcaccattcgctagttcccttcgtaatagcaatatgagagaaccaactatctttagtagctccatgccagtgctttacaccttcatgaattgctacaacatcaccgggttttaacaattgcgccggcttgccttcttcttgataccaaccctcaccagcagttactaataagatttggaaaccatcatggtgaatatgccagttgttacggcaaccgggctcaaaattaacgtttgaaacatttacatcaatgttatcatcaggagatactaacccattgagataacttgttccaataaagtattttgcaaatgcaacgttcttatcaccaaaaccaaaaaggtcattttttatttcgtattcattcttagccattattactaacatccaattaattgttggtttaataataaactctagcattaagaatgtaaaaatcttattataaatggtgagttattcaaaaaatgaattataattttcgcaaccatgaaaataatgacttttcattgaaagctggactaccatgagtaagaatatggtagccgggagtgacatttaacttaccagcatagttgatgaagtcctcttggtaatcaccagtgttactccaacctgtactaaacggcgcaatcttaccagtgaatttttgaatttgttgaagtaagtcaatgattggtgagacaactccgccattccagactggtccaccaactaaaatcaaatcgtaatacgataagtctggtaaggtggtcactagtttagggaaggcatgtgtcttaagctgttgctgataaattcttccagtttcttccatatccagtggaaaagtatcatcgggaactttaattctcacaatatcggcaccagttgcttcatgaatcttactagcgagtctagcagtgtctccgaattgcgaataatataaaattgccattatcaataactccttaatataaataaaaatgagggataccatatggatacacgtgtattaaaatactttttaactgttgcacaaactaataatatcactaaagctgcggaacaattacatattacccagcctaccctttcccggcaaatcatggacctagaaaccgaattagacataaagttgtttaaccgagaaaaccggcgccttcagctcacaaaagctggaatcttatttcaacagcgagcaacgaccatgctacaactcttggatcaaactgaaaacgaccttcatcaacaagaagaggcattaacaggagaaattaatctcggctcagcagtttcgagtgtctctccttatataacgaaaataatttttgaatttcaaaagctttacccgaacgtaatctttaatttatctgatggggatggcgatgtccttcggcgtcaactagatgaagggctcaatgaccttgtatgcctccttgaacccgttgaagctgctaaatataactttctcgaattaccggtccgtgaagaatggggagtaatgatgaaaaaatcggccccacttgccaagtattctactatcaccaaagaagatctttacaaaattcccttaattcttccccaatgtagtattgttcgcgatgaagttagtgatatcttaaaattagatcaaacgcgtttaaatatccgtgcgacaactagtttacctggaaataccgtttcacttttaagaaatagtaattactatggtctgacaattaagggcgtctataataattttcatgatcctgaccttgtttttgttccccttgtacctaacaaatcgacaggggatgtccttgcctggcgcaaaaataccatcttatctccagcaatcgaaaaatttcttcagtttgttaacgagcaaattcaaggatcctaaagtatttaatgttataactgatttagaaaggggaatttaattaaaatgaatcaaaatctacaaccaaagataaaattaaacaacggtcacctcatcccccaacttggcttaggagtctggaaagcctcacttgcggaaacacagcaaatggttaaagaggctgttatgaatgattacgtcttaatcgatactgctaaacaatatgggaatgaagcagccgtcggacaaggcattcaagatggtttcaaggctactggccgtgaacgtgatagcatctttcttaccactaaaattttcaatggtgatcaaggagattatgataaacttcggcaagcagtgaatgagcaattaaaaaagttacaaacaaactatgtcgaccttctccttcttcattggccagttaatgataaatacaatgaaagctggcgcgcgttagaagagatttacaaggacggtcaagcaaaatcaattggtgtttgcaattttaatgttgaacgaatgactgatttgctcgatcacgccaaaattaaaccagcaattaatcaaattgaattcaatcccctgattcaccagcctaagattgtaaagttttgtcgagaaaataatattcagcttgaagcctggtcgccactaggtaatggtcgtcttctttccaatgatgttattaagcaaatcgcagacgagcacaaaaagagtcctgcccaagtaattcttcgctgggaaattcagcaaggctttatagttcttaccaagactactcatcctcaacgtatgcaagaaaatgccgaaatttttgactttaccctatcaccggatgaaatgaagcaaatcgacaagttagatcaagaaaagcattctatctggtatgataagttcaagtggtcaggaaatccggacggtgtagatgactatattggtaagccgggcgcattttgatccaaccaatttcatatcttttaccataaagggcacctctaaacgagtgatgccttttttattagctaaaattttctagaaatgttcatattattatactataattaaaatcattaaaagaaagagaggattctttaatgaaagctgttgtatctgttctaggtgaagaccaagttggaattatcgctaaggtaagtgcccttcttgcccaaaaacaaattaatattctagatgtttcccaaacaattatggatggcaatttcgtaatgatgatgtctgtgatgatccctgaaaatcttgatagttatcaattaactaatgaacttacagaacttggtaaagagattggcgttgaaattaaccttagaaatgccaaaatttacgatgccatgcataatctttaagatatacaggaggaatatcacttaatgaattcacaacaaatttatgaaaccagccacatgatttctaatgaaaacctcgatgtgcggacaatcacgatgggaatttctttgcttgattgtatcgatagtgatagtacggttgcatgtcaaaagatctatgacaaaattacgacaaaagcaaagaaccttgttaaagtcggccaacaaattgaagccgaatatgggattccaattgctaacaagcgagtaactgttactcctatttccctcattgccgctgcttctcaagaccacgactatgttaaatatgctaaaaccttagacaaagctgccaaaacattagggattgattttatcggcgggtacagtgcgctggttcaaaaggggtaccaaactggtgaccgtacgttaatcgcttccctccctgaagcattggcggaaactgattttgtttgtgcatcagtaaatgttggctctactcgtagcgggatcaatatggatgccgttgcacaaatgggtgaagtagtcgtcgctggttcaaagcttgatatgatgacaaatgctaaactagttatcttttgtaatgctgttgaagataatcccttcatggcgggcggatttcatggtgttggtgaaccagatgtagtaataaatgttggtgtttcaggacctggagttatcaaaaccgccctagaaaaagttaagggcgaatcaatggatgtcgttgctgaaacgatcaagaaaactgcctttaaagtgacacgaatgggtcaattagtaggaactgttgcagctgaaagactgggcgttcaatttgggatcgtggacctttccctcgcaccaactgctgccgctggtgattccgttgccgaagttctagaagaaatcggcgttgctcaggttggaactcatggaaccaccgctgctctagctatgttaaacgatgccgtgaaaaaaggcggtattatggcctgcagtcatgttggtggtttatcaggcgcattcatccccgtctctgaagatgctggcatgattaaggcagttaacgctggaacgctaaatatctctaaattagaagcaatgactgcagtttgttccgttggtcttgatatgattgcaattccaggtgacacgccaaaagaaaccattagcgcaatgattgctgatgaagcggcgattggaatgattaataataaaaccactgctgtccgcgtgattcccgcacccggcaaaaaagttggtgatacggttgaattcggtggtctattaggatatgcccctgtaatggcagtcaataaagccgcaagtaccgcaatgattaaccgtggtggacttattcccgccccaattcatagtttcaaaaattaatttaaaaaatagcgagagattaggaatccctagtctcccgctattttagtgtttaattacctgttaataaggcgtaaacatatgaattttcttctggacggtaaaccccgtgaagttcaccaactttagtaaagccatttttgtcgatcaagtgttgcatgatcttgttgtcttcatgagtatcgatccgaatagtcttaatatccttccgattattcttaatgtaatcaattacactagtgaataatgctgaggcatatccttttccagcatgattggagtgaattgccacacggtgaataacaacataacgatcagtgtcaattaaccaatcaccgtcaagttcatcatatgagtgatctggtgcttcaacaattgataatgcaccaacagtttcatcatcttgtgattgtacaaggtatgcaaatcctttttcaatatcttctttgatatgttcttcgttcgggtaatctccttgccattgatcgatcccttgttcagctaattggtttcgaccatctcgcagaatttccataatttgatttaaatcatccattttggcttgtttgatttgcatcgtattaccttcccttctcattacattaattagatgtgttattcgtttagcaaccctaatactgtaacatattttacgttttaaatacaactgttaactattaaaagatgccccttcaatatgctatgatagcactaaaaagaaaaagaaggcttctatatgatcaaatttattaaatttactttaacaatatttactgcatttttcctaatattcatttatggactagcagcaaatccagttcatgcagatctctcaaataaatatattcattctactacccccaccctctttttccatggctacggaagcggtgcccatgcagaagaatatatggtaaatggttttgtgaaagcaagtgtgtcaaagacagttatcaccgcagatgttgctggcgatggaaccgttactcttaaaggagatattcctcataacgccgtcaatccgctcgtgatggtcaatttcaatgataaccatagcacaaattatgaattacaaggacaatgggttaagaacgttcttgaagaactgcaagctaaatatcattttaaaaaggtaaatattgaagcacactccatgggaaacatggcagttatgtattttctgcttgctaatgccggcaaccataatcttccacaaattcaaaaacaagttgcgatggctggagcctttgatggtgcaatcggttggaatgaacctgctaatctaatagtgaataaaaagacgggaaaaccttccgcaatgaatgattcctatcaaaaattacttcccttacgtcaccgctacccacggcaaattaaattattgaatatttacggtgacttaaaagatggcaacgatagccaagtttcaaacgcttcctgtctttctcttaaatatcttattaataaccgcgcacgttcataccgcgaagttaagattactgggctaaacgctaaacacgaattacttcatcataatccgcaagtcaataaaatcttaatcagtttcttctggggaaagtaataatgttgcactaataagtttattagtcatttgaaagtagtttttgtataaagcagtgtaacgaccactatttttagttggcagccatggcttgtctcgcccgcaataatggagaatcacggtattacgcattacccaatcggttgtccattcaccaaaggaaatcgtttcgtaaataccgcctttacgagtatcaaaattatatagttgatcagggaaagatttaatataacgtccatataaggcattcaagacgtcttgatcaggtaataaaagtgtatgggtacggatgtagttaaaaatatccgtatcctttacttttttacggatagtatcaaggttcatcaagagaacgccagaattataatacccgtcagcatcaaagttttgcagacgaatcttattaataacctctgtcgtattcgtcaggtttgtatggatggcagaagcatataggtatccctctaatgaagtctcatacagacttgaaagatcattaatacacaatacatcagcatccaagtataaaattttatgcaaatcttgaggtaaaagacagtgtgctagtaaacgataataaattgttgtcggatagcggtctgtaactggtgctttgctaaataattgatcattaactttgattggaaaatagttcattcctaattgcttacaaactctttccaagtcttcagttcgtttcaatttctccttttgtaagacatatacattaaattcttgtgcatgagtatttaacttgatcgataacaaaactgttgctaattgcgtgacaaatttgtcgttaattgaaaataataaattcattttattccacccctcacatcttattctacaaaacgttgacgtggattgcgattcagtatttaataattaaagaaccaatcaagaatagaggttttatgatgaaacaagcggaacaattaactgccattaaagagtacaccattcaaaaattaggtcaggacaagactggacatgggatggaccatattaaccgcgtagtaaaaatgagtaaacgattagcaattggtgaaaaagttgatccctttttgcccatcgtggcggcctaccttcacgatacaattgatgagaaattagttgacaacgttgaggcagctaaacaagaattagttgattacttaaggcaaaatgactttagtgatgaccaagtcaaaataattatggatgtcattaataatatttcttttgctcataccttagataaagaggaagtcaagctctccatcattggacaaatagtccgtgatgccgactggttagatgcaatcggcgcaattggcattacgcgggcaatttattatggaggtggccatcatgaaaaaatatacgatccggctattaagcctcgtcataatatgtcccgggaagaatatcgtaatttagcaaatgaaactatcattaatcactttgatgaaaaactcttacatctaaaagacatgatgaacactgaaactgccaagaaaattgcaaatcaccgtcaacaagtgatgctcgactttcttgatgaatttcatgcagaatgggatgcaaagatgtaaattatttagagaaataataaatgccttggaaaacttgaatgtttttccaaggcattttgcttacttatcatcttttttatttttagcacttcttaagtcgacaataatcgaaccgccctgcttatcgcctgcagagttacctgaatcattattatgattattatcaatatgcaatgcttttcgcgctacccaccgaaaaatcaatgagatcggtgctaccaggaagccatacaataatcctgtcagtaatgcattaggaataatcagttgaacaaatgttaatccacctgttggcgtccccgttaggactaatccaattagaccataaaagattgaaataaagaataattgaactagaccggtaaaaatagcaagccataataattgtgaatgattgagatcaatagataatggaacttgtctgcgtaaaatcaagccaaccacaatcaaaataacaataaaatcgactaatattacccagtcagcagttcctaagacaatcatgattatggcactaacaagcgtcacaataaatgcaatattaattcccaatgcaactgctattcccactgcaatcacgccagctaaaggcataaacgccttaccggtcggcaaaatggtttgaaagccagtaaatgatattaatatcatcaaaatacccgccgtaattgccaaaagggttttaattaaggtttgttttttcatgctaaaggcttctttgctgtatcttgcatccatgctaaggccagggctccttgtcctaagtgggaaccaattactggaccaaagtaactcaactcaaatgaaatatcaggatgatccgcttgaagtttatcaagccacttttggccttcttctggagcatttgcgtgaacaaccatcgctctaactggatagtcaagtttggcaatatcctcatcaaagatttgttcacagcgaagtttagcctttttcattgaccgcaccttttcaaacgcttcaatggcatgcgttggagtatgcatagtcaggagaggtttgatttttaaaattgagcctacaaatgcagaggcgtttgataaacgaccaccacgaacaaggttttgcaagtcatcaaccacaaatacattattaaaggtatcacgatattcctttacctttttaacaatgtcatctaaatcatcgccttcactagctaatttagctgcttctaaggctaagtaccccatcattttaactgttaggtgggaatcaattggtacgatcttgattgtatccttcatctgctcagcaagttgttcaacagtatccaaatatcctgtaatagcccgtgttaaatgaatgctaatcacagcatcatacccatcatcggctaatccttggtaaacttccatcaattgaccgattggcgtttgagaagtcgttggaaaagagcttgaatttgccatcttttcataaaaatcactggtggaaatatcgacaccttcacggtatgtttgaccatccaatgtcactgggattgggacaacatgaatattattagccgccgcctcttcaggagaaaggtaggcagtgctgtcagtaacaacagcaattttcatcttatcaactccatgttctaaatttgtataaggcagattgcaagaaataacttgaacaaagttagtgacgcagattacgcaaaaagatctcaattggtgtgcgccagtttaaacatttgagtggcctggagttcaaataccagttaatttgaattaactcatcatcagtgatttcctcaatcggttgacttttaaggataaagcgtcgtagtactcggttgcgattctcattactgccccgttcatgtggagaataagcatgcgcaaagtagaggggaatcctggcctgctcttcaattagcttgtagttagcgaattctttcccatggtcaacagtaagggtcttgagattatcttctaactggttagctaattctaaaatggccttggtcattgaggtactatctcgtccctgaagccgtttaacgatgataagacgactcttacgctcgacaaacgtagctattgcttgacctttacgctttccagataaaactgtatccgcttcaaagcgacctgaggtatgacggtcaataacttcagcaggacgatcttcaatggaacgtccatggctaaaagtcccacggggttctttggctcgtcggcggcgaattccatggtcaggtaaatcagccacgtcaatatccaatactccttgatcaatccagttgtagatggtcttgtaggcgattctaactacatgagccacttgttcaatcgaccatttttggatcttaatcttttcttcaattaatcgcttgaggttagtcgttaagatggttttacgcccacgatgactaagtttagcttcatgatcagcttgagctttaactgcgtgatattcaccagtcaaacgatgaacctcattaaagatcgtggttttaccgaagccaaggtaatcagcgatgtatttaagggagcggttttcataacgaagagtttcgatgacaacacggtcttcaaatgataaaatagtggtgcccataaaggtccttctttctaatggaatgttgtggtaacaccattaaagacctttatgggtttttatgtccactaatatgttcaacttaaattttacaatctaccataattaaaaataattgcgtttttacgcggatttcacccacataatacaaaaagcataccacattgacggccctaaaccaaccaaaaatatgtccactaaagcatcattacttttcattaatgatgtaaaactgtataattaatagtgctattttcgtttgtaattataatatttaggaggctacactaatgtcttttgatggcttgtttactcatgcaattgtccatgagctagatcaaaaattaactactggtcgggtagccaaagttagtcaaccttaccctgcagaattaatcattatgatccgtgctcaccggcacaactatccattactcatttctgctaatccaacatacccacgaatccaaattactgagatcccatacaaaaatccagcggttccaactaattttacaatgacgatgcggaaataccttgaaggtgcaatcgtcaataaaattgaacaagttgataatgatcggattatcaaaattacctttgacactcgtgatgaattaggagatagccaacaattagttcttgtgagtgagattatggcccggcatagtaatatttcactcgttaatctcaagacgggtaaaatcattgacaccattaagcatgttggctcagatcaaaatcgggttcgcctgttattacctggtgctacctttgtcatgccaccaaagcaagataaagttaacccttacttgccaaaccagatctactctgatcttgtaagacaaaccgatgacacagtagaattaagtcatcagttacagaagcattatcaaggatttggcaaagactccgcacgggaattagctgcagaattactgcaaagtgataatttaccagctacctatcagcactttcttaagcactttgaaaatccagagccagtattaatcacccactctaatggaaagtctcaatttgctgtgttccctccattaaatattgatggtgagttgcaacatttcgactccctctctgcccttctcgatgccttttatgctaataaagcagagcaagatcgttccaaagaattagctgggcaagtgttaaaggtattgaagaatgagctaaaaaaagatcggcgaaaagtaaaaaaactgcaacaacaattacaagatgcagcaactgcagatcagtaccgaatttgtggtgagatccttactacctatcttagtaaattaactccaggaatgaaagaaatcgaacttcctaacttttatgatgataataagccactgaaaatcaagcttactccagaattatcaccatcgcgtaacgcccaaaagtacttcactaagtataataagcttaaaacctctgtcgaatatgtaaaggaacagctaaaactgacaaatgatgaaatcaaatactttgaaaacattgaaaatcagattaaattagctgctcctgctgatattcaagagattaaactagaattacaagagcaaggttatattaaaaagaagaaaagtgggaaaaagcaacgaaaagttaaggtaagtgccccagaagagtttcatactagtgatggcactacagttttagtaggtaaaaataacctacaaaatgatcgtcttagctttaaaattgctaataaaaatgaaatttggttacatgttaaagatatcccaggttcccacgtggtaatccgctcaacaaacccatctgaagatacgattctagaagctgcacagttagcagcatacttctctaaaggtcgcgattccgataacgtgcccgttgattatctccctgttaagcgacttcataagccaaacggagctaaacctggatttgttatttttacaggtcagaaaacactttatgtaacaccacataagctttctaactaaaaagaggctgggaaaaaacttttgttttctcccagcctcaactgcttttatgaacaatagaaagataacgtggaactagctttgcgtcgccacaaggcttgagtctaagtacggacgataatcagcccgtgccgtgctaatcatcgtcctagcttagccaaccgccttgtcgaggaggttattttccacttcttttttatatctcccgaaatgtcaatttaagttagaaagaaagtagttgctcatcagtgacgtaggacatgaatacctcatatggagttcgatagcctagtgatttgcggggcaggttatttcgcttactcatcagttgggtcaccaattcatcaggaagattgcggaaatctagctgttttgttaagccgtcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgctgcgggaatttccgaagccactgacctaagtgttggttaatcgcatcagccgtcttttcgtgcacattgagtacaatttcgaccttcgattggcgttcggtcagggtcattaccgccccttggtgctttttgccttggacggtatcagcttcaaggtgtccaaattcagtggcatagtgcggaaagtccttggcacgctcgtgaatacttcgccccaattggccagccttcccgcggcgctcaatatagccattcgggtgccgcttacctcgcatgggcaaagcacggacatccaaaccgaactgcccccgttcaaacatccggtaaagagttcgccggttacaactaattgggcgctcagcgcgcccaataatggtgtcaggcgtccacccctgggcaattttgtcgttgatataagtaagttcagccagtgacaactgagtacgttttcggccacaacgttgcttattgcgcatatagtgatcttgataatcagcaattgaggcaccggtttccaggtaacgataaacgcgataaacggtttcggcgctacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgtctctaaattattctcctaaaaattgcatctgagcaccaataactcggttgcgggcagggattccacctttgactcgcaacgccttaaatgggaaggttgcacgatagttaacaatccctgataccggtttgggctccagcattttatcgaatttaccagtgaataattgagtaaaaattcctggtaagctaatatgaagtgcttttgataaaaaggctacttctggcaatgataatggttgaactttaattaaattaaattcaccatcattctcttcaaaaatcacttggtataatcctggctgttccagctttaacacagcaacactagcctggtcattgagattttggtaagttgacgaaggaagatcagccgggtagcgtaaagcggtggattgatagtttaacgcaattggtgaaaaaagatcagtcattgttcctaatggataagcataattaccatcatagacataattgaaggagtaacgttgcctatcgctactagcagcagtagttggcaattcatctggaattacgatgatttttacatccaagtcataattttgcaatgatttcaataatttactataactagcaggaataaacaaatactggggttgctctatccgtaatatctgcaaaatattttcaatcgttactggctcaacatagcgcttttcagctaactctggattaaacgtaactgaactaggattcgaatttacaatgacgttattaaagccctcattatgaagctcttttaacatcatagcaacaaagtaatcaccagaattacttaatcctaaacgtagtccccccgttccaattacaagggcatttggttgggaagttcggctaatttcattttcttcttcataagcagaataaaaactattagtatgttgatcaaactccccggccgatggttcgatttccttgtactttgtcaacaattgatggtctaaactcatctgataaacttgctcagaggtagttttccatagtcttgcaataagctgattgcttaatccgtaactctttgctttttgtaaaaccggttctttatttggatgctcagcaatttcccgaatcaacaaccgcattttattaatctgttcaaaataaaatgggtcaatctttgtcatctctgctaattcgttaactgaatatcctctctgcattgcttcaattaatacaaaaagtcgtcctgcttctgggtggacaattttggcgattaattggtcatcagtcaattgcttttgagcggcaagatgaaagtcagctggctcgtgataacgggattcaatagctttaaaaagtgcttcaatagtgcttcggccgataccaaaaaccgtccccaccgaccgtttttctgttccaagtaaacgactagcttttggtaaatcgttgaatccccatattggaacccgtgcagcaatatgatccatcgttggttcaataagagccgcatgatgaacataattttcgccaagatcaatgtcccgcagatgctttcccgcatataattgtgctgttacttgagcaattgggtaaccagttgactgcgacacaaacgctgtaattcgatcaaagtatggactgctcttaatgacataaaaacgatcactatttgtatccagggcaaactgaatatggtttgtaccaacaattcttaatttgcgagtaatagcaaaagccgtatcccgaatatcctgaatctgccgatcgcgaagtgtttggacaggattgaaagcaatcgaatcaccagcatggataccaattgggtccatatcctcaatcattgacaacatcatcatcgttccagaactatcacgttgaacgactacttcaatttccttatagccagcaagactttgctgaactactacctgttccgcacgcgactggctcaagcaagcctttaccgcatctgccaattcacttcgatcatgcacgattttacgtgtactgctactcttaggtaataccgaccggataataactggatatcctagtttagttgcctcatccaaagcatcctgataattattaaccgttacgatttttttaacaggtgcttccatttgacgaagggttctttcaagtaaaaccgcactattaatttgacgaatagttgcttcagggactcctagcaattgaatattttctttacgaataatccctttttctagcaattcttgggtaagttcaaaagcccgacgatttcccagtgtaggtaagattgcatcaggatgaaatttattaataatatccattaggctttcgacttttagtgggacaatacaaccgtggtcaacattttctaagcttactgaaaatgggttatcatctgccaagattgtttttatcttcatttgcttaaaaacgcgtgagacctggtaaatagcagagtcgagctcatcaccgtgttgaacatcgttggctcctgctccaataatcaatacagatttcaacttttccatcaatgacgatcccccctcctattcattgtatcaacgaactcatcaaacaagccatcagtttcatcaggccccggtgcaccatcgggaaagaattgaactgaaaaagctggatagcgacgatgacgaagcccttgaacactattatcaagcatgtcaacgtatgtaataaaaagctgggagcggtcaaccgaattacgatcaatcaagtatccttctgcttgagtcgcatagacaatgtggtcagtaataatttcatgaattgggtgattcaccccatggtgttcgaccgaaatttgctggacatttgctccattggcgattccgaataattcatgacctagtccaatagcaaacatcggtactttggtctggacagtacgaatcatttccaggaccgacctacgaacattatttgggtttcccggtccacttgaaagtacaaccccatcaggatctaaccgtaatatttcttcagccgttgcagtatatggtaagacagtaatattgcattttcgtcgactcaattcccgtaatattccgttctttaatccaaagtcaatcacaacaacacttagcccggttccaggattaggatatggcttaggagtagagacttgagcaacttgctggttcgttaaaacagtcgcatgaagctggtcaaaagcgtgatcatctggaactggaacaatacttccttttaatggcttttcagcttttcttaacttatgaactactgctcgcgtatcaatattagcgattccaggaatattcatttgttgaaggtatttatcaagtgtcaattgtcgtccattatcatcggtgccagcatcggcaagggaacgaacaataattcctttaattgtcggtacaatggattcataaatattacgttgaatgccgtaactcccgatattcggctgggtaaaaacgacaatttggttattataaacctgattagtgataatttcttggtaaccagtcatactggtgttaaaaacaacttcaccaaaagtaacagctggtgaaccaaaaccttcgccagcgaaaattgagccatcttcaaatattaggtatcgtgctgtcactgtcccactctcctaaaactttgttaataattgatcaatattattatgaacgttctctgaattaaacacaataattttattggtctgtcttacgtaaatgttcaagcatttttgtgaaataggctggtaatggagccgtaaaaaccatttctttgcctgttcgggggtgtttaaagcctaacaaacgagcatgtaaatattggccgttgccagtaagcgtttttcgcggtccatacaacggatctcccgccagcgggtgaccaatatatttcatatgaacgcgaatctggtgagtccgtcctgtttctaactggcaggcaactaatgtgtaattcttaaaccgttctaacacattaaaatgagttaccgcatgacgtccatcaaccacaactgcctgcttcttgcggtcctttaacgagcgacctaatggagcatcaattgttcctttatcttcttttataactccatgcacaagcgcaacatattctcgtttattagtttttgcttttaattgagctgtcaaagaacggtgcgccatatcatttttggctaccatcaatagtcctgaggtatccttatcaatccgatgaacgatccctggccgaaattctccgttaatagttgatagtggtgaatgatataaaagagcatttacaagcgtatggtttggatgacctggtgcaggatgaaccaccatcccctgcggtttattaacgacaataacatcatcatcttcatatacaatatcaagaggaatatcctcaggtgttaaatcaattttttgtggttcttctggaattatttggacgtggtcacctacaagcaacttatatttaggctttacttgttcgccattaacaaggacgtgaccatcttctatccaatgttgaatttgtgatcgggaaaattgatcaaagtgatgaccaagctgcttatcaatccttcccaccatctcaccatcaattgttaattctaattcttcagacatttgttagtctttctcctttaagatgcaaattattagccagattacgccaattgttaagcacatatccgcaatgttaaaaattgggaaattaataaatgttgtttcaaacatatccacaacatacccttgtcttaaccgatcgataaagttgccaattgttcctgccataatcaatgataagccaattagcataggaatatttttacggtactgccagataaagtaaccaattacaataatcgcaacaatagttataatggtaaaaaaagtttgttgcccttcaaaaatgctccaagcagcccctgaatttcgtaaattagttaactcaataataccaggaattaactgcttactaccaccaagaacaattgaagaagcaacccaagattttaataattggtcacaaattgttaaaattaaaataattacaatagcgatccccagtaacaattattgaaccccctgttgtttcaatgccaatttcaagcgtgcaattgctttggtggtaaaggtaaaactcattacctctccattcacagtaattgtcaccgtatgcttggtaaactctggctgacgaatatcagagattgggataacgaggtactgtttttgtaacaaacgattaaacaccattttagtcggagtgattactacggttcgtcgccgccattctaataaggcaaggattacaaaaactgcaaaaaagagcgcgctgagccactgaaaatgagtaatttcaagccaaattacgagaccggcaataaagaagagaaaagtccaacaccagctaataattgtccccgtaaggtctggttggtaaaaataacgagtttcttcttccataattataaatgtcatcctttcagaaaagaggtagttttatgatcaaaatctttacagatgctgcaacaaaaggaaacccgggccctactggtttgggaataataataattgccaatcataagcaaattcagcttgcaatcccagtagataaggaaagcatggataatcaccatggcgaattcgctgcagctcactttggatttaaatatttaattgatcactttagcaataatgaaacaatcctattttatactgatagccgtatcttaagtgacgcaatcggcaaaaattatacaaaacattaccaaaaagaattagcagcattaaatcctcttctccaacactttccaacagttgttacccagtggattcctgaaagccataatcgtggagcacataatttagcaaatcaggccctccataaaatagagtgattttagaaaacatcatatcgttttaattatatcatccacgtgttctatcagccaccaaacagagaaaaagccttagcggtcgttacaatgtaactcctactaaggcttttattattgggaaaatttgccccctagcacctattttcgatctttcgaatcgcttggaacccttgctatttaagggatttgatcttggagcgatcttttttgccccaatattggtagagatctgttcgtaaagcaccattataaagtttacgacgcttggtagcgggtgcgccataataattttcaaattccatatcagccgtcaaaatatatttactccatgtggttaatggacgatataactcacccatctgccggtaaagttcatgaactgattccttatcacttaaccgttcaccatatggcggattagcaacgataactccattaacttcgcttgtttgccagtcttttacggctaattgcttaaacgtaatatcgtgagttaatcctgccgcacgagaattttcttgagcaatatcaatcatattctgatcaatatcatatccgtggatatctaattcgatatcataatttgctaaggaatcggcttcatcccgaacttcatcagataaaccatctggaactaaattaacccattgttcactaataaatgaacggttgatgcccggcgcaatattatgaccgtataatgcggcttcgattggaatcgttcccgaaccacatacaggatcgacaaatggattatctgggaaccagtaagccagcatcaccaaggcggctgccatattttccttcaacggtgctccacctttatttttacgatatccacgcttaaaaagcccttctccactagtatctaacgtaagaagaacatggtctttattaatcgctacttctaacgggtaagtggcaccagtttcggctaagcgagtccgacggtggtatgcattactgaggcgttgaacaatcgcctttttagtgattgcttgaacacttggcacattatgcaattgtgagttatgactttttccttccactgggaaattcgcgtcaattggtaacaaatcttcccatgcaatgttttcagtacgatcaaacaattcttcaaaagaccgagcatcgaattcaccagcaacaatttttactcggtctgcggtccgtagccagagattagtccgaatgacatccttcattgtcccttgaaaacgcacccgaccattttctactttgacttcatagccaagatctcttagttcttttcctactaatgcttcaatacctgcagcagcagtagcaattaactgatatgtttgcacattaaacgctcctttagacttattcctattagctattttaccttatgttgctttaaaatgaaaagaagacgcaagaagaaacaaaaggaagcgagacagaagtcacttgttactttgtttttcgacgcgaaactagcctctgggagacctcgcaagcaacaataggcctccaatgtttggcttttttgccggacgttggaggccattgttgtactgcgtatttgctttttatgaaagtaacttaacttatgtcacaatccctttttgtttatgaatggtagttgactttaatctaactacattaatgaattctcatttactttatcagttaatattttataaacgcgttctatgtcccaggtggtgccacgagattcaaatgcgtccaataaaggcaaaccatattctttggcgtatgtcttggcagttattacatacatcttccctaaggttaagttcccactgccaattattcccgcacaacatttaacattgtcatagctttccaaataatcgtgcattggtgttgttaaaatctctgttaatgtcggcgtaaatctacttccaccaatcatatatgttggtagtaaaacaaaaaatttactatcgctttcagtcggaagtgtctcctctgaaatctccaataaatcgactaaaggattttcattattcaaatgatgttgttgcgttgcgtattcttgaagccgatgagtaaatgaccgtacattcccagaaaacgacatatatacaatttttattctcttattatccataattccctaacttcattatctaattttattaatcaaaagataagctaatttacaaataactcatttctaacccctttaacattataggcgcacttgcaataaaatgaaacgattatttatattttattgctattttaagtaatatctatcttaagcttctaaaatttaatttatcgccatttaactttttacttcaagcgagtaattattaacgcattctacaaaaagagaaccaataaaaccatactctgatttttaaaataaaaaaacccgagcgaactcgggtgcctgtatgcaagtatctgtaggccatgttttgtcgtaatataattatcaggcataattatatcgaggtaatcatctatctcagagtaccgaaatactctcccctggaatcacttcaatttgttatccaaagctcccctaccgtagtttgggtttaccgcttgaggggtttaccgcgttccaccaatatcgtttccaacattgtatcgtcactgtggcacttttcaggaatactaagacatagttaaaaccttagtccgtttttccgccgtcaccataaaatggtgccccgccttattttttcagcgagcacaaacactacaggcatcgcagcctgtgcgagcatggaccttcctaacacaacataagctgtgctcaattacccaaaacttgcaaaattattaataaactattcgacacgcactaaagcaaatgtgagtcattattatcattaccatctaactgtgaaccaaatacacgacgttctagattagatagacgctttaaaatatccatatttgtagcgctcgatacaggttgtcgggaagtagtttggctactcatagatgaaccaacttctacttgacgatttaattcatcaacctttgctctcaaacgttcattttcatcatttaaacgttcaagttctttgttataggtgtcgtagtctttaataacatcatctaagaaagcatcaacatccgcttcatcgtagcctttgccaatatttctctccttaaattgcttgtgcaaaatatcttgtggagtaaattttatgttatccaacttaaacacctcaattgtttagtttgcgtagtccaataactataataccaaatcaaagaaaaaatgcaagattaaaattcatctttttccctttgacgctcggcccattcttctgcctcttcttgaagttcatcaaaatcaacaagcgtcatcgaatactcactttcttctatatatttttgaatcgtctcataatcatacttagtttttccttcatactctggatcgtaaagaagaaaagcctcatcagtatgagtaagcataaactgctgataattccgtaattgttgtggcgattgataaggtttatctgaaacattagcaaaaaaatcaacttgctgggtaatatttgtcagcttcaactgattactttcattccattgcttaccaaattctgcaaagggaaacattaaagctgtttttaattgtggaaaatccgcttgaaattctaaagcagcttcaagtccccatctttccgttcccatttgtggtccagttattacccaaaattcatcatcatttaattctaattgagcccttaaatatttttttagcacctcttttattacttgaactttgggatcatcatccttaaatatatttagttcgtaacttcgatagccagtaatccataatctcttcataaaattctccctaaagcctttaacttaaacttgtaatcatcttgtatcaatcattatgtaacgagtctggtataataaatctctagttaggagagtgatcactgtgaccattcactatcccaatggtcagcaacctgtacaacactataatacacataatgaattaccgacaccacatcaatctatttatgccaaacgtgggatgtcattagaggatgagatcaatcatagtaatcattactatttggctcaccatattgctgttattcataaaaagcctacccctattcagcttgtaaaagttgattaccccaagcggagtgcggctgttattaaagaagcatattttcggcgaccatcaactactgattacaatggagtgtaccgtggatactacattgattttgatgctaaagaaacacgtaataaaaattcttttccattaaagaactttcatccccaccaaattcaacatatgcgtgaatgtgtagcacagggaggaatttgttttgctttcattaaatttacggagcttgacctgctatacctgcttcccgcttccaacctgtttaaatattgggaccaacagcaaaatggcggccgtaaatcaattttgcgaactgatatcgctaaagaaggctatcaaattcattatcaactcaatccgcgtttaccatatttaaacgctgttgataaaataattgctgcaaaagcgtaaaggagtttactatgtcaaatgataatcagtcaacgcgtagtgagcgtcataataataataatgacaatcaacagcgcaatgttggcagcttaataaagaaaatcttgctatgggtagcaggaatcgtcgttctactaatggtggcatctgcagctttatttttctactatgcctcaagcgcgcctaaaattagtagaagcgacttaacaagtcagagtattacgactatttacgatgatcaaaatcgagtaatttctcgtttaggagcacaaaagcgagaatatgccaaggataatcaaattccaaagcagttaaaaaatgctgttgtttcaattgaggatcgccgcttctacaagcaccatggtgttgatacaattcgaattcttggagcagccacttctaatgtttttggtcgttcagccgggatgcaggggggaagtacgctgactcaacagttagttaaattatccgtcttctcaacggctgcctctgatcgaacattaaaacgtaaagcccaagaagcatggcttgctattaatgttgagcagcattttagcaagagtcaaatccttgatttctacattaacaaggtttacatgggaaatggaatttatggaatgcaaacagcagcccagtactactacggtaaagatttaaacgatcttgacctttcccaattagccctgcttgctgggatgccacaatctcccacttactataatccacttgtaagtaacacaaagtatgcaacgcaacggcgcaatgaagtattgaatgcgatggttcgcagcaattatattacccaatcccaggctaaccaagctgcaagcgacagcgttactgctggtttagaccctgatcacggtaatatttcgggaagcggaactgctgtagattctaaggttgtggatccttatgtaaagcaggttcttgctgatttacaggcacaaggatacgacccttatagtgatgggttaaaggttcacaccaatcttgacctcgatgcgcaacaacacctttatgatgctgcaaataaaaatgttcagttccaaaacgataaaatgcaagctggagtggctgttaccgacccccacaacgggcaaattattgccatgctcggtggccgtcacacaggaaatgttgtgtatggacttaaccgagctgtgcaaagcaatcgtagttctgggtcaaccgcaaagccattaatggattatggtccggctatcgaatacttgcaatggccaacttttaaatcaattgctgatacgcggtttgtctttcctggtaccaacactgtccttcatgactttgacaaaaagtacaagggtaatatgacaatgcgtgaagccttagttcaatcacggaatgttcctgctattcgcgcattgcaagctgttggaattaagcgtgctacttctttccttgatggattaggaatttcacaaaaacaaccatatactttacaaaacgggattgcgctgtatatctccccactccaagtttctgctgcatatgcggcctttgctaatggtggtacttactacaaaccttactacattagctcgattactactcaagatggttcagtaaagcaattcaatcctaaaggtaaacgcgcaatgaataaggctactgcctacatgattactgatatgcttaaaggagttttcacagattcacaaggaagcgcaactgacgctcgactcgacggtgttaaccaagctggtaagacagggacgacaaactaccctggaaattctagccagtctggcgtaatggattcctggatggctggttatactaagaattactcaattgcagtttggactggttatgaccacccactcgaacctggtggcagcatttcagaacagtatgtaaagtcagcgcaattgctttacaaggacttaatgcaatatcttgacagccaaaatcacgcatctgattggacgatgccagacactgttgaggctgttcgagttaaaggtaaacgtcagcttgtaattcgtgattcaaaatgggcatttgattacactgaagatacatcggatgatcgtgatagtagttctacttctagctcaagcgattcatcatcgtcttcatcttcttctagctctgcttcaagtagtagcagcgaaagtcgcacagaagaacgcaacaatactccagctgagtcttcatcaagcagtgctccggctagttcaagttcatctgcacccgcacaaagttcaagttctagccctgcctctgctacacaaccaagcacaactaatccctaataagatcttttaaaaattgaagataataaaaaggattgtggaattttctccgcaatcctttttattatcaactttttttaataatgaattgtacgttttcgccgaccattttgtagaatatagacggcaataattactaaaataattcctaaaatttctgcccaattcaagttcaatttaaagaagatcacacttaaaatcgaagttgtaattggttgaacagcatccatgatactaactacatcagatggggcatatctagttgcatgaagcaaaattccaaatggtaaaatcgttccgaataacaccaccgtcgcaaccgatgctactaacgtggtagtaatatgtggtggattgacccaaaatggccggtagaggttaaataggactccggcaatcatcgtcccccacccgaggacaacaattggcggattttcatcagcagcacgttgtggaaggacaacatagaatgcagctgtaattccagaacctaagccccagagaagagatacaaacggtaaagctaattgggtaaggttaccacgcgtaatacataatgctaccccaatcaaagcaacaacaaacgcaataatatcactcctgaacggacgacgatgcataaaaataattccacctaacacaataaaaagcggggaaagatattgaagaattgttgctgctgaggcatttcctgtttgaatagcataatagaacgtaagcaggtttgccatcaatcctaaaatagcataactaataactgaaatagcagttgctcgtgtcttaaatacgttaaaaatcttttttccatataaaaatacactaattactaataaaattactcctgctgaaaaagtccgcattgagagcatccacgtagcaggaattgctaaattttgtgagatgagttgcaaaacggttccggatattccccacatagcggaggcaaccgctgcccatataattcctttcattacttgagaagaagatttttccatgtcaaccaccctttatttaattttattcgcctaatttataaatcggtattttaggcttttttaatgtcttcttttctggcttttgtccagcctcttttcgctgttcaaacctcttttcgtgctcattgatatctctttctgtccgtaagccctgacgatcccagctttgtagaatccggtccatatattggagatttagcgcactattcattactgcctgccgtaaagcaagtttaatcattattgccgaataattatctttatccaaccaatcattaacaatttgcaattccattgatgagagtggccggccaaattcggcctctagctgattaaatgtctcaacccgactattagtattttcaaccttaattgtttcctcttggtcattctcattgagcaatgctaatttattgataaggagcgaaaaatcatatattgcatcttctttaccatcttccatttttcgcatcttctgctcaacaagatggtttgtcatcatttggtgaagctgttcaaacacctgccgctcttttgttcctaagttctttgcaattgtacgaacatccggattcattattcctcggtcctgataggatttgaactgaagatataagacaaattgagaagttgtcatccccaactctttataatgatgtagcaataagttgcttatatttgtttctcctgcctgcaaataatgttgtaaaaggcttgcatctggcatttaatcagctcctctcttagtaaaatatttttgcaaaagtaaagagactgagtaatcccagcctctattagtttcagcttttattaaaggttattaatattttgaacgtattgtccagtcttaaaattaatcagatcgtagcagaggttccctttttgattacgatatgttacttcccagacaatcttgtcattaaatatcccgggagcaacttttaaaatttctcgcagatcacgatttgattttgtcatcgctcgtgctctcgcagcagtaatcccacttgattgttttagaactctgatcttgccaccgtgttggggaaccataaccaagatcggttggttttgctgattcttgccactaatcgtatagtaagtattctctcgattataaatataaaattggtcaggagattgaagatgagcatatttttcagcaagtgaaattgtctgtcgtcgcgctgaatttcgcggctgattgctaactgcaaaaacactccacactattaacaagattagtaaaatcgcaatcaaaaggttacgaattgtccgcattgaggaaccgcgactttgttcacgctgaacttcacgtcgactttgcatatcttttccctcttatctctttagttttttagattcttatatgacaatcgttttcgattataccagaaatcggtaattaaaagttgataaagtttaattaactttgtcctctttaccatttcgtaaaaacttctgagtaattgaaatcaagtcagcagtttttttgctattaaccggtaaatcagtgggcagactactcaaaatcgtcttcccataccgtcttgtctgtagtcgtggatcaagaactactgcaaccccatgatcatcttctgtccgtaataatcgtccaatcccctgacgtaaccgcatcgttgcttttggcaattctgaatgatagaacggatttttcccctgctgctgaagtaacttattatgagcacgattcattatttcatcaggcgaatcgaacggtaagcgcgtaataattaagagttcaagagcggactctggtaaatctatcccttcccaaaaactagaagcaccaagaaggatcgaattttttccaccactaaactgttttaagattttatcacgattacccgtaattccttgggctaaaatatcccgctgatcaaatagatccgtttcacgaagttggctatatacctgctcaatcatcaccagtgagttgaataaaatcattgtctgataatcagcattcttcgttaattggtaaatcgtgtcactgagatatttaatgtaatcactgttattttgagcgctcggtactggtgcatcttctgcaatcaataatttagcattctgtttgtaattgtatggagatgcgaatcgacgcgttaaagtattattgcgctctaaatctaactggtggtaaagatacggcgatcgtggcgatgtaaacaatgtcgcccccacaaataatggttgagcaaaatatggataaacattctttgtgaggtaatgggttgcttccaatagccccccactaagctgtaaggcactttgttcacttgattggcgaatagtaatccaaaaagcagcagcctctccttgttgttgaagtgtttcgttaaattcatttagtgtctgatcggcttcaattaattttgcaagctgactttgaaattggctcatgaggtaacgatcacttaataaccaccggtctggctgactgctaaataaatgactgagggcagaaaaatgaagctgcacactgcttaatgcctgctctagcttcatcatcacgggcccactaatatctaaaagagccatcacttgatcattttgtagtggttgttcaattaattcattatcaggattaccagtagcgcttgccatatattgacggtaaagggcttgctggaaaaggtcaaccgcttcttctactgcattgagatcaccacgaagcaattcaacattataactgcctagtgcctgttcagcgaaaatatcagttaagttccggtcattgccattattaactaatccagacattatatgaactgctgtgcgcaatttttgaaaattaaatgttcgccgtgaccgttttaagatactttcgcttaagtgctgagcttcatcgattactaagtatgggcgacgagttccatcccctaattcctgggcatgagcaaccaagtacgcatgattcgtaataataatatcagcttgatgaagccgcttttcccgccgaacgagaaaatcatcatggtaaaaggcatttgctggattcaagctccgaataccctgatgacgaatttcagtaaagtatggcgactgctgagaatttaaattaagttcatcaaggtccccactttgcgttgaaagcagccatactaaaattttagcttttaacaactgaacaagcttcgattcttcaatcacacttaaggaatgaacaaaacgtgcaatatcaatataatgagcgtttcctttgataatcacactattcattttaaaaggcaacaccttatttaactgtgcgattgatgtatcaataatttgttgctggaggatattagttgctgtgctgacgacaatcttcttatcaagatatgcaacataacttagcggaaaaagatagcccaatgtcttccctactccagttccagcctcgacaatcatattttggggttcagcatgagtataattattgtaaatgctgttcatcattttggcttgaacaggccgcaatctcaacgtatctccgtatagcttttcctttgcctttttagtggaaggatatttatgcttttctcgctgaccattagcagtaatcggccgcgatttatgaagaacaattccgtgagagacatacaactcttcgcttaatggctggggcgatttacgtcgacgctgcaattcagcatcaaaaaccccggctgtttgctgaggtaggttgagcttcaactgagtaatcttttcaagcataagcgttggtaattcttgaactcgttttaacaagtcattaagtaagtctgcagttgcctcagcgtctgatactgcactatgagggtgatcatgctcaatatgcaacgaactagttaagtctcgtaaacggaaactctttgcagtaggaagaagaatctgactaagggttacagtatcgattgcaggaattgataatgagggatatccagctcgctctaattctgcatttaggaaaggaaagtcaaaattaacattgtgagccacaaaggtcgtttccgccaacaaactataaatagttccagcaatgtcctcaaacaaaggtgcttttcgtacgtctttatcttcaattcctgttaattgaacaattgaacgaggaattttctctcgtggatttatttttgtttcaaagtgattcatgatttcgccatcttgaacgagaacacaaccgatttgaatgattcgatcaccatgattaacattcgttccggttgtttctaaatcaacaactgagtagattggcgctttcttgtcacgcttttttgtgcgctgactactacgctgtgtcacactatcaccatatttctccgaagttattatattaagttactaaatattctaaactaaatgatacaccattctactataaatttctcatttttacacgaatcggcttttctttgtgctaaaatgtttagatttggtaacatccacaatcgcttttagctagaatcactgttttatgctatgattaagtttgaatttttatatagaaagtaggttacgatggtgaaacaacaagggattggtactagccatgcgaaaatcattttaatgggagaacatagcgtagtatacggtcaaccggcaatagccttaccattgccaagcgttcaattatcagttacgctcagcagtcgccaagataaccagcgaattattaaaagccgttattatcatggtagtctaggaaatttaccttcctccatgatcggaattaaaaaattaattgacactttatctgcaaggtttaatgaccacgaaactggttgggacttaaaaattgaaagtcaattacctgctgaacgaggaatggggtcgtctgccgccagtgcgattgcaattattcgagcattctttgattattatgatgaaccactcgatcgaacattattgcttcagcttgcagatgtcgaagaacaaattacacatcgtagtccatccggtttagacgctgctactgtcagttcagataaaccgcttttttatgttaaggggcggattggggtaccaattgaaatgaaccttgatgcctctttagtaattgctgatactggaaaaaaaggtgctactaaggaagctattttggcagttaaagatgaactgaaaaataacaatgaaaaagctgaaggacatattaagcatctcggtgaattagtaaaccaaacaaaagactatcttacacaaaatgacattgtaaaattaggcgatgctcttaactttgcgcaaactgatttagctgctctcaacgtgtcagaccatcattagatcaccttattcatgttgcacgtgataatggagctcttggtgcaaaattaactggtggtggtcgtggcggttgtatgatcgccttaatgcaaacagctatgggagctcgccgccttgcaagtatcctaaaagagaacggggcacatgatatttggcttcaaccacttgataagcgaggtaataactaatggcaactgcaaaagcacatactaatattgcgcttgttaaatattggggaaagaagaatcaagaattaatcattccacaaactgacagtctctcccttacgcttaatgagttttacaccactactaccgtaaattttgataatcaccttacttcagacttagttgccatcgatcaacaaacacttagtaagaaaggggccaaaaaagtagttcatgttctagatattgttcggcaactaagtggaataaaagcttttgcacgcgtaaagtcaattaatcatgttccaactgcagccggccttgcttcctcagcttccgcatttgctgccttagcaggcgctgctagtactgcggccggattaaatctctcaagccgtgatctatcacgacttgcccgacgtggatccggttcggcaactagatctatttatggcggattggttgaatggcaaaaaggaactgatgatgcatcctcgtttgcacaaccagttttagaaaatgttgactttccaatcgaaatgttagcagttttagttgatacaaaaaggaaaaaaatttccagtcgatctggaatgcaatccagtgttgaaacttcaccctactatgatgcttggcgccaagtagtagcgaatgatatggttgccataaagaaagctatcaaagcaaaagatattgaccaaatcggccatattgctgaagaaaatgctcttcggatgcacgcacttactttttcagctgaccctggttttacctactttaatggtgaaacgttaaccatcattaaagcagtggaagacttgcgcaatcagggaataaactgctattatacaatggatgccggtccgaacgtcaaagtgatttacgaccgagaaaaccggagcaaaattgttgaaaaattaagtaatattgttggcccagaacggttggtggtttcacaaccgggacctggaataaagatttggaatgaataaaatttaatgataaggggactttaaattttgattactgaaaaagctcccggtaaattgtatattgccggcgaatatgctgttgttgaaaatggttatcctgcagttttagttgcgttagatcaatttgttacctgtacaatcgaggaaagcactcaagaagttggtcaaattattagtcgccaatataataacgatcaattatcctggcgacgtttaggagaccaaatggtagttgacaaacgtgataatcctttttcttacattctttctgctattagagttacagaagaatatgctcgtacttttagtcgcgacttacgaatatttaatatccatattgacagtcaattagacagtgctaatggtcgaaaatatggtcttggttcctctgccgctgttactgtagcaactgttaaggctctttgtcggttctataatttgcccgttaacaaggaccaaatctttaaattagctgcaattgcccattttgaagttcaaggaaatggttcgttgggtgatgttgccgcttccgtatatggtggttggatttcctatcattcattcgatcggcagtggcttgcccaacaacgtaagtatcttgacctaaagacgatcattgatttaccttggcctgatctgaatattgagtctctaactgctcccaaaaacttagaacttttaattggctggactggtaaaccagcctcaacttcccaacttgttgataaaatttctctttttaaagctcgtcgtcaaactgaatatcatcattttcttgaaaaaagtaaatcatgtatccaacgaatggttgatggttttcaccgtcaagatcttgaagcgattaaaaatgaaattcgttataaccgtgacctcttaaaacaactcggcactaattcgggggtaaacatcgaaaccgaatcattatctaagctttgccaaatcgctgaatcttttggtggggctgctaagacatctggtgctggtggcggtgattgtgggatcgtcgctattgatagcaactctaactttgggaacgttctaaagagctgggccaaaaaccgcatcgaacaacttcctttatccgtacactttatcgataacgcaaaaagcttcaagaaatctgttaagcaccatctttcttacattcacaagtagatcaaaggaggctccatgatggaatcacgtcatgcccaacgaaaaaacgaacacctttcattagctgccaaatattatgaccaggttcatcaacatcattattttgatcaagtgcgtctaattcatgatagcttacctgaaatgacaacagatgatgttgatttgcatgtccagttagctgataatttagaaattgaatgtcctttttatattgaggcaatgactggcggaagtgatcaagcacttaaagtcaaccaacaacttgctcaattagctcataaacaccatttagcaatggcaactggatctctcagtattatttcaaaagacccccaatccttttcgtcttttgaaataattcgcgaagaaaatccaaagggcattatttttgcaaatttaagtgcaaatgccagtcttgaccaagcgataaatgctatttcacttttgaaggcaaatgcccttgaactgcatatcaatgcggcccaagaattaattatgcctgaaggtgatcgcgattttaattggttggataacatccaataccttgtcagtgaactagaagtcccagttattgtaaaagaggttggctttggaatgagcaaaacgacgattgccaaactgcaaacccatgacgttcacctcatcaatgttagtggtcgtggtgggacaaactttgcagcgattgagaatcggcgtaaccatgatattaattttgagagtttattggactggggacaaacaactcccgaatcactattggaagctcattcaattcggcgcggtaaaactgaaattattgcctctggcggaattacttctcccctcgatgttatcaaggccggtgtattaggcgcccgggcagttggtgttgccggttacttcctcaatattcttcaaaatgaaggctatgaagcattagaccaaacgctcggtgaatggcaagtgattgtcaaacgcttgctcgcgctccttggttgctcatcatttaccgagctttcacgtgttgaatatgttttaggaacagacttactatcatatgctcgtcaacgacacttacgctaacctaaataattgaaattcctattaagattgatacaattgatttaataactaaaggtttggatggtgattgaagtgaataaaattaattggggcaaatcaattacagttggtataacggctggtcttgttgccggccttgttaaacttggttgggaaaatattctcccaccacggacaccagagcgagatcaaacaaacccaccacaaaaaatgcttgagcaatttggcgttccaacacagattacacatgctacttatacctattccggccaacagttgccatgggtaagctatgttgttcactttagtttctcagctggttttggagttctctatagtatcggtggacagttagcgccgtggatcaaaaaaggcgatggaataccattcgggattgctgtttgggatttcttccacctcaagttaatgccattaatgggaacagtgcctgctgcaaaagatcaaccacttgaagaacatgtttctgaatttttaggacatgcaatctggatgtggacgattgatgcattaataaaaagtaaaaaataataaaagaggctgggaaaaaactcctagtccaaaatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactgtgtgcagttcgccagtagcccttgcgggtactagcgaagacatatgcatcacgctgggacagccccagcttctgtaagttagttaccttagttttaagcttcttccattgcttccagatatactgtcttattcgggccctcaaccacttgtcaaggcgttgaataaagtcagttagtttcccaattgagtagtactgaagccatccacgcatttttcgatgaatttcttcaaacattcttgtcagggatattccacgattacgtttagttaataacctcaatgctttctttactcgttgttgcgattgttttgctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttatccaactcatttagatagatattcgccagtattggtgacaatggccctccttgtggggttcctttttcactcttagcgaaaagcccatggtctaagactccgctagttagaaacttacgaatgagccttagtgtccatgggtcatcaatatattgttgaagatacttaatcatcaagtcatgattaacattatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaattccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcgcagtggacacccttgtcctcagctcatggttccgactactacggcccatagcggactctcaccgcctagctaatacccatgccgggcgcacataaaaaccggatgatgaattttttgaacaattcatcatccggtttttatgtacacaggaaatcgttcctgatatgatgtaattacccctaaaaacaaccaaagggagcgatttccatgtatcaaaattataccataggacaaaccgaattcgtactaaactataactatgatttaccacaaaatcatattgcgcggctaattagtgattttgtcgactcgattccacaaaatgtgctattagaagattcaggagcggctaccggccgcccttcatcgcatccagcaattatgcttaagattctcttgtttgcctactcacgtcaaacttattctggaagaaagattgaaatgatgttggataagaacctgccaatgcgttggttagcccatgattatacttatagctaccataccatcaataactttcgacgcagtcagcacgctagtaagctaattaaacatgcctttgtctactttaccatggctttgaaagatcacggactaattcaaaatgatgcagtttttatcgatgggaccaaggtagaagccgatgccaataaatattcatttacttggcggcgggcggttgaaaagtatcacgctaagttaagagaaaagacgagtaagctttatggggaactagtagaaaaacaagtggtgcaagaaatggcacccgagctggttacttctgccgaaggcatggaagtaatgaaacaagagcttgcggagaaaatcattaagttagatgaagagattaagcaagaaccaaaaatcatcaaaggtggttcagttagaaaacggcgccgtcgttttctaaaaaacttcgccatcaattaagcaacgacctaattccgcgtgccaaaaagtatgaacgtaccgaagatatcttccaaggtcgtaatagctatttcaagactgatcatgatgcgacttttatgtgtatgaaggaagatccgatgatgaatcgggagttgaagcccggctataacctgcaaatcgctacacataagcaatttgtccttgattacgggctcttttcaaatccaactgacaccaggaccttagtgccatttcttacccagtttcatgctttagatttctttaagcatatcgttgccgatgccggttatggtagtgagtacaattacacaatgattcttgatcagtttgaaaagcagcctgttattccatacacaacttatcaaaaggaacagaaacataaatttaaaaacgatccaactaaatcacaaaattggcagtataatgccgaagatgattactacatcgatcatttaggagttcgctttagcttttatcgttatagtaggcgaaccgataaatatggtttcgaacgtgatttcaaactctatcgagcggataagcaccaactgtcagaacaattggatgagttggcaaaaacaccaagtggtcggcaacactatatgcaggttaacccaacgtggaattattacaaggctaaagtaaaagcaaccctctcaagtgacgaaggcaagacaatttatcgtcgacagaagttcgacgttgagccagtctttgatcacatgaagagggattttggcatatgccgaactcatctacgcggacaacgagctgtggaaaatgacattgggctagccctggtggcattaaatctaacgaaattgggacaatcaattagtcgattggcgactaatttcataaataatttaaaatccgaactacgatttttggatcgatcaaaaatcatagtccggattttactgttagagaaccaagaattaatagttaattcccagcctcttttattattttaaattatttacctttaaagtaatgcacttcggaagtgaagtcccccgtacgagtcgggtcacggaacaaaccgacattcatcaattcatctccaccataagtcttatcagtcatttcatcatgataatcaattgttggatcaagccctgccatcttggtattattaatttcaaaacggttagtatgcaactgcttaaacataaatagcagtgcttctgacttatccggactgataaattcccaggcgactgtattgctatcaaaaggactttctaagcgaataaagtcaccatattgaattaagtggcggtgagccttataaaacttgatctgttcctttaccatttgccgatcctcttcagtcaaatctgctaagtcaagttcatatccaaagaccccactcatggcaacatcgccccgcatctcaaaactggtagaacggccagtttgctggttaggtgaaaccgatacatgcgccgtcatagatgagattggataagttaaagatgttccgtattgaatctttaaccgttcaaccgcgtctgtatcatctgatggccaactttgcggcatgtagtaaagaataccagcatcaaagcggccaccaccgccagaacagccttcaaacaagatattaggataacgggtaactaaccgctccattaagtcatataaacctaaaacataacggtggctaacttctccttgatgttctgcatccgctgcgctagagaagacctcagtaagattacggttgaagtcccatttaatatagtcaagtggcaccttatctaaaattaagcacatttgattgtaaatattatcaacgacttctttacggctaaagtctagcactaattgattacgagaaagtgtcattccacggtttggttcatgtaaggcatagtctggatgttccttatataacttagagtcaactgaaatcatttctggctcaaaccagagaccaaatttcatgcaatgctcgtgggtccggtctgctacccgctttaatccaccagtaagcttatcctggttaacaaaccaatcaccaagcgatgaattatcatcattccggtggccaaaccagccgtcatcaagaacaaacatttcaattcccaatggctttgcttcatcaataatttggtctaacttcttatcatcaaagtcaaagaaggtcgcttcccagttattaataacaattggtcggtctgcatattgatacttaccgcgagcaacccggtctcgtaataacttatggaatacttgtgacatcccatttaagccacgctgactaaagcccatgattgcttcaggtgtctgaaaatcttttcccggttcaagaacccattcaaagttataatcattaattccagttattaagcgaatctggtcgatctgatctttttccaaggtaaactggtgattacctgagtagacaaggagcactcccaaagcatttccctgaaattcatcggtgttcttgtcaaccaaggccacaaacggattcatatgatgagaactagaatttcgacggctagaaaattctgttattccccgacgtaattcttgccgttcaggttgccgttcaagagcatattgtcctggaacggagataacgtcataatcatgtttagttaaatccagttgcattgaggcaatcttttcaattcgtaattcttgattgcttgtgtttactaaccgcgcattccgtgtaataaccggccgttcgttatagatggtgtatgaaagaataagttgtgcaccgattgttttatcaaccaaagtaacttccaatgtttctgcttctttatcacttttaacataagatgcaggtaatccagctagtttgggcttccccggtaaaatcttataagacttgtaacggaaatcagtcagtcgtgaaccattttttgttttgataataattgcaggcacacgatagtctccggtattgtttcccgaatactcctgcaacaaatcatctttagagtaagttcggtccatcgatccaggaaggttccctgaaaatccacgatcaactcgtggatatcggcgttcaccatggtagttacgaattgccggtccaaaataaaggtgactgaggatatttccctcttctattgaaaataaataggaaatttctttattttttaagtgaaaaacacgttgttgttcatcaaatgtaatcattcgttgtggcccctttcttgaaatcgattctataataaacgtttagttatttctcgtcaagcgctttcattattgatatgccagcaatcatccgtcaatattggctactaaacgtttactaaaaatatgttatgctagaaattgattaaaaggaggttttcctatgactggtatcagaaaaatagcacgtgaggctggtgtatctcctgccagcgtttcacgtgtcttaagcaatgattcatctttttcagtaggtgaacaaacaagagcacgaattaaaaaagtagcagcaaagtataattaccatccccacctaaacaggaccgttactccgccgccaactcctcgttcaattctagtgcttacaactcattcgctcgagacagaagctcatgacccttatttcattcaagtccatgatggaattattcaggaagcttccaagcaaaacattcaaatcaaagcttttgttcgttttcccaataaagcctttcaatttactgacgctcaaaaatatgatggcgtaattgttgccggagtttttacgcaagaattctacgctaatttagctaaaaacaatccccatatcgttttaattgacgactatcgatatctccccgcttacgatattatccgtaattcgtattttgaagccactcagatcgttcttgatcagttactagaaaatggacttaataaaatcgcctttatcggtggaaatattcatcccatgaataataatggcgaaacgacagactcgtatcaagatattcgagctaaggcctatttgatgtggacaagacttcataatatttctccattgattgtccttaatgggtggactcctaaagatggctttgacagcatgaatactcttttgaaagataattttcaggccgccttaatagctagtgaccaactaactatcggcgcatatcgagccctgaagcaacaccagcttaaagttccccaagaccttcaaattattagctataatgattcggatattgctgaatatttagttccgtccctttcatcgatcaatccagcgagtttttcaatggggacaatagcagttcaaagactagtccaccgtctgaataatccaaatgaaatccctattcatattaatttgcctgccaaagccacttggcgcgaaagttcagaaattaatttgaattagtgaaacgttttataagtaaaaagagagtaattgtgcttgtgataccgttttctaaggtttatactcaaacatggttatcagattgataaacgttcactttaattaaatgaggtttttgattatgttattaggaagtattgaagctggcggtactaagtttgtctgtgctgtcggtgacgaaaattttaatgaaattgataaaaaaatcatccctacaaccacccccgaagaaactttaggggcttcaattgaattttttaagcagtaccctgaactagctgcactttcaattgccagttttggaccaattgatactaatccggctagtgaaaagtacggttatattactgatactcctaaagttaagtggcaaaattgcaattttgtcggcacaatgactgaagccctcaatattcccgtctactggacaacggacgtcaatggttcggtttacggtgaatatgtcaatttaaaagataagtatgataatccggccttggtttactatacccttggaactggcgtgggtgctggagcaattcaaaatggccgctttattggtggaattagtacccctgaaatgggccatgttcgcttacaacgccacccagctgatctaaactttactggtatctgcccttaccaccacgattgcttggaaggattggtagctggaccaactttcaaggcgcggctcggtattagcggcgaagatgttcctgataatcaccctgtttgggatatcatggcctattacgttgcacaagcggcagttcaggtaactgccattttgcggccacaaaaaattatcttcggtggaagtgtttcgcgcccagcctttcttgaacgggttcggaagcaatttgcaatgttatggaatgactatcttccagttggatcgctcgatgaatatattgtcaacccttctgttccaggaaatggctctgctactctcggtaattttgcattggctaaacacttaatcgaaacaaataaataaccatcatcggtcactataatgcaaaaatgactaagactgaggaaaatattgctcctcaatcttagtcatttttatttatttccaaagatagttcaatagacccgctttagtcattccattggctgtcgtttcacgcaaaactgatgctgaattaattaaagcctcttgttcacgcgaatctaatggtaattctactaccctttgaataccatctttatcaattacagccggtgtcccgaggtaaatatccttttctccatattcaccatctaaatatgcacttacgggtaatactgtactttggtcatacaaaattgcttttgttattcttgccaaagcagtcgctactccataatatgttgcgcctttccggccaataatctcataagccttattacgtacttgttcttctagttttaacaattcttgctttgttagcccattagctaaaacataatccattaaaggcgttccaccgattgtcccacaagaataagcagcaaattctgaatcaccgtactctgctaacatatcaacatgaacatctcggggatcaattgctaaccttttaccaagtgctactcttaagcgtgccgaatcaagagaggttcctgatccaattactttatgtgctggaaaaccagaaattttttgaacagcatatgtcaagatatcgactgggttggcagcaattaagaagattccattaaacccggtattaactacttcttgaacgatttccttcataatctttaagttacgttcaactaatttaagccgtatttcacctggcttttgcacagcacctgcacaaatagtaacaatatcagcgtctttacaatcttgatagctaccagccttaacctttactggggcagtaaatggcgttgtgtcttccaaatccagtgcatccccaacgcttcgctcattactcttatttataataactaattcctcagctaaaccttgctggatcacgctaaaagcataagcggaccccacaactccatcaccaattaaaacaaccttttgatgttcttctgtcgccatactcctttttctctccctaattaaaatttacataaaaagatgagcataaataggaaccaaaatgtccattgctaacgaaacgataacaactgccactgcggccattgctccctgaattgaccctagttgaaccgccttagcagatccaacagtgtgaccagcggatccaagaccaagaccagttccgaccttagaaattttctttagtctaaagaccttaatcaggaattcggcaaggcaatatatttaactaaatcccatcccgttggactgaatagcaagataaaaagcatctgaatactttccatcaaaatccccacaataaaaccatgccacggcgtcattaccttaaaataactttttcgatcatgatacaaaaaaccagaaagcgcaccaatcaaaactgagctgggcacataaaaccaaccttgcaggggtgcacttgaataatccgatggacccccgctactaatcctactaaactaccaacccatggcccaccaataattccagcaactgaaacagccaaaattcggacattgacaatcgagtcatttgttgaaatggccgtaagaataattttattatgcaactggttattcgcatcgatctctattccagtcatattagctataatagcaaaaatagaaaaaagaatcgttagctgaattttggcactaatggtttgattaaataacaggcggcgaaataggggtacactaaccagcaaaaacgctagaataataattaaaccaacacgctcagacattaaaattgttaaatatatcatttatccttgtgtccctgtatttattactggttgcgttccccgttcactaataattgctaccatgatattattgataatttgcaaacgttgctcatctgttaaatcaaggttggcttccttgcttaggcgttcaatcgcttcttcagtaattgaaacagccccctcaacgattatcttgcgcgctgataggattgctgatgactgttgtttttgcagcatggcgctcgctatttcagttgcgtaggctaagtgcgttaaccgtgtttcaataattttgacccccgcgacatttaaccgttcttgcagttcagcagttaaacgctctgacacttcggtgggatttccgcgaagagtaattgcatcttgatcttcaaaactatcatagggatattcactagcaacatgacgaaccgcagactcactttgaatttgaacaaattgctcataatcatcaaccgaaaagagtgcttttgcggtatcgacaactttgtagacaataacggccgcaatttcgactggattacctttcgaatcattgacctttaaaatttgactattaaaattgcagacacgaagagaaacagtctccttatttgtaaatggtaccgtcataaataagcccgcatcacgaatagtcccaatataattaccaaaaaaagttaaaactttagcttcatttggctgaataattgtcaatgatgtactaaaaagaatcacaattaagaataaaataattccaattgtcaggactaccggaaaattacgcgtaaagccaacaaacatcagccacaaactaattaaaccgataataatcgccccgagtaacccgaggtagccgttaacgtgaaaggctgttttttctttcatctcgataatcctcctaatttaaaaacgtaaccccttgggataaaagtttttgattgttttaccgaccaactttccaaaaccagcagtatgtttgtcgcatactagtaaataccaaccattcggaaggtcagcatcaatattaattacatccccatggacatattggtgccactgttctctgtttaggtcaatgacccgttttgcctcctgtggtaagctagcaagggcccatgccaacgctggttcaaatcgatttttcttaaaagtaccgaggtgaagtccaggccgaagtacatttagtccctcgatcttgtcctcttctaatggcaaatcatagagctggtcaccaaataaaatcaattggtgtggttgatagtctggaaaaacgcttgtagcaaactggttaaagagtttgatctgttctttgtccggtttaacaatcgattgctttttccgcttattcttctttttgcgcttttcattagttgactctggcttaccatttactaacttagcaatgaaatgtccttcccccttgagatggtgcgggaataatcggactgtctttttcaactcttcattgccatcagcccattctggacgaccatcatccatccccactgccttttcaatcgggacgagttttaaatccggataatcaccaagcaaccatgaaatagtttgttcatcctcttctggtgcaaaagtacaggtcgaatagactaatgttcctcctggctttagcattttcattgcggatgctaggatcttctgctgacggttagcacactcagcagggtattctggtgaccaatattcaattccggcaggctcttttctaaacattccttctcccgaacaaggcgcgtcaacaagaatccggtcaaaatattgaggaaattgtttttctaaatctgcgggactctcactagtaacaactgcattttttgctccccatcgttccaggttttcagccaaaattttcgcccgtttagggaaaatttcattagcaactaatagtccctggttgttcattttagcgatgaggtgtgttgttttacctcccggagctgcacacaagtctagcactcgttctccagcttgtggattaaccacttctcctacaaacattgctgacggctcttgactatatacccatccagtaacatggtctaatgattttccattcacttgaccataatatcctgtcggcacatacggtacttttcccgtggctttttcaattgttgcaaccggctgtccgttctttaatggattctcgcgaaaaccactataacttgactgagcaagtgctgataaaaactcatcggcctctgctcccattagttttttgtatttcgtgacaaattcatttggtaattgcacgttatttttcgctcctctttactgtaatatctttattgtaacgtattttttagtctttttaagtcaaaatacttggcaaagcgttaagtttttgtttacaatattataattgaattttttatggaaagagaagtgagatagtaatggatcaacacttgattgcgcttgatcttgatggcacaacattaaataatcaatcgaaattaacaaacgagacaattataactttacgtgcccttgcccgggatggacatattgtcagcatcatcactggccgtccttaccgaattgccaaacatatttacgatgaaattgggattaaaactccgatggtaaactttaatggggccctaacgcatatacctcatgaacactgggataaagaatatgatgttgaattaacacgggagctagccctcgatcttctagcccaccggaaagaactaggaattaaaacaattaccgttgaaaataaacatcatgtatgggctaatcaagctagtaatgatttacccgaattcttaccgaacaagttgcgcgatgatcaaatcctaaccgcgactaacttaacaggcaatccaatcgcaatgacgatccaatatgaaccagaacaccaagaagaaatcattaaagcagttaatgaaaaatacggcgattttgttgaaccacgagtatggggtggcccttacaacatcttagaactgatccatcgtggcactcataaggagtcaggaatgttttatatcgctaagcagtaccaaattaaccggcaaaatattattgcttttggtgacgagcataatgatttagaaatgcttgatgcagctggacgtggcgttgcaatgcataatgccatttctgagcttaaaagtattgctaatgatgtgaccccaattgataacgagcataacgggctggcgaaatacttgcaagcttatttcaaagttacaatataaaaagctaggaagagatagtttaaaactaccaattcctagctttttacatagttattcctagtcaactagtttgccaacaacagggataccttcaaggactgattccagatggatagaacgaggcattactgaagttaaatcacgaccagcaaggtttccatggtgtttaccatccttccattgcggaacgttagagacatcgtaaacaacgcctttaacggcaacgtatgcaggatgtccatttcgaccatcgaactcagcgagttcggttgttgtaaatgttttttctgccatcaatgcttcacctttctctgattcaagaatagctaataattatattctagatcaaacaatccgtaaatgcattaattattagatgattattattttttcttcaatcaacttaataaaattgttaaaattggctttttgattgctcttcttgccttttccactcttttcataaaataatttatagataaaaagataatctttattacattaggacaaaaaattggtataataaaaggtgaaggtgattctgcaatcactttcgccaacatacttctactgtggatcattgatgttgtcatgtcatcaatgatcctcttttattttacagcattagttttattctgcaataaattttcacaattattccagccgtttattgaaactatttcagcaagtgtgaaaaataacttttggatcttgataattattagcaaaaagaagatactgaagaagagataactttaagaatgaaagcaggtttattgatgtatagagtacttgtggcggataattatcccatcattcgaatggcagttaaaaatctggttgaacaactagataattttaaagtaattgctgaagaaacaaccggaatagatgcctcattacgggttgaacaaggtgacattgatatcattattatggatttagcgataccacctggtgaaaatggtctgatcacaatcaaaagaattcatgaacatttccctaacaccaaaattattattttttcttctcgtaatgaacctcaatacatcaatcaggcaatttataatggcgcaaatagctatatctttaaaagctcctctccaaaagaactagttcatgccctaagacacgctattaatggtgaaaaatacttagacaataatattatggtaacgaagaaagatttattagttatcaaaggcggttctccgcacttcgatttaggaaattacgttgctctttcgaaacgtgagcaagaaatcttaccgttaatcgttctcggatatactaacaaagaaattgctactaagatgtttatatcccctaaaactgttgaagcccataagacaaagattatgcaaaaattaaaccttgcttcacacgcagaacttctccactatgcagttaaacatcaattagtagacctatagataatgggagtggaaaataatcttctcgacaaggcggtaggctaaggatagaacggtgattagcacggcacgggctgattatcgttcgtacttagcctcgagtcttatgattacgacgcggagctagcctatttggcttccacgttatcttactattgttcgcgaaaatcattgaggctgagagaaaacaaagttttctcccagcctcattattttcatttattactaattgtcttatcaaaattatttaaaagagcagctacttgaacttcaacaacattatttttattgaaccgcgcaaatacttctgcttcagttaaaagttgacgtatttttttcgagttttctcctaactcaattgtattatttgcttctagtaatttgattcgtggtaagaaataagtaacgtggttgctagcacagatctttgtcgtagcctccaacacttggttactaacttccaaccgcttgtttaatgaatgatactcggcagcgtagtacatcatcgttacaatccgtagataatagttccgatcaacacccgctaagtcttcatcagcctttgatcttaagaatgcaataacctttgagaaaaagaaatcagcatgttccattgaattttgtcgtgcatataagatccctgatcctaaatatgctaatggtgaaaagatcgtccgatgttgctcatccagttcatctaaaatcttagtaaagttaaaaagacttgtcgacgcgttattattagttaaagtgtaaatcatcccttttaaataataatattgcatccggtcttgtggcgattttaaatcttcaagccgaatcttcttaaggttactaactgcctgtggaaagtgttcaatcattaaagctaattcaatttggtctagcagactccggatataacgaattgaagacgtattatccttacttaaatcatcaatcgttaatcctagccgctcacaaagctgcgccaaaatcgtgagtgatggtacttgaccattgctttcaaacttgcttaaggtcgactgggtacaaatccccttgcttaaggcaacttgtgagtagccgagtctttttcgttgataaacaaagcgtttaatatccatgtctgacctcctatatctaaccgtgaattcctaatgcaattttagcaaacctactcattcttgacaaatcccagacaggttcccacacaaggttaatattacatttagttacaccttcaacagaagtaactgccttggtaatgtcgcgatttaagatgtcgcctaatggacagcccattgtcgttaaagtcattgtaaccgtacattcaccattattatcaactttaacatcataaataaggccaaggttaacgaggtcaattcccagttctgggtcaataacttcttccaacgcatccatcactttattttcaattggggaaaagggagtatccttttcgtcagccataagcgttcctccaaacttatttgttaattcaattaaccaattgaaccttccatctcaaaactgatcaaacggttcaattcaactgcatattccatcggtaattgtttcgtaaatggttccacaaagcccataataatcatttcagttgcctttgcttctgaaattcccctgctcataaggtagtaaagctgttcttcagagatcttagatacttttgcctcatgttccattgcgacatgagcattgtcaatttcattatatgggatcgtatctgaggatgattggtcatccataatgatcgtatcacattcaacgtgggctttagagccatcagagtgcttaccaaagcggaccgttccgcggtaatcagttgagccccccgtcttagcaatcgacttcgaaacaattgaactagatgtgtttttagcattgtggatcattcgggctcccgaatcttggtggattccgttgctggcaactgcgatggaaagcatggttccccgtgccccctcaccattaaggtagacgcttgggtacttcatcgtgacttttgagccaaggttcccatcgacccattccatggttgcgttttctgctgctgctgcccgttttgtttctagactataaacattatcagaccagttctgaatagttgtgtaacgacaataagcatccttgcagacgttaacttcaacaacggcagcatggagactatcagaagagtaattgggagcagtacatccttcaacataatcaacacttgccccttcatcaacaataatcaaggttcgctcaaattgtcctgagttttccgcattaagccggaagtaagattgaattggcgtctttgtcttaacgcccattggtacataaataaatgaaccgcccgaccatactgctgcatttagggctgcaaatttattatcagttggttgaactaatttaccaaaccatttcttaaataattctggatattcttttaaggctgtatctgtatcagtaaaaataatccccagcttttcaaactcatttttcatgttgtgataaacaacttcagattcatactgagctgaagaaccagcaaggtattttcgctctgcttccggaactcctaagcgatcaaaagtccgttttaaatcttcgggcacatcatcccagtcgcgaaactttttatccgtcatcttttggtagtaaagcatgttcttcaggtctaattctgataaatctggaccaaattttggcatcggtaattctttataaatcttgtaggctttaagccggtaatctagcatccatttaggttcatgcttagcagctgaaattttgcggacagtttcttctgttaaccctctcccagttgagtattccggctcaacgttatcgtgaaagccgtattcgtactggtcattattatttataatgctagctgcatcattactcattattttcttcctcctcgctatccttcaacagtgctcgttgtaatgcccaccatgagagcgtggcacactttattcgggctggaaattccataatactagtaagaatccgggcatcccctagttgatccaagtcagcttctgaatgttctttgccaattgccatatcagaaaaagtctttgccatcgcaagggcttcttcagttgtttttcctttaacagcatcggtcatcatgcttgctgatgcttgactaatagtacagccatcaccagtataggcaatatttttgatcttgttatcttctacttcgacttgaagattaatcgtatctccacaagtcggattatgaagggtcattgcattcgtagtagttgctaattctcccttattatgtggatgatcggcatggtcgagaatcacttcacggtataaaccacttaacttagatagtcccaatgttaaagaactcctttgtttccttgattgcgttaattaattgatcagcatcttctttagtattgtaaaaataaaaactggcacgagcggttgctgttactcccaagtcttccatgagtggctgcgcacaatggtgaccagcacggactgctaccccatccatatcaagggccgtggcaacatcatggggatggagacctttgatgttaaaggaaattaccccagtatgttttgctggcgattgcggaccataaacttcgacatctggaatagcaattaacttgggtaaaacataattaacaagttcctgttctttttgcacaatcctatccattccaataccatttaaataatcaatcgcggctccaagcccaactgccccggcaatattttgggttcccgcttcaaatttaaacgggatatcagcccatgtactctcattccggtgaacgtcattaatcatttctccaccgtattggtaaggagacatcgctcgtaataagttctcttttccgtacaaaaccccaattcccattggactcatcatcttatgaccagagaaagcgtaaaagtcaacatcaagatcttgtacatcgactggcatatggggaactgcttgtgctccatcaccaacaacgattgccccatgttggtgcgcaatcgttgctaattctttcaagggcgtcactgttcctaatacattactagcatgagctactgccacaatctttgtcttatcggtaattttctttttagcatctgcaagatcaagttcgccatctggagttaattcaatatatttcagggtagcacccttttccttagctaattgttgccaaggaataaggttactatggtgttccattattgaaataacaatctcatcaccaggttgaatattttgttcgccataggttgcagcgacgagattcaacccatccgtacatccctttgtaaagataatctcattagcactcgacgcgttaataaacttttgcactttttttcgcgcttcttcataatccttagttgcacgttctgctagggtatgaacccctcgatgaacatttgcattatcttgttcataaaagttaataagtgcctgaattacctgacgtgggcgctgaacagtcgcagcattatcaaggtaggctaagcgttcatcattaactcgctgattaagtgctggaaagtcggctaaataatcattcgtattgttgtccatcggcgagcttcctttcaagaatcgtaattaacttatttcgtacatccactgctgggattgcactcaagactgctcctaggaatcctcgaataaccattcgttctgcttgtgcgcgcggaattccccgactcattaagtaatacatttgttgttgatcaactgggccaacactagccgcatgtcctgcctcaacatcattttcgtcaattaacagaattgggttagcatctcctcgtgcttgatcggacataatcaatacccggttttgttgatcagcctttgcaccatgagcaccatgaataatttgcccaattccattaaaaatcaattcagacttttcaagaataacacctcgctggtttatcaatccggtagtatgcttgccatgattagtaacgcggttgttgacgccaacttcttggtcacgagtagttacggcaatcatctttgagttagcataacccccatcacctagcaattcggaatccatatcaccaactgtggcaccatcgttcatcaagccgactgcccattcaacgtgcgcatccttgccaatatcggcacgccgcttaaagtaagtatgggtatggggaccaaattcatctaaggaagaaaaatcaatctcactattttcctgcgccattaattcaatcatcatattagcggcattttcatgatcaccaacagttgtaaggtgttggataaacttaatgcggctgccacgatcggcaattactagaatatgcgaaattagaggctcatcttgagtactgtcctgaataatctcagcctcaattggcttttcaatttcaacgttttttggaatatagaggaataaaccggcattaaggtaggcaagatgataagcagttaataggttttcttcggggttaatagcagtcatgaagtacttattgaaaagttcaggatattcgcgcgcagcagtaaagatatctgtgagaataaccccctgatcttgaagtttttgtggcaagttaacgtggagcaaagtttgcccaaactgagttaccttaattacttcatcatcggtgactggtttttcaactaagtcggcgtctgcttcaacccatttcaatggccgctccgcaataaggggccaagttcgaaaatcgaaccgttgcatccgtggcaaacgaagcttttccattaactcccgagcactaagccggcgatcaatcaattgctgaggttcattatttgctttactagcagcaattatttgttcttttgctgagtttaattctgtcatcaaactgcctcctagtcttcatcatctacaagtttgatatcaagacctaattcgtcacgtaagccagcgtaaccttcatcttcaagtttcttggcaagatcaggaccaccagttttaacaattcgaccacccatcattacgtgaactgtatcaggaacgatgtagttcaaaagacgttgatagtgggtaataattaatgaaccaaagttgtcgccccgcattgaattaacaccctttgaaaccaccttaagggcatcaatatcaagtccagagtcaatctcatcaagaatcgcaaaactaggttcaatcattaaaagctgcaaaatctcattccgcttcttttcaccaccagagaatccttcattaagataacgttcagtcatggattgactcatatcaagcaattccaggttcttatcgagtttcttaataaagtccattaccgaaatttgatcatcttcaggacgacgagcattgatcgcagcccgaagaaactcagcattagtaaccccttgaatttcagcgggatattgcattgcaagaaagagaccttttcgtgctcgttcatcgaccggcatatcaacaatactctccccatcaagaaggatatcgccttttgtaacatgatagttaggatgacccatgatggtttgagaaagagtagacttaccagttccatttggtcccataattgcatggatttctccagtcttcatcttaaggttaacccctttaaggatctccttttcttctttgctttcttcatctttaactgaaacgtgaagatcctttatttctagtgttgccataaaattcatcctcctgacccgaaatattccaaaatattctcggtaaatattccataaatatcaacaaattctttacattcttattatatccgaataataaaaaaataaaactattcatctcaatttattttaagcgttttctcgatgaataatttgagtgtataataaagatataatatagtgtttatataattttagaatatttgataaggcaggtggcgataatgattcaacaaaattatattcttcactcatttgactgtttaaatacagccactgccgcccgattacatgatatgggcttgtgtgaagggtgtccgattaaagtagttcaaaaatatccttttcatggcccagtgataatcgaaaatgatcaccaacgaattggtttgcggtacactgtttttacgatgcttacgggggcagaataaaatgacaacagttgcactgattggaaaccctaatactggtaaaactaccctgtttaactcgctcactgataaatacgcctatgtcggtaattggacaggagtcacagttgaaaagaaacaaggaacgcttaagggaacagatattattatcatcgatttacctggcgtatattcactcgatcctttgacaaaagacgaagcagtggtaactaactacttaatgcataaccaacctaatatggtcttaaatattacgaatgctagtcagttaaaacgaaaccttttgctaacaatcgaggtattggaactcggctatcctgttgtattggttcttaacatgattgatgatctccgtcgatcagggtacgactatgatcttgacctgcttgaaaaaaggctgggttgtaaagtaatgacaacaaatgcgcgtggacatcaagggattgatcaattacgaaaagaaactatcaattgtaattcgctccaccctacccaactagatttagattatccccgatgatcaagcaagcaatcaggcaggcaagtacagcgttggaaagtgattattcttttgcgccccaggttgcgcgttggttagcgattcaattcataagtaagaataaagtaattcgtaaatttgcccgggaaaaagagctaactccccttctttcgcaacaaaaatattatgacgcgcaaaagttcgctgaccaaatttttgaagtccggctacagtttattgaggacactctcaaccaggcccgtcatccacttaacaatggtgggcaagttgagataacaagtcgaatcgacaaaatcgttaccaacccgattcttggcttaccaattttcgtcctaattttctttgtaatgtttaagatgtcctttgattgggttggcaccccactttccgatatgcttgatcagtttatatcaggcccagtttcaactactaccgaccaaaccctcgctagtctaggggcaattcctgcattacggtcgttagtcgttaacggcattattgccggggttggtggagttttagcctttattccacaaatcttcatgctctttgcctgcatttccctgcttgaggactctggttatatggcgcgggcagcgttagtaacggaccgggttatgcagatgattggtttaaatggtaagtcttttattccattaattattggttttggttgtaacgttacgggaatcatggctgcgcgaacaattgaacagcctaaagaacgactgatcactaccttaatcatgccgtttatgagttgttcagcccgcctaccgatttatagcttattcgttgccgccttcttcccacgtcaccaagcactgattgttttatcagtctacttcttaggaattgtcgtggctttagcaatggcaaaattctatcaagtaatctttaaggtaaaagaaagctcagtgtttgtagttgaacttcctcactatcatcttccccgtcttgatataatttggcacggaacatgggataagggtaaaggatttattaaaaaggctgggacaattatttttgctggaactgttttaatctggatattatcaagttttggtcctagtggttttgttactaattcggctaatagttttgctgccgaccttggacacatccttgttccgatctttaagccaattggtattgaccagtggcagccaattagtgctttgtttacagggatccttgccaaagaggttattacttctagtatgatggtaatgttccatacaagcagtaaagcattcctcatcgcttcacttggtcagtttatgactccgctttctgcttatacgttattagtctttattctcttatatgcaccatgtttcgcaacgttagcaactatcaaacaagaaactggttctacaaagtggatgctttattctgttgcatccagtttagtcgttgcgtacgggcttgcatttattatctttcaggttggtcgattatttattgggtgatttaaaatgaaattaattattaacgttattattattgctgcaattattgcgttagccttttacctccttgttaagacttttcaacgaggcaagcaagggaaatgtgcagcttgtgactacgattgtgaaattaaaaagctggcaaagaataaaaagtaattataaaatatggagacgtgtggttagtttccacgttatcttgctattgttcgtgaaaacgaggctgagagaaaacaaaagttttctcccagcctcgtttttttactcattattcaatttttctcgtaacataaaccggcgaatcttaccactcgcgttttttggcaattctgaaacaaaaatatagtgttgaggaactttatatcgcgccagatgttcataaccataatttattagcttagttggagaaagacgacgatcactgacgacaaaggcaactggtacttggccccagacagaatcattttgaccaacgactgcaacttcattaatctgtgggtaacgttggtagatctgctcaacttcttggggaaaatattttctccaccagagatcaacatttcatctgcgcgaccatcgatatagagatatccttctttgtccaggtgaccgatatctcctgtccggtaccacccgtcaatcattttagaaggcaacttatcaggcaggttaagatagcccggagttaaagctggtgttttcagcagaatttcaccatctttactaagttttagttgggttgagaatagtggctgcccaactgatcctaattttaggagtgcatcagctgaccgtaatgcaacaatttgggaacatgtttccgtcattccatagcattgaacaacaggaattgaccgttgcaaacatgcttcgagcgtttctcgatcaatcgttccgcccccaagtaacatacaacgaaatgctgaattatagtgcgtattagtcttattttgctgctgaatgagctttttcagcataaaaggcacaaccgacataatggtgaccgtttcatttgctaaaattcgttcaagttcttcagcacggaacttctcaaccaagcgaacagtcatcccgtaaattaatccccgcataataatcgaaaaaccactaatatgaaagatcggcgctacacacaaccacttatctgcggatgataaacctaaattcaatgcagaagagactgctgaataaaaatggttgccaaaagtttgcaaaactcctttaggcctaccagtcgtcccagaagtatacataatgctggctacccagtttgatttaaatactggaattagctctcctggatcagcacttgttatcaagaacgcactgtaagacttaaaaggatccgtcatccctgatcgccagagagaattttcaaccaaacacaactgaagtccactatctttaatctgtcgttcaagctcttcaccagcaagccgcaagttcaaccagacaatcgtgcggccactacacatgatcgctagtgataatttatagctcatcagagtattagtagctaggatgcctacccgcgaaccaggattaagatggtcaatttttccaacaagtacctctacctgtttttttaattcagcaaatgataggcgttcattaccatcgtcaatcgcaatctggttcggctgagttgctgcttgctttaatagccagttttgtgtttccatttaaattgcctcttttatttatgggaatttagggaactggtcaaaattagggtcccgtttttcgttaaaggcatcccgcccttctttaccttcatcagtggtgtagaagagcatcgtcgcatcaccaccgagctgttggaggccagccagtccatcagtatcagcattcatggcagccttaataaaccgtaatgccgttggtgacttcttcaagatttcgttacaccagtccaaggtaaccgattcaacttggtctaatggcacaactttattaatccagttcatctggtaggcttcatcggcactatagaagtgatttaagaaccagacttcctttgcccgtttatgaccaattacgcgggcaagataaccagatccatagccagcatcaaaacttccgaccttaggaccagtttgaccaaatttagcattgtcagcagcaatcgttaaatcacaaacaagttgcaagatatttccgccaccaactgaccaaccttttaccatcgcaatgactggtttagggataatccggattaaatgctgcaaatcaaggacattgagacgggcaatcttatctggaccaacgtatccaccattaccacgaactccttggtcaccaccagatgagaaagccttatcaccagcaccagttaggataatcaccccaattgtgctatcatcacgacagatggtaaacgcgtcgatcatttcttgaattgtaacgggggtaaaggcgttcatcttttctggacgattcattgtaatttttgcaatctttcccgctcgttcaaaaataatttcagaataatctttaaccggttgccaatcaactgttgtcataactactctactccttttgtgaggtcaataataatgaacctattagaaaatttagatattcaaactcaatcagtcacagccaacaagtgcgttatcactgttaaagtaagtgataagctcaagcaaccttatggaatcgttcatggtggaataaattcagtcctcgctgaaaccgcagcttccttaggtgccaatcaatggttagctgatcgtcaacaagatcaaatagctctcggtgttaatattaccacagagcacctcattgcggtatcgaatggtaaattaagagcaattgcaattccgattaaacgtggccggcgaatccaaacctggcaagtcgatatccattgcaatgatcaatgtactagtaccagtatagttactttgatcaatcaaccccggtcttaatcttctgatcatttctttaattattattcgaaaataaaattatttagaattataaaaaatggttattcatctttactactatcttttctcgccttaacgttcgattaatcgttctgattatacaaattccgttattgttctaaaataagacatttgataaattaataccaacgcgaggcgaactgcgtgataaaattaaaccgttttatcttgcctgaattaaggaatgaatcccttcttttaggtcgtcagtttacctatttggggagaagaaaaataaataggacaaacactatgatgggaagcatgtcgcgtaaattatagttttaaaggagagcatttttgatatgcgcttcaatgaaaaagatgaagaaaagtaccttaagctgattaacaatacccgtcgcggaagcaataaagacttcgaagagttatttcgccgttattggccgctcgttcgccgactgtggcaacgatataatattagcggccttgaattggcagattgggaacaggaagcccgtgttgtgatgctagaagttattcgtttatacaataatcaaggtccgcgcatgtttagctgcttttttaaggaatgcttaactaaccggattcgtgatattcaacgacaaactcaggctcacaaacggatcccagcaggctgtctttacgcattaagcgatgattttgctgaaacacttaccgactttttacatcattcccctgatgacattatttattgccggcagagtcttgaccgtttactttgccgctgttctacatttgaacgaaaagtattagtttatctccatactggttattcgataactgagattgctggtacccttgattgctctaaacggagcgtccaaagtgccttgcatcgttgccacggcaagctattaaaagtattaatgaagtaaggacttataaagcaaaaataaggtgctgagagaaagctttttattttctcccaacaccttattttttatgctttcctaataaacaaacatgcaatcactgcaactaatgcactgataacaaggccgaagaaagcagctgaatatgagccggctgcttggacaatccacccaattaagagtggaccaacaaaaccaccgagttgcccaccaaagttaacaatcccaattgatgatccataagttttctccgataaaatctgtgcaatgaaactaaagataccggtaaatgccaatgatttaacgaaatagatcaagacatcaaagatcacaacgcctactaatgaagttgacttaaagagaccaaacatgaaaaccagagtcaggaatgaagcaatactaatcatcctccgttcatgcttcttaaacaaatgcaccatcacaaagccagaaataaatgctgcaatacctccagaaataactggcagtggtactaaccaggccaagttcttcaagttaattccctgttcttgcaagaaataaactggcatccaggtttcaagtcccttagtaatgatattcagcgcaagtccaattactacaaaggcccagacacggtggtcaatctttttccattcaatcttggaacgcgcctgcccattttcttggctgctattaattggccgttctaccaggtaataggtaagtaaaataataaacccaccaaccccaagcaaaacaaaggcatttcgccaaccactgctagcaataattggcacaataattagtggcgctactgctgccccggcataattcgatgaaattaaagcagaagttgcttgtgatttctcactcttatcataattttcagaaattcgttttaatgccgctgctggatatggcccttctgcaatcccaaacagaaaccgaatcgcaatcaaggcagcaagggaccacgcccagccagtcaccattgtcatcaacgaccaggcaaacaaggaaataattaccatcagtttactgccaaacttatcagttaagtatcctccaggtatctgcatcaaagtataccctaagaagaacgcactggcggttgcccctaacgctgccgccccaacatgaaagtctttaccgatgtaagcaagggaaatattcatcactgtgcggtcagcaaataaaatcatatatcctaaatatagtagcagaaaagatccccatcgttttgctactgtaaagttacctatattttccataaaattacccctttaatataaagatctttttattgtaattgatcattttagaacttaccacccaaatcctaagaatatccgctaaaattaagaacgtcactcttaatatttttttgttaaaatattagagatatcctaaaaaatgattgttaatccaaggaggaattatggatttctcatttaaaaaacgaccggtaaaaagactatatggtgaatatactattttattcatctttttagccttatgtattttcgggacatacttaattactggtcatacttttatccttagcaaagatgctctcaatcagcatttacctttactagcaaagtatcgagaagcactgattagcttcttccaccatcctcgcctaaacttctggtcatggcaaatggggctaggcagtgatacctttcaagtatattcttactatacgattggagacgttttctcttaccttgtactactttttcccgcagcaaagattaccctcgcctaccaggtaattaatattatccggatgtattgtgttggcctcgcttttgtctacttcgcgcaacactttaaatttcggaatagcgtcattttgatgggggcaacaacctacctggtcaattcgtttttactctatgcctgtatcgcccagccgttctttaccacgccatttattatctttcctttaatcgtggtccagattgaacggatattgcaagaaggctcgccctggccgcttgctggtgcctttacatggatgctagtaagcaactattaccttgcttacgttttaggaattggttcatttctctatcttgtccttcgcgtaggaacgcattatcgtcgcacgcttaattatgggaaagccttgcttaaacttgcctttgcgacaattactagtgtcctcttatccgcggtcttgctcgtcccagaaattatcgcggtcacaaattcaacccggactggatcattatttgctaatggtttaaaaacctatcctctttactactatctctttttgcctaagtcactgattaacggtggtcaatggtatttcatgttctggtctgcgctagggattgtttcaattggttttatcgcccttgtttacatttattctcgtccccgaaagtatcccctgctaacgattagccttggtctttccttaatcatgctgctaattccagcagtcggcgctttcttcaacggaatgatgtcagcttctaaccgttggacgctcttgatctaccttccattagcaatggccgtctgtattctagcagagaacattccaacgcttgatcaaaagacaatggcggtcctaagttgggcaacagggatttacctcattgtcttgattgcaaccttcttctttgacaatgagaatgatatttttatgccggttattttcttaattggctccctaatggtcatctggttgattcacttaaataaacttactcatccttaccggtggttactagcgattacaatgcttaacgctggggtgaacgcaatttacgcggctttcccctataacggagatttctctagtagtatgctgagccggggagagtatcaagcaattactagcaaccgttacggtaaccttgatcaggatttgaagaataattctttttaccgcgtttcaacaattagccaaaataagattattgacggcccgaaccttgataacgaccttacttctggattgcataacattgattcttactattcactgcaaaataaatatttgggacagtttaatacaagcctacaaaataaccagtatcaggctaatatccccattcggcaagccgatgatcggacaattatgaacaatttctttggcgtcaaatatctctttgttcaaagcaatggtgataacgcgacaaagattcccgctggttactttttagataaagcaactgatccagtcatcaattatgatgaaggacagccaagcaatcccaaaagcaaagatgagtttgtgcccacgcaaacaatgcggtacaaaacgaactatgctttcccattactttactggcaagataattacattagtaaaaaagattatcaatcactctcaccaactgaaaaagaacgcgttttagctaccggtgttctggttgataagcaagaaaagcttcgaggaatgaaggccgctaatctcaagacgcatgtctatccccttaaaagcgagttagtttctaaccgcttgaataaggttaacccggctaagctgacctataccgatagtgaagaaacttatcaattgcaattatcagaactgcaaagtaaaaaaatgcagcaaaaattaaagggcagcgagttgcatattgaattttctaagattaagtacactcctttctccatgaaagaacagattgcctatgagcaagcacatctgaaggaaacggtccttaatcccggaaatgttattaatcagcgctatacccactatcgctattggcgttaccacgttttaaatggttcacctgatattagctttaagcttaatgtcggcagtaagtttggaactgctacgattgaacaggcgcggcaaagtaccctttctttatttaaacacgttactaattcgacgcttaatattggttattatgatggcaaactgccaacttcactcaccttccagccttcaaagctgggaacttataagctcaaataccgggtagtagcagaaaaactagataataattattatcgtgaagttaaaacattgcaacgccatcgtctagaggacgttaaattcaaacgcaaccaagttcagggaacgattaaaactactcgtcctggcgtcctcacctcttcgattccttattctactggttggtcagtgaaagttaatgggaaaaagacaactaccttacgaacaaaccaggctttcctaggagtatacttacctgccggaactcatcatgttacctttagctatgagttgccaggaatcaaattaggcgtattactcagcttgattggcctaggctggaccattcttaccggaatcattacgatcgtatgggaacggaagcgcaagtaaagcagaataattcttgcatcccttttaagagacgcttaagataaaattaaatctatgggcaggagaaaaaatcgtgcataagaagtttacctatattgtctaccaaattattatggctatcttagccgttatctcgattggaatgctgatcgcatattatgctaagcggatcaatattgatgcctacccttacaatatgattgacaatgggatttggttggccttctttactgattacgttatccgcctgattatttcaccaaataaacgcgaatttgttaaagataacatctttgaccttctatcaatcattcctgccagcagcctcttctttctcttccgaattggacaaattggtagaacctttcagatgcttaaactcatgcgcattatgcgtttagtcggatttaccggtcgtttaggcgtcttctttgagcgcaatgagttgctctactacttgtacattacgattgctgttataatggtagccgctgcaatgttttgcatctcggagaaagtctcttacgaaacagccctgtggtgggcaattacaactgctactacgattggttacggggatgtgattcctaagaccggaattggccgggcagccgcgattgtcttgatgctcttgggaattggttttattgggatgcttaccagtacgattactgagttctttgccaaaaaagacgaacggaagatttctgcacaattagtcaaaattcaacatgaaaatcgccaactaaaggctgagctagacgaaatcaagcgtttgattaagaaaaataaacgttagcaaataacctccattcaaggatttatccaagaatggaggttatttttaatttatttgtcgatttaacgaaatcatctctagtaagctttgtgcagtgatcgctccttcattacccgctttgagtcccgcgcgttgcattgcctgttcaatgttatcggtagtaaggatgccaaatgtaattggaatattgctcgttaagttaagattcattacgccgccagcaacattttgacaaattaaatcgtagtgatctgtttcacctttgataatagcgcctaacgtcaaaatgccgtcatattccttttttgtcaataattgttttgtcataaacggaatttcaaatgctcccggcacatggtatacatcaacgttttcaaggtcaaacttagctaacatttcggtagctccctgcactaattgtttagtgacagtttcgttaaaatcagcaacaacaatcccgatttttgcactttgaacattaaattttccagtaaattctttcatgattaagcctccagattcagtaagtgatgaaatttatttttctttgtgattaagtaattctcatcgtagttattaggtgcgatttctaatggtatccgttcattgatttcaatatcgccaagttgtaattgcgcaattttatcgggattattagtaagtaggttaatcttggttatccctaattgatgtaaaatcgcaactgcttggtcatactgccgttcatcaggcgcaaaactaatttttcattggcttcgacatcatagtcgtgctcttgtaaagtaagctcgcaacttatttgctaaaccaattccacgaccttcttgacgcaaataaataataaccccgttgccgtttttctcaattcggcgcattgcttcatgaagttgaggaccacaatcacagcgaagggaaccaacatcgccagtaaagcattctgaatgcaagcgaaccattacaggagtagttggatcaatatctcccttattagcgctagattattgccatcaaaccacgtaagcgaaagtcaccatactgagacgggaggtgcacctctgctactggtttgctcgctagactttgccggtattcctgaagttctttgatcgtaatgatgggtaagctaaattcggctgctttctcatggagttcaactgatcgtgccatttcaccattgtcttttaaaatctcacagatataagcaactggttccaccccagctaagcgcgcaaggtcaacagcagcttcagtatgtccatttcgttctaatactccatttttctttgcaactaaaggaaagatatgacctggtttgtagaagtcttcgtttttagcagtcggtgcggcaagatgagtaatagtgcgccaacgatcaaaagctgaaattcccgttgttgtcgaatgatggtcaacgctgatcgtaaaagccgtaccaaaaggatctgaattatcagcagtcatctgaggtaatttcaatcgttcagctacttccggtgccatgggaacacacatcaatccacgggcatacttagtcatgaaattaaccttttcgggagtagcttcactagcaagccccaccaaatcgccttctgcttcgcggtctgcatcatccatgacaattgctaaacccccttcttgcaaatgcttaatcgttgcttgaattttctttacatccattattttcggcctcctagtaaatttgcgactacatatttgcctaaaatatcggtttctagattaacttcatcccctactttaagcgtatctaagttagtcacgagttgagtgtgcggaatcagcccaaccgtaaaccagtcatcaccagtttccatcactgttaaacttacgccattaatcgcgacacttccttgcgctaccacttgaccatgcaggcgttgcggaagactaaattgcacttcaatagcattttcattgacagtccgcttaaaactcgtgatagttcgtcaacatgccccgttacaatatgaccttctagccgtgcgccgatttgcaatgaacgttcaagatttaccagggaccctttttccaagtttttgaacgttgtcttttcaaaggtttgtgacattaatgtcgtcgtaaattgattgttgttgatttctacgaccgttaaacatgtcccatttaccgcaattgaatcgccaagttgcacggtggttaaaaaatcatcactatgaggttcaaccaccaattcaatcgtttcgccatcttgggtaatttttactattcgtcccgtttccgcaactaaaccactaaacattttcaatcttcctttccgcaatcctaatattattttctaagattttaatttcctgatgggtaaaattcattgggcaagctagttccatgccgctaacaccttttttgccaagcatgtggggagctacgtatgtaataagctcttcaaataagccttcctgtaaaaaggcttgatggacagtcggacccccttccacataaacagattgaatttctcgacaaccaagttcatgcaagatgtcgttaattgaccacgtccggcgataaaacacccgaatgcctttagcaaactgatcttgtagcgaactattttccgtaaaaatccaagtaggtgcctgcccttcagtcaacaagtgtaaggttggattatcttttaaacgtccccggcggtcaagaacaatccttactggcggaaactttgtcggactagtcgttaataaagttggattatcgataattgcggtttggcttccaatcaagattccttgaaaattaccacgctcggtatgaaccatttttgccacagcagaattagtaatcgccgttcgttgacctttttctgcggccacgcgatagtcaagactcactgcttgttttaaagttacccatggtcgtcggtaccgatagaagaaatcgtaatgcggatttaagacctgtgctgcttccttaaggacgcccgttttgacagtaatattttgctgttgaagcgtagtaatccctttcccggtgacaagctggtgcgggtctgtttccgcgatcacaaccctcctgatacccgcgtcaataatcgcctgactacatggtggttgtttcccatagtgattgcagggttccaacgtgacataaagagttgctccctgtaactgtttcggcgtaagtttacctattgcatcccgttcagcgtgaattccaccgtattcgtgagtatgacctcgcgctaaaacttgaccatttttcacaacaactgccccaacgcgaggatttttccaagtttcattgccagcctttgctgcttcagcgattgccatttgcatgaaataaacatcttccactctaaccatcctttccaaaataaaaacgccctaagatttctctcgggacgttaaatagttaacttaaaaaacagctcggtaaaaataaaaccggataacatcactgctatccggggctttacgtttaaactgattgtgtcatttttagttttcttctcccatccagactatactgtcggtaccagattttcactggttcaaccgttaacataaatgctaacgggtcacggactccaagcgtacttgttaccgtcggttgggaatttcaccctgcccgaagaaaattagattgttaaatttacatatagtgtaactcttcactttctttttgtaaacagcaaatttatttctgtgagaaactttgcagggtatccatgatcaattggatgaatttctcacgatcaatatcaaggaggactttagtattttggggcttatcagttaactgatagtagtcacaaaccgtctctccccgtgtaagatcgccctgagtttcaacatccacattcattttgtcagtaccgaacatagtaggatcaatcaaccaagcaatcgtacatgggtcatggaggggtgcacctttaaaaccccattttggattttcatggtactgttcaaagaagtttaggagaccgtagaaggcttgagcgacaggattatcgatctgcccaatttgctcaatctcatctttcataatctgcgctttatgggtcacgttcaacggtgccattaccagaggcaggccgaagttcattacaatcttagctgcttctggatcaacaaaaatattaaattcaactgatggtcgccaattgccaagtcccattgccccacccatgaagacaatttgatcaatcttttcttttgccaagtcgggatagactcgcaagaataaggctgcatttgtcattggaccggtgacaactagagtgactttctcatcacttttacgaagagttttagcgatcaattcaatagccggaattggttgaactttgaaatcgggatcaggaaggtccgcaccatctaaacccgtctcaccatgaacttctggtgcagtttcaagcggctcaaccagcggagtttgattcccctgagcaactggaatatcttcacgatggagtaaagttaacatccgcatcgcattatttaaggttttgtccggtgtttggttaccagcagaagttgttacggcaaggacatcaatcttcggtgaagcaatggccatcgttaacgccaatgcatcatcatgtccgggatcgcagtcaaggattatctttttggtcatttgttatcggcatcctttctttgtgaattgttagtatagcggttacattaattataacaaatgaacattattctgtttaatgtcgatcaataaaatttaaaaagacataataaaaggaccacctaatcgtgatccttttcaatataagttataattttacgctttctttactaaataaattggtaaagcaatcgcgccagctaaaagggctaaaatagtaaacttcttctttgaatgcttcttaggttgtgtagttttatttttcttcataagaatctactcctttgttcaaaaacctatcactacctacactcttattttagccccattttgcctttacgtaaaaatatatgggccaggtaattaaagcaattataaataaccaaacaattatcttttgaaataggttaagtttccaaatatgtttcataggttcaccttatttctttttaagccagctaaatatcccatggcggtgcgcttgcttttcttgtgcctctgttaaccgggtaagcaattcagtcacctttgcatcagtatttaccttttgagcgtcccgagctacctcgctgctattatacttttgctgaagggtatcactgttaagccaccgatcaaaattagcaacatcgacaataaaaccggtactagtatattgataactaatccgatactttcgcggcaagtattggaagtaccgttccatcatcattgaaccattatttcgcgccgtactatctgaaaccttattaaaaagctgcttattaatttgcgcttttaactgaccatcctgctgaataaacgttagatcagcacccacttccgcctggttaatcagcattgtccaatcatttcgcccgacaaagagtgagtaatcataattatcatcaaagtagtctttaacaagctcaaacatcccaaattggtccatcgcttgtttcaagacatatttgatgggataaaggtaatccttctcaatcttttgttctgtctctggtgacacatcattgaagaattttgcgagttcaacttggcaataacgataaagctgatcgttagcgcgctcaagcaagtcatttaatttagcttcacgttcatcctcatccccggcaaaagttgattcaaagctgaggtaccataaacgacgcataatttccggtttaagggaaaattgcgatttactatcaccctcacgacgattcatcgtaaaaataaatgatgggagtggctgagttaaactacgattgttagtaatttctttaatgaagcgatcaaaatatggccgtgttgttaagtcggggctaatatcatcaatcatcattggattaacgggcccggcactatacatataatcgcttaagacggttgtaatagtcatattgatattggactttcctaatgcataatttttagcatcaaaaacaccgccatcaaggaaattgccactccccgttagcttggctgctagccgctttcccaaggtcgacttccctgttcgtccttgaccaatcaaggctactccaaggggtacatcttcgcgcgatttactacttggcgataattcatacatattccggattttccatagccaaggcgcctcaaataggaaacacatgaaatcacatgcctgccacccctcaccgacttctttgtaattatcgtactcatgggcaatatcactaaataattgcagctgttcacggagccggtcacccgttaaattcgatgttattaattctgactttacattatcaccaacacggggcgcttcaaataactgaccattgttataaaacaagactggtttagggtagaggtcttcttcacgggtaacctttcctgagttatcatcgtttcgagacacatgtttaactacctgggtaaggctgtagagttctttccctatattttcgagattgcgtttcttatagccagcattaccaaagagcttgacagtttgggcgacactcaatttttctggagctgatagtttctttaattcctcgtcagaactatactgatccttatattcttttacttcttctgccgggataatcaccgcatccttgtcaccggtatccttgtttttcaccatattcaccgtatcggtatagacattaatctgaagctgctctttatttttcgccttaatgaacccggccattttctttgcgtccagataggtagtcgcatggcgaaggttatcgttgaacatctggacatggcattgataaagcggatccgtctgcattccatagtcactgtcaagttgttctaaattatgatgaattgctgcttcggttaaattcatcgaaccggcaaatgaaagataccggtcgtcacttgtcattaagtacattttggtatgaattaattcttgcttagtgaataaaagttgcaagctaccatctaaaattcgcttcgtaaattcactatcagggtgttcataaccataattgacaaattcagtccggtcatttaactgcctcatccgtttgccaattgattctttcccattgtcgcttaagccgaggatcaaagtgaccttatcatagcgcggtaatagttgctcctcaataaacttaattgaagaaacaaatgaaacgcccctaaattcggttggcttttcaagatgctcacccgcgaattgccaaaaatcggcatcagaaatcaattcttgtttagtgtaatctaggatatctaacatgtgactcgcctcctttttagttaactttcaaattatatcatgaaaaaaagaaccactcgcaagtgattcttcggataaaaattagttcttctttgccagcttatatagtaagtacattggccaaattaaggctcctgcgacaagtgttaataaaacaatcttttggttctttgacaagttatgacatggacacttcatatttaatcgcctctttgttgatcagttaagttaattataacgcatttgggcgataatttaaggaagcgatttcagatttaaagaagatttagtatcttaaaacatattaccatcaattttatatgtcatataatgttcttttacttctactccaacttgatactgaatcattaaattagttaacatctcgccgttaaccagtgtaatatttaagtcctttgctgcgttgattgcaccttgagtaaatgtagaagttgtaataaatacacctctatctgcatgcttgagcttaattgaaccactaaatgctgtaatttctggcatttgaactgaattatctggcgcatatctttttacttgaagataaactttttgcaaacctagtgggtcttgattaataattccatcaattccatgatcatttgatttctgtgttactaaagcctgcccttcatcacccttgtaccccattacagataacaactgaaccattaagttttcaaatttatatggattcatttttaccaagtgatttaataattcatcctgcgttttttcgtcttgctgattaaaccattccttaacttgactttcagctaaatctttattttctcgcttctgtctatttttcttttgattacttttttcttgtttgtatttcttataagctggctcattatggatcaaagttctcgttatattaattccatattctttactaagctcttgcccgcgacgagtcgggagataaaggcctctcttgggtcggtttaataaacctgaaattgctaaatcacttaaagcaaaactaactcgattacgcatgaccaaatcatgactcttttgtggataacgcatgtcaacaccgattttaaaatgtaggatttcaccggtttaaaaatgtagtttttcaccgatttgtttctgttgtctgttgttcttgatagtctttcattcgatatgattttccagtaattttgaatatttcagaatggtgaactaagcgatctaagatcgcattcgcaattgttggattagagaatgtttgaccccacttggatagtggaatattagtggtaatgattgttgatttcttttcatatcgacgagctattaactggaagaaaagatctgatcccaaatcgtcaataggtagatagcctatttcatcaataatcaaaagcttataacgactgtagttttttaatattgcctcaagacgattttcttggtgggcaagtttgagccgttcaattagttcatgacaattgacaaaataagtactgagatgattcctacaggcctccattcctaatccagttgctaagtgcgttttgccaactcctgaagacccgatgaataagatattttgtgctaacgaaacaaaattcatcgattttaagttcatgatacggtttttatcaaccgaaggttgaaagttaaagtcaaaatcattcaagcctttgtcgtaaggaaagtgtgcaatatgaatggacattttagctgatcgttcagttcgatatgtgatttcttttgcagttagctgttctagagcttctgctaatgataaatcattattattcaagtaatttggcaaatattctttgattgcagtcagcttgagcttttctaaattgtcttctaattgtgtatagatagtcatccgtcattcctccactataattgatcaaacatgcgtaaatttatttctacctgttctgccaatttatcgtcatctaagtcatgaaaaatagttgtcccaaggatttccttcatatcatcgcgatgataatttagttttttattactcaggtaatgttgtcgaaccaatcgtgaggcatgataaatcattaatttttggtctgtaaccttgacgttaactgtttgcccgatatactttacaggtacagaatatttattgcctagataggtgatcatcgattcattactaactttgcgggttagatcgtgatcaactaatgaattcaaaaggattggattgtatggctgtaaatattctttttcttttatccataaatcttctggtctttgatcagttgcttagcttatttcgtgattgagctgtgtttcaagctgcttcacgatattttttaacgccttctcatcctgaaattcgtgattataaactttaatacggtctacggttctcgctaaggcttcgacttttcctttggtttggggacggaagggccgacaggcttggggaataaagcctgcggctttagagaaattcaataagcgtgaattccaaataacttttcgatagctactcttggcgtgatcaaccgccgttttcatattatcgaaataaattctttgaggaacaccgccagtattttgaaaagcctcaatcaaacattgaaatagtgtgtcttgtttacggtcaaaaactaactttaagaattttttgcgtgaataacccaatacatacagaaatagtgaaaaagtaatggggcggttttctctggtatataagactaagtcttctttccaatcaacctgacttacatcaccaggtgcagtttcaactctaatcactggctgctggtattgtgcttttttcaactggtgacagtaatcacgcaaaattgaaattccgccttcgtagcctaattctttaatgaaatagaaaatggctgttgcagaacaggttttgtatttatccttgataacatcacggtatgggtccaacttacttgggcaacgcttgttagtttgtcgtttaccggcttgtggattatttaaataccgcttaattgtcctagggtcgcaattatattgacggcctagggccgcataattaggtttaatttttgccattttgtaaaatattaactcctcttgtaattctagtcgcatcaaatcacctcaaaagatttaatgcaattagtataaaaaattgtaggaaaatcgacattttcaaatcggtgttttcctacattttagaaccggtgttaacataacgcatttgcaacatgctttgcggtaaattagcttcttctaaagttctttgtatcaattcactgctttgccaattctgtctttcaacggcaacttttaaaataactcctaaaaatgcatcccaagtcggagtaccatcggcttgatgttttaacgttgtatagtcaatcattttcagctcctaaaattcacttcaaatcgaagtaataatcatccaaagcatacgtattaactggcgtaatatgtaattgatatttttcaaccaattcagctagtgtctgcccgtcaattaatgttacagtattatttccttgggttgccttttttcgagcacgatctgtgaaatgattagttgtgataaatatcccatattcagcattaaaactatccattactcctttaaacttatcgatttcaggttctgatactgctccttttgtgtaccttttacattgaatcgctacccgactagttctgaattcatcagatgtaaaatatccaaagccatcgattccatggtcaccggaacgaacaattccgcgatctttatcaattacaacacccatttttgaaatcaataagcgcgaaaaactttcaaatttactaggatcaaacttcattaattgagtaatcaattggtttttccagtttaaatctttagtatcctcttggtcttctggtcctgttgattcgtctccgctttcttcacttactttatttttattacgttcagcacgttccttatttttcttatcccaataagcaccaatttcttttttctgttctaacgaaggataatttgttaaatcatcgttctctccggccttagtaagaacaatatcctgattacgatgaggagcttcaatatattgaatactgcgcaaatttcgaataccaaagttaaagtcaaacaagaatggtgaataagtgcccgttttaccttctttagttgaatagacttgatcataagttaatccatcatattcattatctgcaattgctttccaaatagattttcggcttgctgacccacccaaatctcttaatgccataataattgctttttctactgatcttctcttatattctgccatgatttcacccattaaatatatattctaaatacttattatatcgtaactttttaccagctatttctcagtattatcaataatttttataaaagtatgtattaatgttaaatgggagcagcgtaagttgggggagactcttactgggtttgaatatggtcttaatacacctgcaactgactacgatggtataaataagtatttgcgtattactgacattgacgatgtatctcataaattcgatatatcacatttaacttctcctaaattaaaagatgataattatcttttagccaatggtgatattctatttgcacgaactggtgctagtgttggtaaaagttacaggtacagtaatatcgacggtaaagtgtactatgctggttttttaatcaaagctcacattaaagaccacttttctactaattttatttttgatacaacacttctacctcgatatcattattttgttcaagtaacttctatgagatctgggcagcctggaatcaatgcaaaagaatatcaaaaatatataatttatacccctcggagaacgaacaaaacaagattagcgatttaatactaactattcaaaaattaattgatctccagcaacgaaaattggaacaacttaaacagctaaaaaaggcgctgttacaacaattatttgttgaaaaaaatagtaaacatccaattttaagatttaaaaactttaatggtgattgggaagagcgcaaattaagtgatattgcaaattatagaaacggaaaagctcatgagcaatatattgatatgaatggaatctatactgttgtaaattcaaaattcatttcaacaaatggtaaagtaaagaaattttcaaatgagccaatcgaactcttaaaaaaaggtgagatcgcttttgttttatctgatgtaccgaacggaaaagctctagcaaaggcctacttgatagatagtgataataaatacagtttaaatcagagaattgcaggaatttctcctagttccgatataaatagctattttctatatgtattaatgaacaggaatcgatactttttgaagttcgatgatggtgtaggtcaaacaaacctatcaaaaaaagatattgaagaattcaaagaaaactatccattatttgatgaacaacaaaaaatagctaatcttttttcacagattcaagcactaatcagtctccaacaaaacaaacatactcaactaatcgccttgaaaaagtatcttttacaaaagcttttcatctaaaaaaagtggtatcagcatttagtttactggtaccgctttttgtttagttcagttgagatagatgatgtaagactttattattatctttattttcgagttcctcaataatatgaatataggtttcttgggtcgttgtagtgttggcatggcccagtctcttagcaacactagcaactgacactccttcataaagtaataatgaggcatgggtatggcgtaaaccatgaacagaaatagttggtatatctaatttatagcaatatttttctaacaagccattaacagtcgagttaaatactcttttattgtgtggcacaaaaattggccagtcactttctttatttcgaataagtgacttaaattgattcataaggtgccaatcgaccatcacaacacgatttgaagattcattcttagttttttgaaaattaccaattggcgttttataattccaagatttattaacgataatttgctgcctttcaaaatcaaaatcttctggagttaaggctaacgcttccgcaaatcgtaagccagtctttgatactaataaaataaaccaatcccagtttaattcgtcacctagatcaagatggcggagtagtttttgcaattcataaaggttcaaaaatttattctttttattgctaggatcaactccctttataattgctcgccgtgtagggtcatgttccagtaatccttcgtctagtgcatcaactaaggctgcttttaggtgatgatgaaaatcaagagtagtttgtttttcatgagtagcagcatagttatttaacaatttttgatatgattggcgagtaagttcattcatatgtaactctggtgcaagttctttaatttttctatgcgttaaataatatttatccaacgttacttttcgaactgctttttccttataaagtttaatccaatccatatagtatttataaaatagctttgtactgtagtgtttccgagacataataaaacctccaataaataatctagtgtcaaaaacacaaatgtattatttattggaggttacgcttcatgcaataaattagataaagagcttttgaagaagatattttttaagaatagttaattgatcgattttagattgctggagtttaatcaaactatcaattttcattatcgtaatgcttattaggttttcttcttcaattttaggtaaacttaacttcaaatgttttactattttagcagataagttcccttgtcccccttgaagataggttgaaataatttttcttttgttcttaattaaccaagtttttataaaatacacgttgtctttttttaagttaattgccattacagcttgattaatagctccatcaatttgagctattccaacctctccactagttgctccataaagagcatataaaagtgtccctttttttataaatttagcagatgaattttttaatccatctggtgttaaatgtagctgagtggtatttttattaatttctgcagatctaatgaatgggatgttaccgccatagtaatccttattagaaatagccggagttcctccagaaaaagtatttgctatatcattaaatttatgaggcaaccaattatcattaaagtttttaaaccttaaaattggttgtttacaatctttatcaataaacattcgctgtaatgaaaaaatcttaagttgccttaattgttccaattttcgttgctggagatcaattaatttttgaatagttagtattaaatcgctaatcttgttttgttcgttctccgagggggtataaattatatatttttgatattcttttgcattgattccaggctgcccagatctcatagaagttacttgaacaaaataatgatatcgaggtagaagtgttgtatcaaaaataaaattagtagaaaagtggtctttaatgtgagctttgattaaaaaaccagcatagtacactttaccgtcgatattactgtacctgtaacttttaccaacactagcaccagttcgtgcaaatagaatatcaccattggctaaaagataattatcatcttttaatttaggagaagttaaatgtgatatatcgaatttatgagatacatcgtcaatgtcagtaatacgcaaatacttatttataccatcgtagtcagttgcaggtgtattaagaccatattcaaacccagtaagagcctcccccaacttacgctgctcccaatcatcagtaaatcctttaaaacggacttcaggcaccaatttttcgggctttttatccattacgctttacctcgttttctaacattttgataaattcgtttaagtctttttgggtcttctcgtcttttgaagttagctctttcatcatccccaaaagctcaccttgggtctgttcaatctctttttgagtctcttccatttcttttgttaacttcccaagatcaactggtggttcgggttcaaatgtgtcaacatatcgcggaatattaaggttatagtcgttttctttaatttcatcgatcgttgccacatgagcatacttatcaacgtcttttctttccttatatgtatcaattatcttatcaatatcttcttttcgtaagacgttttggttcttacccttttcaaagtttttgcttgcgtcaataaacaatacatctttattttctttattcttctttaagacaagtacaactgtcggaattccagttgaatagaataaatttgctggcaacccaataattgcatcaatctgatttttctctaataaagctttccgaatctgagcttccttagcaccacggaatagaaccccgtgtggcaaaacaattgccatcgttccatcttgttttaagtgatataggccatgcaaaagaaaggcatagtccgcttttgtcttcggtgccaatgctccatactccttaaaacgaggatcttttagcttattatcattgttatcccatcgtgcagagtaaggcggattagccacaaccatgtcaaaactatgtggatgatctaccccatgttcgtctactccatcaggccaatccatttcaagcgtatctgcattttttagcgtcatgttttggtaacgaacatcgtgcatcattaaattcatccgcgctaaattataagttgtcgtgtttagttcttgaccagcatattttaacttcttaccaggaacttgatcttgaaccgtcagtaagagagagcctgatccacatgcaaagtcatatacttctggattctgaatctttgagtctaaatctaaagctaccaatttagctaatatttctgaaacttggtgtggggtatagaactcaccagccttttttcctgagtttgtggcaaactgctgaattaaataagtataaatatcagcgaggatatctttgccgttttcatctttatattcaatttgatctatcaagttaacaatatctgttaatgctttagctctagcagcagtagtattacctaggcgagaatttccaagattcatatcatcaaaaattccatggaaatccattttagcattatgattaagattcaaattatgattaaaattatctaacatatcttgatagtctgacggtgcaattgtattgttattgactctatcgacaattgatgcccaagtatatttaggggcaattgcataacctaatgcccctgcaatttcaggtaatgcgtcaactagttcttcttctggtatacccaaatatgcatcatttacactttggttattttcaggaaatactactttaccttttaataaatattcttcctgattttctgatagataacggtagaatacgaaacctaaaatgtaatttctatattcaccagcatccatattacttcttaagcgattcgccatttcccaaatctgactctcaatttctcttgtagtactcaattaaaaaactcctaatatttttctttagttcatcagcaaattcagttatattttcacgaagtatccttctatatttaaatctattcatatttcgtatttcttcagcttcagcatcagtcttgtatactgcttggccttccatgacgatgttgtcgagctctccatttccgtttaggtcatcggcgccaatgacatgcttatctaagatttcatttattaaatgtgaatcttcaatatcagctagtccccactttttcttatactcaaaaatggcagaacgttgttgcccttcattattttgggcaattaactttttaacgtgcttttgttgcacagggtattcaaatttaacctttcctttgaagagatccttaataaatcttagaattttggccgcatatccccgatcttctaatttatcagaaataatctttacttcttcagcggattttttagcgccctcaatgtcgttatcgtgatacttattcatcacttcaacaatcaatccctcaaggtaatcccaattgaccttcacttctttaacgtgttccatttggaggtcaacttgcgagaaatcaatatgatgccttttagcaatttttgtttttagccgatttgctaaagtggttgttaagatttcttcatcatccaagctcatccccaatgaagttaataatttttcaggatgtgtatcgtcatatttatcgtcttgtttggcaattgccatcaaatggttatattggcgtaagtctttgtacatttgttcttgtgcattttcgcttgctgggatatcagtaaaatcttctgaaaaaccagctaacctgtttactaccttatgcaactctttcttaacttcaccataggaaggggcaataacaccatcgtttttaccttcatcgttaaaaagttcttcttgaatgttagcggagttgcggtttgcatattttgccaatgcacttttcattaacttttccgtgtgtttaggccatcggtaatttacaattcggccgaatggcttagtttgcatatcctgaacccggtttgttcgcgaatatgcttggattaaagctgcaccctttaatgtccgatctacataaagagtatttaattgtggtgcattaaagcccgttaataattggtcaacaacgatcacaagatcaaagtatttgccatcatcaattgtccgattcaatcgcgaaactacttgttctgtatattctttaacctgcttatcattaaagctagtaccaaacatttcattgtagtcttgcattgcgttacgcaaagaatcatttgtctctagctgattatcaccattggacgtatcttgactaaaggtaattccaattcgtaatggatgttcccttttcgcattttgcttcttaaattcgttataatactccatcgccattggagttgatgctttcccgccaccaacatgagtagtaagaattgcattgtacttactattaacagagcgtttattccaatttttcaagatatcctcaacgaccaactcaacatgtttatgattttcatcatagacacttggctcaaccttatcgtccatgtcgttttcattcatgttggcgattcgttcttggatttcctcatctgtcatcttaggatagcgagccttaaaatactctggcagatattgttctctcagtactttttcagttaatgttgtctcaaaatccaccttgaatccaagaacattaccatctttaatggcatcttgaattgtataagtatgaataacatccccaaagatatcacgagttgtcggcgttttagacttaccattttcttctggaaagacaggagtcccagtataaccaacccaggccgatttaggaaaaactttccgaattctttgcagcatttctccagaagttgagcggtgagcctcatcaacaataaagacaagattcttatcaacaggcttgaagtcattgcttcgaaccattgcatccatcttttgagtagaagttacaataattccgtttcctttacgcttcaatttattagctaatgcccacgattagcagtatcagtaactactcccccattacttccttcagtattttcaggatcatacgccatatattcatcaactgtttggttagttaaggccactcgatcaaccataaatacaactttatcaacattaggtaatcgtgatgcaagccaggcagccttaaatgaactgatggttttaccagatccagttgtatgccaaacatatccgattcgttgatcatcaatcccaaacgtatgctcacgaattttgttaatgacccgttttgttgcataaacttgatatggacgcataatctttatcatttgatgacgggtgttccatccaaaatcatataatttgttgccatttgatgggccatcggaatcgataacattagatccgcaaattgcattgcatctagcactggtttattatcctttgctcgttgccattgaaaagcaaaatcggtattaaacttgtcagctgtcgtattagccatgtaacgtgcatcatgtggtgttaaggcaactagaatttgaagagtgccaaaaaatatcagaatattggtcttcttcgatatattgatgcatttggtttaacgcttctttagcatcccgaccatcagctttttcctcaatttggataatcggtaaaccatttattaacattgttacatcaaaacgacgattcttccgtcctggaattactgctggacgctcaatctgattaacaatttgataaacagtattcccagcgcctatttgatcctggtcaaaaactgttaaatatacatgtttaccatcatcacgatcaatttcaatttgcgatattccattagtcccgtatagaaactgcccagcttcatagggagtatttaatttattgactatcgccttcacttgattaaattcggttggcgataacggtttctctaggcggtcttgattatgttgctcaagaatacgcttaaagttgtcccacaattgatctgttgttttaatctgtggtaagtattcccattgcttagttccacctaaattactaagatggttaattaattcattttcaaatgctaattcgctcttccaaatagtcatttaataacccactttaactttatattctttaacattataagaaaaattaacactcctatgcaacgtaagtaaaaacatttaagcattttactaagttttagcaaaaaagtatccttttatttttaatttatgcaataattaacttgttgttagaaattaaggttatacttaaaggagattttattatgactgaacaaaaagttgctgttattactggtagtagtcgtggtatcggaaagggcattgcggaacaactaggaaaagatggctatgcaatggtcattaatggttatcataaagaagaaacagacaagacaaccaaagaattagctgacaaaggatataaggttgtggcagctcctggtgacgtttcaaaaaaggaaactcatgaaatgcttgtaaaagctgctgtggataactttggacgccttgacacttacattaacaatgccggaattgcacaaattggtaatctcctagacgaatcagccgaagaatttcataaaatttacgctactaatgttgatagtgttctgtttgggattcaagctgctgctgaacaattcaggaagcaagatgatggagataaaatccgtaaaatcatcaatgcttcaagtatcgctggacacattggttatgaacaattaggagcatactcttcaactaaatttgctattcgtggattaacacaagtagctgctaaggaattagctaaatttaatattacggttaatgcctattgcccaggtattgtgggtaccgatatgtgggactttatcgacgaaaagatggttgaagaaaatggtggtgaaaaaggtcaatacttaaaggccgctattgacggaattgctcttggtcgtgttgaacatccatcagacgtcgctaactttgtctcctacctcgcttcagacaaatctgactacatgactggtcaagctgtccaaattgacggtggagttcaatttatctaatttagttttcaatataaaatagtaattccctaaccctgataaaaaattaccaaggctagggattttttatcctccccaaatcataagtcaatctacatcccccaaaatgctataatcaaagcaaacctatcaaaggaggagaattgtatgtttgaagcttacaaatactactgggaaaacgcctttaagtaccgggctacttcaacgcgggcggatttttggtggccagtattagttaatttcatcatttttgttattttatatttcttactagcaatcgctggttttgcttctgtcacttcgattatgaatggctataatcgtggcgttggattcttaattttcttgctcttcgttattgcagtattcgctattgctattattattcccggaattgctatctgtgtccggcgggttcgcgataccggtttgactggctggaccgtattggttttctggttactttcccttatttttacaagtaacgacagtgcagtgatggaaactatttcctcagtcattgatataatcttcttagtgattctctgcttgccaactggttacgtcaataaacaaggttggtggagcgctaactacgacaacgatgttaaggttctatcattacgaaacaataattaaattaaaagagctggtgcctcaaaatgcagcatcagctcttttaatttagtcaattttaattatcccttgtaaataggttggtatgaaccccgcaaagtgatcttatcaagtccgttatcgaggttgtacttatcgtcactaagcttcttttcccggtaacctgcccgtgaaaaagcttcgactaagcgcgccataaattcttgaccaccttctgcagtttcataaatcatgtggtcaatgtattgtggcatgtttgtactcttccgcaataaagtgattaagtacacctgcttatcagtcttgttaatttctgaggtattttgcatcaatgacatatctatttcctcctattcaatccaagaattctcttcctactcatattataaattatgtacaggattagtcaaaactgtttatcaaaaaaatgagcgaaaacacgaataagttaatttagaaaataaatgtcctcctgtaaaatataataatatttttaccctaaccctgtaattttcgttaattaagtgttactataatggcgaaaggaagcataatcatggaaattaatgcagatgctcttaagaacttccaagattcgaagttcaattttgtagatgcagatggtaatgatgtagactttgataacttggacgaaagtgtaaagtacactcttcgtgatggtgaaacagttgttgaagatgatatgcatgccaaggacgttgttgataccattaataatgaatatggtaaaacaatgaacgtttaatttcttgatatgtagaattaaaaataggttcctatcactcaatctttgatagggacctatttttttactatctaaattgcttctcttgcccaagagttctaaaattagaaataaattgaaagataagggactcttatttatgatgaacattttattaatcatcttaacggcaatttttattatcgaaagtatttttgaagttcgttatttttaccaaattcgaaccatttttaatcaatctggccgtattgaacctactaaacgagttcagcgaatcgtcacaattgaaactcagtggtcatggatttcatggatcttcttactcttactgtttgttttaccagacgtgtataccgctattctcatctgtgtcattacccttattgaaacatgggtagtctacgaactttacaacgctcgcgaatatgctaagaaaattaatgaaaaataataaaagtaaagaggaaggtgttacaagcttaacgccttccccttttttatgctacacgcacttttgttaacagttcataaacataagacaactcacttggacgaaaggcgccatggagggtccccacttttttaaagccgctcttagttgcgatccgttgcattgccatattattttcatttgtgcttaaacgaattgatttgatttctggacgctcggtctccaaatactcaatcaaactcaaaaataatttggatgcatatccttttcctgcgtgtcgtgaatgaatagctacgcggtggattacaacataattttcagtattaattagccattccccgttgagtttgtcataaaaatgatccggtgcttcaacaattgctaacgtgccaactgtttgtccatcatctgctttaacgagataagcataaccattctcaatatcttcttttacatgggtaacgttcggataatccccctgccattggtcaacgccccgctcagctaactggttacgtccatcacgtaaaatatctactactacatctaaatctgccattgttgctttccggattttcattgtaatccctccttaaaatcgttgcttatagctaaaccataacaaattaagcaactaatagtatcacaccttgagattcatatgcaattactttttatttttaattttaggaaatcgataaacttatattaaataagctattgacatcgcttacatctaatattatattattaggtgtaacgataaactaaagcgttttcaaataaataaagggagaattactacaatgaattattttatcggtgttgatgttggaactacttctacaaaggcagttctatatgaccaaaatgcaactgtgttagatcaatttagccaaggttattccctttaccgcgatgctagtggaatggctgaacaaaacccaactgcaattgtcgaagcagtcgaaaaagttattcatgatgcagcacaaaaagcagatttaacaaatggaaaattgttagcggtatcattttctagtgctaaccaaagtgtgattatgctcgacaagaatttcaatcccctttcacgggtcatcacttgggctgatacccgtgcacgtgatgtcgccaacgaattaaagaatagtcctgctggtcagcaaatctatgctaaaacaggtacacctattcatccaatgtccccattgaccaagattatgtggctcaataagacacaagcagataaggttgctcaaactgcatattttggcgatatcaaatcctacctcttccaccagtttttcaatacatttaaggttgatgtttccatcgcttcatgtaccggaatgatgaatgtcaatacgtgtgactgggacgatcaagcattggaactcgctaacgtcgactgttcccaattaccagaaatcgtgaacggaacaacccaagcgattggcctaacagcagcggcgcaagcaaaaatgggtatcccgctgacacgccatttgtctatggtgcctttgacggtgctttatctaatttaggtgtgggggcaattaagcaaaatactgttgccattacgattggaacttcggctggtgttcgggtagtaactgaccatccagtgatcgatcctcagcaacgactcttctgttacgccgtggataaaggtttatgggtcatcggcggtccgcttaataatggtggcgatgtctatcagtgggccgttgaacacttagttgacgctagtgcagttaaaaatgaaaatattgatccctacactcttgctaaccgagttattgaaggtgttcccgccggagctcacggtttgctcttccacccattccttggcggtgaacgggcaccattatgggacgctaatgcgcgcggtagtttctttggactttcccacattcatactcgtgccgatatgctgcgctcagtaatggaaggaatttgtatgaatattgcaactgttttccaagcggttcgtgatcttgttggtaatcctgcaagcgtaactgcaactggcggttttgcgcgagctgaagtttggcggcaaatgttagcagatgtcttgaactgtccggtcaatatcccgaactcatttgaatctggttgtctcggtgcaatcaccatggcaatgaagagtttaggaatgattgaaaactatgaaatcattaaaacattagttggtgatatcagttcttatcagccaaatcaagatgcggttaatgtttatcaaaattacttaccactttttaagcaggtcgaaggattattaacaccagcctattcgaccatcgctaaattacaacaacaatctactactcattagggggttattattatgcctttacttattgttttaatcggggttattatcttaattttcatgattgttaaactaaagatgaacactttcgttggtttagtaatcacatcattcatcgttggtttgttactcggccttccacttacaaaaattccgcagacaattgaaaccgggatcgggggccaattaggacacttagctattatctttggtttcgggtcaatgcttggtaaattagtttctgatgccggtggtggatatcgaattgcaacaacattgattaataagtttggtcggcgttggatccaagttgctgttatccttgcctcctttatcattgggttagcattattctttgaagttgggcttgtcgttgttttaccaattatctttattatcgcccacgagcttgatatgccattgatgtatcttggtattccaatggcagcaaccttaaacgttacccacgctttcttaccaccacatcctgctccaactgctatcacggacattcttggtgcaaaccttggacacgtcttgctgcttggtattttagctgcaatcccaacaatcattattgctggtccagtttataactgggtattacaaaaagtttatccgcgtgtttaccgtaaaaatattgatatttcagttcttggcgaatataaagaattcaagcttgaagaaacgcctaaattcggtatctccgttttaactgcaatgatgccagttatcttaattgctgtcgctactatttgttcatttattttccctaagaacaatccagttaatgaattcattcaatttattggtgctcctgaccttgcaatgcttctttcattaatcttcgcaatctttacaatgggattatggcgaaacaagaaaatggaagaaatttcaaccgcccttgccgactcaatcaagcaaatttctgtaatgcttttgatcatcggtggtggtggtgccttcaagcaagtccttgttgatggtggaatttcaaaatatatttctggtttattcgctcaaactaacatttcaccaattctagctgcttggttaattactgctttattacggatgtcacttggatcctcaacagttgctgcgatgaccgctgccggccttgtggttccaatggctcaccaatttggcggtaactcaattatggcaacattgatggttctttccatcggtgctggttctgtcttttgtggacacgttaatgatgccggtttctggatgatcaaagaatactttggcctttcattaaaggaaactttactttcgtggacaactttaacttccgtcttagcactcgctgggttgggagccgtctacgccatttcattatttgtctaagtcaatttaagcgtcctagtgaattagctagtgacgctttttgtatggtttggtattcttaataatagtagaactattaaggatgatgaataaacaaatgacgcaacatactactatcgctgacgttgctaaagcagctggtgtttcagcgactaccgtttcacgtattattaatggtcgttatgataaaatgcgcccagcaacgcggaaacgggtggaaaaagcaattaaagaccttcaatttgttccaaccgcttctgcacgacagcttcgccaaactcatagtcacgttgttggaatcctcgttggagatatttctaaccccttttcatctttacttgccaaagggatcgatgatgttttgcaacaagcgggctatgatatcctcctcatgaatacgaataactcgcgggaaaatgaaagtcgtgctcttcagcgtctatatcagcaacgagttgacggaattattgtccagcctaattcccgccactttagtcaatttgcccctactattcacaatgatattcccctcgtgattgttgaccgtgaagttgatgaccagccttctacagttgggaaggtcacttctgctaatcgtgatgcttgttataacctcggtaagattctttatcaaaatggttatcagaatattttaactgtcagcgcgcattttgcggaggcatcgggtcaaatccctcgaattgccggtttaaaggttgctgctgctgataatgggctaagctatcacaatattgaaactcggggacatgatcggcagtggcttgctaaaatgtttttgcaacagttaaatgaactcaaaggcaaaactgctgtcgtttcattaatggggcccattttatttgatcttttagcgatttttaaggaactaaacctttccttccctgacgatcttggcttagttagctttgatgattgggaatggtcgcaatatgtcgctaatggaatctttctgttgaagcaagatatggagttaatgggtagcttagcagctaataagcttttaacacagattaaccaacaaagtaccatcagttccactacccttttaccagttgaaatcattgcacaccagtcactttagcatataatattacaaagagaattaaattgagttttaaaggagaacaataaatgaactacttaattggtgttgacgttggaacctctagcacaaaggccgttttatatggtcaagatgcgcaggtgatcacacaagctaactatggctacgagttgcaccgcaatgccgcgggaatggcagaacaagagccagaagaagtaatcaatgctgctgaacaagctatccatgatgtggctacggcagctgatctcagtacggggaaactactagcagtctcaatttcaagtgcaaatcaaagcctcctcttattagataaaaataagaagcctctttcacggttaatcacttgggcagatagtcgagctcagcgcgcagcagacaaccttaagatgatgactgaaggacaacaattatatatgaagacgggggttcctgttcaccctatgtcaaccttgacaaagctcctttggttaagggaagacgaacctgatttatttaaccgcacagcatattttgctgatattaaggcttaccttttctaccggttatttaatgaatttaaggttgatatgtcaatcgcttcctcaactggcttgatgaaccttaaaacttgtgattgggatgaccaggctcttcgggttgcaggaataaccaaagatcaactgcctgaaattgtcgatggaacaactcaagcaactggtttagtgcccgaagcccaagaaaaactaggagtaccagctgatacgccatttgtttatggtgcttacgatggtgccctttcaaatattggtgttggtgcaaccaagcaaaatacagtagcaattacaatcggtacttccgcagctgtacgagtcgtaactgatcatcctgttattgatccagaacgccgcctcttctgctatgctattaataaaggattgtgggtcgttggtggtccgcttaataacggtggcgatgtctatgaatgggcagtaaaacaccttgtcgatagtagcgcagttaaaaacgaacaggtcgatccttatactttggcaaatcacgttattgaaggagtaccagcaggcgcgcatgggcttctctttcatcccttcctgggcggtgaacgggcaccattgtggaatgctaaagcgcgtggtagtttctttgggctttctcatatccatacacgggctgatatgctacgagcagttatggaaggaattagcatgaacattgcaacagtcttccaagcagtacgagcgttagtcggtgaaccagcgagcgttactgcaacaggtggctttgctcgctcaaaagtatggcgccaaatgcttgctgatatcttaaactgtccggttaacgttcctgactcatttgaatctggctgcctcgggtcagtagttatggctatgcaaagcctgggaatgatcgacagtcttgatacaccacagaagttcattggtaaggttagttcttaccaaccagatccagccgcagtaaaagtatatcaacgctatactccactcttccaacaaattgaagatatgcttgctccggcttattctgaaatcgctaaactacaagaacgccaaaacaattaaagaatcaaaaaatcgatcttacaatcattttccgatgtgagatcgattttttaattatgactattctgttaacaggttcttaatattacctttagcatttcaaaaagtaatgtaaaacgcttccaaacatgttactattagcttgtactaaaaaattatttatagaaaggaagtggtactaatggccgcatggaaaaaatggtgggtttcatttgtaatgatgcttcaagtaatcgttggaattgttgtcgtatcattatggttttatcgtgaccaaacttggacaattccagttaatgattggctttatagccccatcggtcaaagtttttcagcaggagtcgcagtatttttaatcattgttgctttaaccgtaatagcaattgctgtttttcgtcccacaacaactaaacaaatgacaatcgctagagatggcgctaataaagttcaaattgatcagcatgcagttgaacacagcttaactacttcaattgccaaatttgacctttataacccagtgattaacctcaagatgcaccgtaacaatcacaacgcagacgtcaccgttcatggaatgctctctaagaggaccaatccaaaactaattcatacagtactactccagacaattaaagaaaaccttaaacgggacttcgacattgatcttaataaattacacattaagctaagtccctactcaaacaaagaatcagtcaacattgtctaaaaaggaggtactatatgaaacttgctacaattggcgttatcttaggactgcttatcagcattagttggattatgtggggctttttcccaatgattggcattctgttagctgtcactatcttaggcggaattggctatgttcttgatgcaagaggctattcattaaataaacttgcgataaaaatgttagataaatttgccaactaattcaaggaggaattaatatgacaaccactacaaataataaaacaattgatgagcaattaacattcgatgatcaagtaattgaaaaaatcgctgggatcaccgctagcaaagttcctggaatcctttcccttgatggaaatatgtttagtgaattagcagataaagtaacttccggaagcaatccaaccaagggtattaatgccgatgttggtgaaaagcaagtcgcattaaaaatggaagctaccatcgaatatggcaaaagcgctccagaaatttttaaggcagtttgttctgaggtacaacacgcaatcaataaaatgactggcttgaatttagttaagtttgagctacatatcaatgatgttaaaacaagagaagaagtagaaaaagatacaaaataagggaacgagccaagtatcacgggcactttcgttttcaacatgaagcccctatatgcaacataggcctccagcgttcggctttaccgggcgttgggggcctatttcgaaatgtgactgaacttttatcacactcttttacataataatcatttaaaatggcggcctaaaataactaaatcacgtttaatcccatcaagctctgctacttgtggtaaaaggccccattgagtaaaaccaaacgatttaaataactttaggcttggaatattatggccaaaaatataagccacgattgtattaactgctaaattaggcaattgaccaataatgaattccatggtttttgtaccaactccttgtttccgcaaccgttgatcaaggtaaatagcaatttcactagtatgattatatgctggacgaccataaaaatgttcaagggccacccacccgagaacctcattttgatgttcaattacccagattggatgattttcgtcaaatgcttcaaaccattctttgcgttcgtcaaccgttatcggggtgagatctgcagtcgctaaccgtgatggaataatttgattataaatttcaacaattttgggtaaatcttcaagtgtcgctttgcggtattgtaactccactatactttcctctaaaaaatttcctgaactaatttttctgaaccattcgaactaacccaatcatcatacttaataaaattccgattgatgctagcaaggtatatcgccgtaattgttgattttcttcagttaatagttttatttctcgtcgcatagcttttttcttcactgtaagcaccgccttcgttaattctaacaagatcatcatatcatattatttgcgattgcttcttaatattttatctttatcctgttaatgactacataaggaagtgtgtagagggtatgatttttaacgatattattagcattttattattttgcgcgtttgcttatctttttaattttaactttcaccgcgataactatgcctatgctattgtgatgtttatcggcataatggtattttatggcgatttttaccatcatctcccaatcaactggaaattgtatattttacttattgctacttttttatgggctttattcacaatcttcatggggagacaagcattaattaaaccagctcaacgtaaacatttttcctatgcaacgattattggaatttttgcaattattatcacttttatcttcaggattattctttaaaaacaataagggagcatgatcatgaagtcgtatctggcttctatcacgctcccttattatattgctagcaatcgtgtgctcgatcaatttgagaatttaagtctgtattactaagatccagaacttcaagattatctgttaaaacgcgtttaggactgacaagtggcattgtaaagtaacgcgggttaaaccttacttccatttcatcatcaaattgaactgctgtatggtctttaataaaaacatcccctaaattagaggtaatcttttcattataatcgggggtatctaaatcctctttgacaaggattagtcgataatcaccatctaaactgcaacccccaacggcagaaaatggaccaaccccatcatcaaaatctaggagtatcttcttagatgacagttcataacgctgtaaacgttcgatagcttgatcagtaaatgtgatattcattaatatcaaccccatttcttaaaatctgtacttatattttaactaattaagaataagctttgaaatttaaagctcaaaaaaactgagaaaaatcgcaaaatctttctcagttttttaaattaatttatttattaaccttcgaatgcatcagtcaaaggaggaacaacttgcttcttccgtgatacaacacccggtaaattcatccgcttgttttcgttaagcttcttaccaaaggctgcttcaaccttttcagcaggatcaccaataactaataactctgagtcactgtttaagatgttagtagcgattaataagaataaatcataattgttatcatccatcatactttgcatttgactttcaagatcagcttgacgagcaaaaacatcatctaaatcaacggtgttaacttgaccaatacgaactttcttgccgccaagttcaaaggtcttagcatcaccatcaacgatatcagcatcagacttagcaccaaggttagtaccagccttaagcatttcaatgccgtacttttcgtaatcttcaacaccagcgatctttgctaagtacttaacagcttcacgatcgtggtcagttgtagttggtgacttcaaaagcaaggtatcagaaatgatagcagaaagcatcatcccagccaagttagcgggaatattaatgtgcttttcttggaacaattctgtaatgattgtacttacacaaccgtaaggacgaacagttgcccagagtggttgagccgtttcaaagccggcaattcggtggtggtcaactaagtgcgttacagtgaccttgtcgatatcattaacactttgttgtggttcgttgtggtctacaagcattaccttatctacttcgtttgcagcggtttcgattacgcgtggtgcttccataccgaaagtcttcaatgcaaacttagtctcatcatttggttcacctaaagcaactgcttcagtttcgtatcccaattgattttggaagtatgaaaatgccattgcagcggtaatcgcatctgtatcaggcttttggtgtccaaatactaattctttgctcatataaattcctcctgtttgttcactactttaatcttagttatttctagtaggtgaaacaatctacattttctattctatcatggaagttaatagattaaagaacaattattaaatatctttcctattatgaataaaatcttttaagatctgccacatttgttcatgctgactgttaaaaaaacgtggtggttctttatctaacgaaaaatattcagtagttgtcgtttctgtaattttgggctgataatgcttagcgctactttcttcaactaagtaaaaagcattaactggttgaacgcggtcaccattaggataagtgtaaaaattctgatcaaaaattgctagtcgtttgacaggcacgacttcaattcccgcatcttctttaaattcccgctttacagtttgctcaaaagattcgccaaattccatgtagccgcctgggaaaccccaatcaccagtgtccgcccgttcttgaagtaaaacagccttctgcttgtttaagagtgccccagaagcactggtcattattaagggacgattcccaactaaatcacgaatttctttaatatacgccaaacttttcgccttcttttaattttggctaacaggttcttcggataaaacattcgtttgtttcattcgaagttttattggttccccttgcgtatcggtatcaattacaaaagttccatttgacttaatcgaacttagatgatggtcagtagccattatatcttggaatgctggccggttagtaatagtctcaaaagcaccttgataatcatggtcgtaagcaaggaagtctgcaatttcatgaggatgtgatttcaaccgccgaaggacaagttcgccccgccgtgctcgtgccccaacttcaatctcatcaactggcatttccttaaatgcacctcgttgagtaattacagcaatatcttgaccatccttaaccaagatttgatctgctacttggtcatcatctttcaaattaatggcccgtacaccagctgtccggattcctgttacaggaacatctgcaacatcataccgcactgcatatccttggcgactaatcgtcaatagtgaacggttctcatttgttggttcatagtaatcaacatttacaacttgcgcattatccctaagcttaattgcgacacttgcatggctcttgtaacgtgaaccaggcttatagtcattaaaggccgtttgctttacttgaccatcgctagttcccatgatgattgttcctggctgatctagtttatcaaaaatcattgctttaatgatctcttcattatccgctaaaccgattgtttgtgagatatgttcgccggtatctttccaccgggcatctgcaatttcatgaattgggcggtaaataatatgcccaagattggtaaacataaataaatgcgataatgtatttgtttgttgaatcaataatgggtaatcgtcttctcggagaccgttttcttctgcctccgatgccttgaaggaacgaatgctgcttcgtttgatatagcccgcatgcgaaactaagaccacaacatcttcgttggcaaccgtaactttagtatcaatctcaagtttttcaacaagattttcaatcttggtccgtcgtggattgccaaattccttcttaatggccctaatttccttagtaagaacttttgctagctcattttcgttagtcaagattaactgatattcattaatccgtgaatttaattgttcttgttcttttttcagctcagttacatccgtatttgttaagcgataaagttgcaaggtaacaattgcttcggcctgttcaggtgtaaagttgtattcttttactaagttttcctttgcatccttacgattcttacttgctcgaatcgttttaatgaccttatctaaaattgagagtgctttgattaacccttcgacaatatgcaatcgttgttgagccttcgttaggttatattgtgtccgtcgacgaataatctctttctggaattcaagataggaagtcaaaattcgcttcaatccaacacgcattggccgctggtcatcaatcgcaaccatattgaagttatagttaatctgtaaatcagtgttctttaataagtaattaagaataccgttcgcattagctccccgctttagttcgattgcaattcgtaatccactacgatcagtttcatcgcgagcttccgcgattccctcaacttttttggcaaggcgcagatcgttaattcgcttaactagttgcgccttatttacttcataaggaatctccgtcacattaatttgttgacgatcaccccgcaaggtttcaatctccgtttttgctcgcactacaacccgaccgcgaccagtctggtatgccttacgaatgccatcaatcccctgaatgattccaccagttgggaaatcagggccaggaataaattccattaacttatccaaagaagcagttggatgcttgataagataaatcagtgcatcaagaacttcgcttaaattatgtgttggaatctcagtagcatatccagcagaaattccagttgctccattaacgagtaagttaggaatacgtgctggtaaaactgtcggttctttttcagtatcatcaaagtttaaggccatttcaactgtatctttgtcgatatcttgaagcattaaacctgctattttactaagccgcgcttcagtataacgcatggccgctggtggatcaccatccattgatccattgttaccatgcatttcaattaggggttcacgtaatttccaatcctgacttagccgaactaatgcttcataaattgaactatcaccgtgggggtggaagttacccattacgttcccgactgatttagcagacttacgaaaccctttatcataagtatttccatctttattcatggcaaataaaatccggcgctgaaccggttttaatccgtcacgaatgtcaggtaaagctcgttcttgaataattgattttgaataacgcccaaaacgatcacccatgatctgttcgagcgtcatatgttcaatttttccgtttctcacaaaacttgattcccttctctatttattccatgtattaattgtaggctctttagtttgaggtaattgtcctttattctcaactaatttatcagattcttgatcatcggctaacgtgaattggacattttcttcaatccattctcgccgtggttccaccttattacccattaaggtagttacacgacgctcagctaattcagcatcctcgatccgaacttggattagtgtccgagtttctggattcatcgtcgtttcccacaactgatcagcattcatttcaccaagccctttgaaccgttgtaattgtgctcccttgcccatctttttagtcaattttgttaattcttcattagtccacgcatacgtgatattagtcttagctccacgtccgcgttgcaagcgataaagtggtggaagagcaatatagatctttccagcttcgatcattggccgcatatatttgtagaaaaaggtaagaagaagaatctgaatatgagcaccatcatcatcggcatcagtcataataataatcttatcgtagtttgaatcttcaacgttaaattcagaaccagcaccagcaccaacagtatagataattgtgttcaattcttcgttttttaatacatcatctaacttcgccttttctgtatttagcactttccctcgtaatggtaaaattgcttggaatttacggtcacgcccctgcttggctgaaccaccggccgaatccccttcgactaggaataattcatttttcttagcattttttgattgggccggagtcaattttccagaaagattgcgttcttttttgccctttcgtttaccaccacgagcttgattacgggctttacgggcagcttctcgagcttcacgcgcctttaatgccttacgaattaacatctgagcaaagtcgccattttccattagggcatagttaagctgctcactgacaatcgcatcaacaatcttccgtgcttcaggagttcccagtttatcctttgtctgaccctcaaattgaagtagacgttcaggaatccggacagaaataacggctgttaacccttcccgaacatcactaccttctagatttttatcattagcctttaacagcccaaccttttttgcgtattcattgaaagttttcgtccaggcactccggaatccggcttcatgagtaccaccatctggagttcggacattattgacaaatgataacaagctctcagagtaaccatcattatattgagccgctacttcaacttcgaccccatcttgctttccgtcaaagtagagcgtctttcctaaaacgtccttaccctcgttaagataagaaacgaattcttgaattccattgtcaaattggaatacatcttgtttttcttgaccagctcgcttatcggtaaggataatcttaatccctttcaataaaaaggccgactcacggagccgattagctaaggtattgtagtcataaacagtagttgaaaaaatcttcgggtccggcttgaatgagacggtcgttccgttctcagctttagtttttcctaattttttcaacgttccaactggttgaccgccatccttaaaaatttcttggtaacggacgtgatcacggacaattgtcagcgtcaaatgtgatgataaggcatttactacggaagctccaacaccatgaagccctcctgaagttttataaccatctgactgaccaaattttcctccagcatggagaaccgtcataataacttcaggtgtcggcttaccggaagcatgcatcccaaccggcatcccccgaccatgatcttgaactgtaatcgcattgtctgcttcaatggtgacgttaatctcatcaccataaccggataatgcttcatcaacggcattatctactatttcatataccaggtggtgcaatccacgtgagtcagtagacccaatatacatccctggtctttttcgtactgcctcaagcccttttaatacttgtatggatgaggcatcatattttacttcttctttggccacaaaatgacctcccattgccaatattatacctaaacgtatgttcggaaaattattttaccatttacatttgctaattgtaaagctaaaccggccacaatttcaattcataattaaaatgatactgaaaacttagtagattggcaaattgtgtcgttagtgtaagattttcataggttggatgaataattcatctggtcgtggaaatcttttttgtagaccaatttacttatttacaaaaaaagaaaagaccagtagcctttagtgtgtcgaatactaagcaaaggcaggtctttcctcatggatattttaacagaaatcgagcagaatttggtgaaatcaggcagtttatttgaagctgaacagattattttaaaaggggtattggagttaggacaagtaatcatgcaaaactttttggaaagcttagatcgaagcttaaagtcccaagctccagcgaactatcaagtaattaataaacagccacggacgcttaattttatctttggcccggtgacttttcaacgacggtattatcaggctgggacaaagaaacgtgaattttacttagaccaacaattaaaaattaaaccacgtcgtcgtttatcgccacactacttaatgatgatggctaagattgcccaaacaactacaatgcgcaatactgccgacattttgaaccttgtatttgacagcggaattactgccgattcggtaatgcacgccgtgcatgagttaggaaatcaggtagctaaacaaactcaagcaaaagaacaccaagctactcctcgccatatgcctaaaaatttaactattgagggtgatgcctttatgattaaaggtaaaaaagaagcaggtcagctgactcttgtgcaccattatcgggtttatgagcgagtagctaatcaaatcattaatcggcatgactttctcagtgttgggcaccaaggacggcttgaagcacgactaagtgattatttagaccgccattataagcttgccggtcaaacgatctttttggccagtgacgctggcccaggttacgaaccagctaagctattaagtctagttcctcaaagtgcacatggtgaatactttctcgaccgctatcattgtttgcagaaaattgaacatactttaggccggcacaacgaattagccatgcgagcaattaaagccgttcgtcatcatgatcaagcagagctaacaataattttagatacttatgaatcacaaaacctaacggaaaaacaagcagatgacctaatgcgtttaagaaagtatctacagcgaaattggcggtatatcctctcaccacaaatgcgtggatttaaggatattcatttaattggttcagtcgaaagttctcaccgggcttttacttaccggatgaagaaacagggcaagtcatggactaagcagggggctaaagccatgattggtttaattgaagcccgaatgaatggtgaactgcaagctagtttaaatataatcctagaacaattaacagttcttcctcgagtggctcaaaccagcctattacaggaaatgcatattcgaactggagagtttctaagaaaggcaccgacaaagccgtcaattggagcagtacaaggaataattccgattaacacggccacaagtagaccaatgggacaactttttaaggcactaacccactaaaactgtatatttaaaggctacctatgaaaacttgacagatacaattgtgtcttcctagtggttaaaattaaatattcatgctatgcttaaaagctgtataagctattattaaggagctatttatatgatttttgaaattattgggatgattattattgcttacctcttaggttcaatcccaactggcctctggatcggtaagtatatttatcataaagatattcgcaagttaggtagcggtaatatcggaacaacaaatacctttcgaacattgggatttaaggcgggcgtcgttgttttggttatcgatattctaaagggaacactcgctgccagtcagccatactttttagggatatctggaaccgttaaccccctattgatcggactctttggtagtcttggtcacactgtatcaatattcgataattttcatggcgggaaagcagtggcaactagcgcggggattctcttagcttataaccccctcctctttgttgttgcctgtttgatttttatctttgtcttatgcttgacaagtatggttagtaccgccagtatggtagggattagtgcaattttcattattgccctcttcattcatgcttggattttagcaatcgtggcaggaatattaacaggagtggtcttttaccgccaccgatcaaacattcaccgaattttatcaggaaaagaatcaatggtaagttttggccttggctattatttacgagaaaagaagctaaataaataggagactggaaatggaaagtttcacagtctcctattttttcgttaaaatggcttaatactaaaatgataattatctgtttcatttggtgctagacggtgcatcccttgcttatggaggaggagcccatcagccttgacattatctgctattccccaccatggttccacacatacaaatggagctgtacttggatattgcgaccaaactcccacgtattctgtattaaaagtatcaactacgaccccgtgattagcaacagtatccgttaatttggctgtaaaatggccgccatctgttttgaaaataatagcatccttattaaaaagatcatgattaagtgataatgaatcctgcatattaatcaattgtggatgagctgaatcgttataggcgccatctaaaatgatccgtgaatattctgttgccggtttaacgcttaattctgtttgttcaaaactcccagtactagttaacggcatattaaaaccaggatgtgctccaatggcatagattaaggtttcatctccgctcgggttcttcaccacatagctaatttcaactttatcaataactaattcaaattttacttgaagactaaatgaaaaagggaatgccttcttagtttcactatcatcatgctgttccatcacaaccatcgatggtgtttgctcaataacttggaattttcgatcacgtgcaaaaccatgttgtgtttgatgataagtttggttgccatattgatattgatcatcttttaagcggccaacgaacggaaagaggattggtgcttggcgattccatgaagcggggtccccctgccataagtattcgattccgttatcctgccgtttaatactatgtagttgagcacctaattcatcaatttttacggttaattgttggttttgtaaagtaatcattgttatcgatcccttcaattgataatcgtttaacattaagtatataaaaaaggttccaaacgcacaatagcagattttggaacccttttcaataaatgtttaagtaaaactcagtaaaaatgaagtagagtttttacttctgaacttcttcttggtagtctccatttggacagacaacctgtttaccacccttgactttcttttcaacaaggaagtgcccatccttaggacaattacgtccaatcggtttatcccatgaaacgaagtcacaatctggataacgggaacaaccatagaaagttcggttcttctttgattttcgttcaacaaccgttccttgcccacactttggacatgtaattccggtatcttttacaatcgccttggtattccgacaatttgggaaacgagaacatgcatagaacttaccataacgacccattttaataaccattggggccccgcaaatttcacaatctgtgccagcaagctcatctttcatctcaatcttatcaacctcttcttcagctgcatcaacttcttttgagaatggttgatagaatttatcaacaacattaatccagttctgcttaccctcttcaatctcatcaagtttgccttcaatatcggcagtaaattggacattgacaatatcagggaattgcttttcgataattcggttgacaatttcacccaattcagttggctcaaagtggcgtgatacaaggcgaacatagtaccgtcgttgaatcgtatcaagggttggcgcataggttgatggccgaccgacgccattttcttccaaggttttaataagagccgcttctgtataacgagcaggtggctgggtaaagtgctgagctggatcgtcctttatcatttttgccttgtcaccttcagttaattctggcaacaagttatctttttcagttcctcgcttatatactttcgtaaacccagggaacttaacttttgatccatttgcacggaaatcgaccccattttgctggaggttaacgctcatcgtatcaattacttccgcagtaatttgactagccacaaaccgcgaccaaatcaaattataaagtttatactggtcggaggttaaatattgcttcattttagctggtgtccgatagactgaagttggccgaatagcttcgtgagcatcctgggccccttcaggtaattttcccttaaccggctttattgccgcatattctgctccatagttttcatgaatatagttagacgcttcatgcttagcaattgacgccacccgagtcgagtccgtccgcatataggtaattaacccaaccggtgctccttctttaatgtcgatcccttcatataacatttgtgctgccatcattgtctttcgtgttcggaagttcaaacgacgattagcatcctgttgcatggtcgaggtcgtatatggtggctgtggttgccgccgacgttcttttttagtcaccttagtaatatcgaaatctttctttttatcgattttagaaaggactgcctgaacatcatcattattcttcaaggaaaccttcttaccattttcaccgtaaaaactagccttgaattcttctttgcccttcttgaaatcagcatcaattgtccagtattcctctggtttgaagtttttaatttcattttcacgttgaataatcagataaagggcaactgattgaacacgaccagcacttaagccctttttgactttcttccataaaattgggctaattgaatatccaactaatcgatctaatacccgtcgtgcctgctgggcatccacgagatccatattaatctctcggggttccttaaaagcttctttaacagcatctttagtaatttcattaaaggtaacccggttcttttgatcatcgtcaagctttaaaatatttgaaacgtgccaggcaattgcttccccttcacgatccgggtcagatgcaagatatacggcttttgcatttttaacgtccttccgtagttccttaattacatcacccttccccgaattgaaatgtaatcaggggtgtagtcattttcaatatctacccccatccggctttttggcaagtcccgaatatgacctaaactagccacaaccttataggaccggcctaaaaatttaccgattgtttttgcctttgatggtgactccacgatcaccagattttttttaatttttgaacggcgacgagttgtctttttcgccgttgatttggttgttttggttgccattctggtaggctcctaacatttttaatatttcattcaataatattattaatccatttgactaccatctgtcaaatataatctctaattgaacaaaatattttaatcaacttctcaccagaaatcaagcccttgaatcgtacagccgaaactcatctagcagatcttgggcgctgagaattggtttcgcgccagctgcgattaaactgttacatcctactgataagggagcatcaatccttccaggaatagcgcatacagaccgattttcatctaaaccgatattagccgtgattaaactcccactccttttctttgcctcgacaaccaaaaccacttcgcttaaacctgcaataattcggttcctttctgggaagtgataagccacaggtgattcaccccgcccatactcagaaattactaatccctgtctggcaacctcatcttgaaggacttggtgacttcgggggtaagcttgatctaaacccgtcccaatcactccgatagtaaggccaccatgttttaacgccagttcatggctaaaaccatctactccttgagctaaaccactgattactactatctgccgcttaattactggtggcagcaatcctcgtaaagcgctctgtccataattagttatctgcctagtgccaacaacaccaattgaaggctgatggagcaagctcagattaccacgataaaacaataccaagggcggacagtacgtttctttcaaggtgatcgggtataacggatccgcaattgtaataaatttttcctgactgtttaaggccactgcttgatcaagctctggacttgtccaattatttttcaatgacgacgcacttcgtaagctaacatttgcatggtcaatcaaatagtcaatattattaaagcagcgcgcctgttgagcacactcccatagacgatactttgaaactaagccaattccgcgacataaacttaaccgtaatagaaaatcgtttacttgtaacataaaaaagcctccctatatttatatacgaaagctttttgaaaatgcattttttaatttaaatattttggaacgggattaaaagaacgccgatgaataggagttgcccccattttttctaagccggctaaatgttctttggttccataacccatattttgtgcaaaaccataccctggataaacataatcatagtcccgcattaggtgatcacggtattcttttgcgacaatactggctgcagcaacgctaatactcttttgatcccccttgatcaaagtcgtctgaggaatatcaattgctaacgggacagcatcaacaatcagatgatctggtcgatggtgaaggtgattaactgcccgaatcattgcatcctgagtagcagcataaatattcatttgatcaatcactggcgcatcatttaccgcaatgctaacttcaaccgcctcatcaacaatccgtaaatacaaattttctcgttcatgcctagttaactgtttggaatctgttacccctatcaggtcaaaatctgcatttaaaattactacacaagtaaccaccggcccagccaatggtcctcttcctacttcatccattcctgcaacatactgatatcccttttcccagtagtacttttcatatttaaaccggttattgaacgcctcttcagcttccttctgccgtgcaagccgccgttcaaattgctgaattgctgcttgaacaccttttcgcgaatcatcacgaatagtttgcaagtaaggatcagttgtatctgtgatagtttgtaaacgggccttaatttgactaatggtttccttattcatttagtccatcctcatttaggtcagcaggtacttccaaagtgattggtcctaattttccctttcgcaagtcaaaaatcaagcgttcactagcccggtcataatcatcacgaaagcccattttagcagtaatcgttaatagtaaatctggattggcaaccgattcgtccagatctgcatcagttaagtggtaacgttgctttaacatctctggctgatgttgccgcaagtaatcaagggcaaacaacgctacatcatcctttgcatataagctatctttaattgctcctgttaaagcaagcattatcccctgcttaggagtagcaaatttatgccaaaggacaccaggagtatcaagtaattccaattctgctgatgaccgcaaccattgctgtccagtagtgactccgggacggtttccagtagccgcaacgttcttttttaccaggtgatttaaaagagttgatttccctacattgggaacaccaacacacattgcccgaattggcctctttttcattcccttggctttttcttctgccaatctatcttttaatatctctttacttttagccgttacaacttttgccacgttattttggcgtgaatcgagagcaagaactggttgattatgttgctcaaagtatttaatccattcatttaatcgtttctggtctgctaggtccgtttttgtcataattaaaagtttgggcttttctcctgcagctagtgccacttctggattttgtgacgaataggggacacgagcatctactagctcaaacaaaatatctactagtggcatttgttcacgaatttggcgtaatgcttttgccatgtgtcctgggaaccattgaattgttgccatttgactttctcccttcttttctaattcattgcatcaatataccgttgccaagcttcatcaaaaattgtcattgatggcaaatagtcagcattttcttccaaataatgcgaaatttcatcaaaatcctctgaatgcttaggaaaagtagtatccaaaaaagcgttgtttgcaaattgttgaacttcatctgcactattcggatttcgttgagtcattaaaaactgataaaaactcattctcattttgatttcctccaatatttattcattacttgttgggaccgtgattaaaaacttaaaccgtccttcttgcatgttaatttcctgagccgagtacttaagagaacggtgcttgctataacggttaaggtctaataaaactgtcttcttttgtgggttaattgttacccatttaggaatattataattctttgcaatgtaacccatcacaaatttgatcgggatatttaaccgtccaactgaaagtcccttagcccgcaacaagacatttccgttacttagtcgttcaggaataaagttaatggcaaatcgcaccttagcccctagaaacttagtatttcctgtcaaggtagcatactgatcgccaacaataaaatcataacggatcttttgcccttttaaaaactgattcaggtaattagcagctaaagcattcacctgttttttattcaattcaaccgttactgatgaatcgcttggctttactgctttgctagttgtagtagcaggagtcggtgcagtcaccttgtttaacacaaccccacagctaattacaatcaaggctactaagaaaaaaaagccccatttccaccaattagtcttttttcttcagaatttttcatttttacctccgtgtgaattcccagctatcatgtttttgcattaccttaaataattggtcagcaattttgacgtatcccgtatgattaggatggaaattatcttctgttgaaatatatttattaaggttcttatccttatgattcataatttcaatgacccgcttttgactgacttgcccttgattagccttttcttcttccttgaccagctgttgttgctgactcttagtctgatattgaccgtatgacatcaacttattaatgttcacaaaatacattgacttataattattcattgtatcttgcgtagtttggttccattgattaattgacttgttaataattgttacatctgggaaatagatatagaagggattataaatactcatcacaaaaataggagccttaggattttcctttcgaactgcatcaaatagcttaattaatttttttgataagtcttttcgccactttcaacactactggtaacttgccgttcagagcccattacgtttttttccaagatctgcatcaagtcgttcccaccaacagtcatcgtaatcacatccgcgctctgtaagtcactacgtaattgagattgctgatttaagcggtcaagaatctggtcggatcggtcccctgttaccccgtaattgactgttgtcaccttagtttggtggtaacggtgttcgattttttccttaattaccccaacgtatccaccattattactctcatccccttgaccgtgagtaagggaatcgcctagtgcaaccagctttacatttttcttttcaacatactttggtgtaacaacttttgaactattactagttaaatttgtaaagtggttaacagtataccatcccccaccaataatcataatagccaaaagcgataataatagccatttagtccactttttcatctattctatagtcctttattttaaaattttaagaagatagaggctgggaaaaatttccatttttctcagcctccacttatttttatcaaagattattctgtatagtatagcaaacaacaagcacccattccagtgtgagttgcaataattggcactgtctctcgaacagtaacctcgatttctggataaaattcttttatttttgctaataagcgttctacttctttgccagcatcgacatgagaaattccaattcgcttaacttttggtccccgtgccatttcatctaaaatcttatcccattccttatgcattgatttaatgccacggccttttgattcaatatgaatctgaccgtcatacacatggagcataaccttaatgtttaataggttagaaatagcaccagcaaatttactaattcggccaccagcaactaaattatcaaggttatcaattgccaagtaaagttcagatttactaagtacttctttcatcttagcaattgcatcttcaacgctaccaccagcttcaatcacttgggctgcttcaattatttcgaagcccattacttggtcggttgactgggaatcgtagactgtaacttttgtctttgtcattccagccgcttgttcagccgcatggacggtcccactaattgattccatcattgtaacgcataatacttcgctaccatcttcacctagcttatcaaaggcatctacaaacttcccaattggtggctgagaagtctttggtagtgacttagcattcttcatcatttcagggaactgttcgtttgtaattgtttcacgctcaacgtataccgtcccatcaatcattacacttaatggtataattgtaatgtcatattttttaatttcttcatcagttaatcctgctgatgagtcacaaacaatttttatctttgccatgaaacttaccactcttcctgaacaatttgtgctataattatctagtattgagaactagataatttatttcaagtactattatactcaattttatctaattttgtaggatcaattactatttatttagtataacaaaaatattttaaaaattcattggtctttggaaagaggttttttgatggatagacaaaaagagacaagagatcggcgtactttgctgatagaaataggtaatgcggttactcatgggattggagcaggactatcgattgctggcttgatcttgttaattatcagagctgttcatactggtagtcccatgcgaattgttacctttactatttacggaagtgctttaattcttttttacctttcgtcaaccttatttcatgccttgatctttacacgagctaaacgggtctttcaaattctcgaccattcaatgatctttgtgcttattgccgcgacttataccccctattgtttagttagtatccgcggctggttaggctggacaattttcggcgtgatttggggcttatctgttattggaatcgtgtataaatgtatttggttaaaacataaaagtaaatattcaaccattatttacattctaatgggctggctatgtctagttgccttcatgcctctctggtatgcgcttggtccagttggcttcggattgcttttactaggaggactttcctttactcttggcgccctcttttacagccggccaacggcatatacccatttgatttggcatatttttgtcctcatcggcacgatattaatgtacttttcaattcttttatacgtttagttcccattcttcaaaacgacaaattagctggtcatctttttcataattattgtggtttactaagtgccaacggtcataatcgatcgttggcatttttgtatctccaacaatttgcttatttatcaccgttcgtgttagctttgtcgccattgggagtaattgctgatagatcgttgccccaccgattacaaaatattcgtttggatttgctttaagatattctttaagggcagctaaagaatgaacgactttcactccttcagcatctatgttctgactggtaagcacaatattttctcgcttaggcaacggtttattgccaagagaagcaaaagtttttcgccccattataattgggtgaccagtagtttttgtcttaaaatgcttcatatcagcagaaacatgccacggaattgtattatctttgccaatccaaccattcaaatcttccgcccagattaaattcagttcactcattttgaaccactccttttaaactgctacgggagccttgattgccggctcataagtatagccttctaatttaatatcagtcatttcatattgatcgattggttttggttcagcaggtaaaatcaatttaggagcttcatgaggtgttcttgtcagctgttctttaacttgatcaaggtggttcagataaatgtgagcatcccctaatgtatgaacaaactcgccaggttctagaccacattgatgagcaatcatatgcgtcaataatgcataactagcgatattgaatggaactcctaaaaagatatcggcgctccgttgatagagctgacaactaagctttccatcattaacataaaattggaacattgtgtgacatggagggagagccatggaaggaacatcttctggattccaagctgaaacaatcatccgtcgtgaatctggagtagttttaatctgctggataacattagcaatttgatcaattgtgtcgccttgactcgtcttccattttcgccactgacttccataaacaagccctaaatcgccatacttttgggcaaaatcatcatcttcaagaattcgctgacaaaatgccttcttttcttggagatagacctgcttaaactctggatctttaagccagcggtgaccaaagtctgtcatatctgagccttgatattcagcactttccacccacttcttaaatgcccattcatcccaaatatgattcttgtgttgaagtaagaagcgaatgttagtgtcacctcgtaaaaaccatagtaattcactcttaatcaagccaaatgggactttcttggtagttaaaataggaaaacctttgcttaagtcaaaccgcatctgatatccgaaaacagacttagtaccagttcctgtccgatcacccttttgatgtccattcgtcaaaacataacgaattaagtctaagtattgctcttcatttatatttgttgccatccttatgttcccttcctttactcgtcaacgtatgtgcttaaatactcccaacgagctgtcttttcatcaattttttcttgtatttcatttagctgcttctgtaacttagcaattttcgtataatcgcttgctgcttcagccatttcattttctaattgctgatgctgttgatcaagggcgtctaattcttcatcaatatgatcccactcgagttgttcagcataagtaagttttgttttttcttttttggctggttcttgcttacttgcctgctttttagcaagggctttttgatcatttttaagctctttatccttatctgcttcttctttttagcagttaaataatcagtaaagcgtcccgtataacgctcaatatcaccatttccattgaagactagcaaattgtcggccactttatctaagaaataacgatcatgagaaaccgtaataacagttcccgcaaaattatctaggtaatcttcaagaactgtcagtgttccaatatcaaggtcgttagttggttcatctagtaataagacgttaggctgctgcattaagatttttaagaggtataatcgtcgcttttcacccccagaaagctttcggatcaaagtaccatgcataaagcgagggaataggaaacgttctaataattgggtaacgctaagcttattaccatctttatcagtaacattatctgcaatttcagacaagaaactaatcatccgcttatcattgtcaattccttctgtttgctgggtataatatcctaacttaacggtttcaccaatcttaaggacaccactatctagagggacacgttgggcaattacgtttaataaactcgtcttacctgccccgttttcaccagtaattccaattcgatcacctgcctgaacaagccaattgaagtcatggaggatttgatgattatcaaattttaagttagcatccttaaattgaataacatctttccctagacgttgtgatccaagattaatagcaatatcttcatcggttttaagattacctatttttccttctaattcgtggaaccgattgattcgccccttttgttttgtggaacgggcttttgcacctgtccgcatccaggctaattcttttttatacagctgttgattctttttctcagtatctttagctaattctactcgttccgccttttttgctacaaagtcctgataatttccctcgtagtgataaagtttaccaaaagatagttcccagatatgatttgtaatttgatcaaggaagtaccgatcgtgggtaacaacaaggacggcacccttataactacgaagaaaatcttggagccaaactaccgaatcgaggtctaagtggttagtcggttcatccagtaataagagatctggctgttgaattaagacttgtgctagcccaacccgtttcttttgtcctccagaaagttgagcaatcttttgacttacatcttttatctttaactgggtcagaatcgtcttcacccgactatctgcttcccatgcatcttcttgatccattcgtgcctgcatttttgtgtaacggtcgattgcttgtggatcttccgggtgcttcgtaaagcgttcaagcgccagctcatattggcgaatcgtttcaaacactggttgtttaccttcaaaaacagcttccatgattgttttattttcatcaagctctggttgctgctttaaataaccgatcgtataatcattgggtttagtgatctgaccgccaccttctgggtttacttccccactaattacgttaagaagacttgttttcccgcttccattaacaccaatcagtccaattcgatcattttcattgataataaacgaaatatcatcaaataaggtcttttcaccgtatgtgctggttaggccctctgcacgcattgtttgcatattatccctctttcgttatctcttctactttttctaataaggttgttgcatcgttagctatttcgccatttactactgccaacgttaattgctgaagaatcttccccatcaatggtcccggttttacccccgctttagtaattaatattcgaccatcaattgctaattctttagcgtttttaattggtaatttttgataagctttttgtaattcctcatcattaattgcccatccatataacttagctacttggttagcatcatggagggctgtttcaccggtattaaacattagtgttggcgtaagcgtacgttgacgaattgcttggactgctggaactacttttttgacctgcgcaattaaatcatttgctgtcttccacttctttaagaatttaccaatttctttttgatcaagctggagctgtaagctcaaaactgaccacaattgggcctcattttccaaatgccattggttaaggattaataaagccgataaagcagcttgcgcattttccaaccctggacaatattggtacaatccagtcgcaataaaatcttttaaacccgctactggattttgacccagcaatagtttttctagttcaacccggattcgttcaactgcaattttttctaataatggtgcattttctttaatcccttttaatgttgcagtatcaatgacaaaatcaagcttacttgcaaaacgcacggcccgcatcatccgtaaagcatcttcatgaaaacgttcattagggttgccaactgctttaataagatgtttttgcaaatcttctagtccgtcaaatagatcaataacttccccatcttcccgtaaggcgagggcattaattgtgaagtctcgacgctggagatcttcacttaatgaacgaacaaaagtcactttatcaggacggcggtagtcttggtaacctgactcggttctaaaagtagttgtttcatatcccgttccatggtcgagaatcataactgtaccatgttcaattccggtatcgacagtatggttaaaaatcgcctttatttcactagggtaagcactcgtcgctatatctatatcatgaatctcatcatgcaaaatagtgtcacggacacaaccgccaacaaaatatgcttcgtagccggcctcctctattttttgtaaaacagggcgtgctggttcaaatatagctggtaatttttttattttcatttaatcatgtcctcattttgataatcaaagttgattataacaaattaagttactactaaaaagagacaggaagcgtaaagaacggctaaaagcgttaacgtttcctgtctcatttaaattaaaaattatttgtaatcttcatattggtcataaagatcttgcatttcagtgtctgttgggactaaccagagatagtgttccaattcatccattaacttatcagtttcaccagtttcgcggtagtaattaattaattcttttaagaatgttggattttcactgtatgccggcaaagcagcttcataatattttccggctaattcaagctgatcagttcgttgatatgaccgcgctaggttccaatataattgtggatctgtttcatcttcttttaccaatggactcaggagcttaatgtttgcctcatcatcgtgttggtgaagcaagaaattactatattgtaaagtaatcgtcatattctctggagcaagttcatgcgcttttaccaagtatttcttcattaacttttggtcaccaaggtagctggtaatttcagctgctaatgaataaaggtattcattgtattgatcaacactgagcccttcttggataactcgtaatgcctgctgatacttattttccttttcatatgcctttgctagttcaggataagcagacgcatattggttatcatcattgataagatcctctaaggtttttattgccttttcagtatctcctaattgaagtcgggtcaaccccttttggaaacgaatatcactagtctggtattccggtttaacctgattgaagtaccctaaagccttcttaaactgaccgctctgagcgtaacaaatccctagacgtccagcgatatcaacttttgcaaagtcagtatacccatttttaattagttggaagtaatattggattgcttcagaatattggccaaccataaagtaaaattcaccaagcgcaaattcaacagctggttcatcgggagccaacgcgtaagcttcttttaacttttcctccgtcacttcaaattcttcttcggtttgatataagtccgcggcaaccagtaatgattgaacataagctggcgagtctggtttaatctgggctaagtatgataaagcttcgtcattatgtccttcatcaattgcaatcgtcgctaaattagtctttaattcatcttcatctggataacaatctaataattttaagtaaatcgttcgtgcctgttgaagaaagcccaatgcgtacaattcctccgcaaggctaaataacatatcatcatcatcattaattagtgcgagtttaaatgagttttgggcttcttttaattttcctgcttctaattgatcaagcatttgttctgagtaggtcatattatgccctccttttactatcacttttaaatatatcacaatcgatgattttaagcattgaacaagtctttaaaaagaaaagagactgggaagagtaaattctttcctagtctctttttaacatttaactgttaattacttaacagcgtcctttaaagctttaccaggcttgaatgctggtaccttgcttgcaggaatgttgatttcttctccagtttgtgggttgcggcccttacgtgcagcacgttgacgtacttcgaagttaccgaagccgatcaattgaaccttttcacccttagctaaagatgcttgaattgaactgaaaacagcatctacagctgcagtagcatccttcttggttaagccagttgcagtagcaacattgcttactaattctgctttgtttgccatgttgtttcacctcccacaaataacgagagtgttaaactcacgtctgtgaatgttaattttgagtggtccaaaattaacgaaataactacgagaagttcgtatcatttcattgttaagattagcatagtgaaagcctgctgacaagcggttttctcaacttctagccgcatttttaatgttttttcattttacaatgaattctttaacttttactgccgttgacgcttgattaaatggatcggtgtaccagaaaagtcaaatgccttccgaatttgattttccaaataacgctcataggagaagtgcattaactctggatcattaacaaagataacaaatgttggtggttcggttgcaacctgtgtcccatagtatactcgcaaacgccgaccattttgtgttggagtcggattggcaacaattgcatccattaaaacatcatttaagactgccgattggatccgttgacggtgatgttgatatacttcctcgatcaatcccggtaattgatttaaccgttgctttgtcttcgccgaaacgaaaataattggtgcataactgaggtactggaattcttgccgaatcagattagtaaaatctgtcatcgttcggtggtctttttcttttaatgtatcccacttattaacgacgataataaccccacatcctgcttcatgagcatatccagcaatgtgcttatctaattcacgaataccttcttctgcatttaggacaacaagtacaacatcactatcatcaattgctcgcatggaccgcatcaatgaataacgctcagtgttctcataaatttttccttttttgcggattccagcagtatcaaccattgtgaatttttgtccatctgctgtttcaaattgagtattaatggcatcacgggtagttccggcaacgttagatacaattacccggttctcacctagaattgcattaaccagtgatgatttccccacattaggacgcccgataaagctaaagtgaatggagtcatcttcatcattagctgcgttatcaggaaactctttaataacagcatccaaaagatcacccattccaataccgtgaacacttgaaactgcatacggttcacccagaccaagggaatagtaatcataaatatcactccgccgttctggattatcgactttattaacagctaagaccactggtttattggagcgatataaaattcgtgctacttgttcatcagcatcagttacaccattttctacatcggcaacgaagattattacatccgcttcatcaatagcaacttctgcttgttggcgaatctgtgtcaataatggttgatctgatatttcgatcccgccagtatcaatcatgctaaaatgtttccctaaccattcagcatgagcataaatacgatctcgagtaactccaggagtatcttcaacaattgaaatccgttctcccgcaatacgattgaataatgttgattttccaacgtttggacgaccaacaactgctacgattggatttgccaatctttccaccttctttcattttattttaaatgattaaagagggagtgggaaagaagtcgcttgcgacttcgttttcccaccctcgcgaggatggctaggcattccggacgttgatttatcaacgttcggaatccagccagctactgcgctactgtataaatacctttaaaaaaagtaaagagactgagttaattcccagcctccccttaaaagataattaatttaagaaactagttccgtaggtccttaagcttgtcaccaattaagtcacccattgagaagccactttcttcttctggagcgttgttcatgaagctccggttgttattgttacgacgtgaacgacgacgaccacggtagttttcaccgttgttattgttgttttcgtcttcctttggacgttcttcaagagccttcattgataaaccaagacgttggtgttcaggatcaacattgattaccttaacttgaacttcttgacctggcttaagaacatctgcaggtgtagcaatgtgcttgtgtgagatttgtgaaatgtgaactaaaccttcaacaccagggaatacttcaacgaaagcaccaaagctagtcaaacgcttaacagtaccagttaatacgctgtctactggagccttttcttcaatatcatcccatggtcctggtaaagtttgcttaatggataatgaaatccgttcacgttcagggtcaacgcttaataccttaaccttaacatcttgaccagcagtcaatacatcagaaggcttgtcaacgtgatcgtatgaaatttcagaaacgtgaaccaatccatcaacgccgccaaggtcaataaatgcaccgaagttagtcatccgtgcaactttaccttcaacaacatcgcctggttgtaattcagcaaataccttttcagcagccttttcgtgttgagcttgaatgatttccttgtgtgaaagaatcaaacggttttcgcttggttcgatttcaacaatcttgaattcaagttcttgacccttaaattgattaaggtcttcaacatagtgatcagtaatcattgaagcagggacgaagccacgaactccagcatcaacgactaatccacccttaacagcttgagtgaccttggcggtaatgtgttcaccttcatcaaatttcttttgaatgtcatcccataccttacgggcttcaagacgacggtgagaaagaaggtagctaccattttccttatcgttaccgatcttagaaatgacaactaagtctaattcgtcacctacttttacagcatcattgatgtcttcaactggcttggttgataattccttagcagggacgacaccttcaacccctgcatctttaataccaacgatagcttgacgatcgtcatcgattgccaaaacttcacccttgacaacatcgcccaccttaacttgttcaatgctatcaagcgcttctaacatatcgtttttattttcgttgttttcagccattaaaaaaaatcctccttgcaacaatcaactctaaaagatattttactaaaatttgtttcacatttccagtatttaggctaattcatcttgtgttttttttattattttactgatttcactcacaacttcatcaattgtcatatttgttgtatccaatttgattgcatcaggtgcttgtgtaagaggtgaaacttttcgcgttgagtcttttttatcccttaattcaattgctttttgtaattcttcaagcgatgttgtattaatcccttttgcttggttttcagcgtatcgccgtcgcgcccgttcataggcactcgctaccatgaatatctttacgggtgcttgtggtaaaacagttgtaccaatatcccgtccatccattacaattccaccattttcagcaatttgccgctgttgcttagtcatctcttcgcgaacagctggaactgccgccacagcagatacatttgctgctactttcggcaaccgaatatcatgagtcacctctttgccatccaagaaaactctttgttcagtttcaccaggttcaaaatctatttttatttgccgagcaatttcagcaacctttttatcatcttttggatcaatgccctggtttaatgctgctaatgtaacagctcggtacattgcgccggtatcacaatagacataattaaacttttttgctactaatttagcgaccgtactctttcctgctgaggccggaccatcaattgctacttgcaatcccttacacattattagttattcactcctctattttcaatccaatacactactctatcaaaaaattgctgctaatactctatttttaacgataacggtttgtattttctgtattattattgtagcgattataggtttggttattgttataacgctgctgataactactgtagcgattaggagtagtccggttttgatacccattaccataacgataactactactatatcgataataactactactgctttgcggagcactataactttggctggtttgtgtcgaacttgattcctcaatacttgaagaagaggattcactactgcttacactagattccttctttgaatgctcactagaggtactcgaactgtgagattctttttttttactattttcagaactagcaactacttgttcagttctcaccggatgattaaaggactgtttattattaatccaataaataagtggtgtagcggcgagaacgataattaatacgattaagatcgtagtaatcattgaattatgtgatcgttgcttacggtgttctgttcgtgataaatggccatcactatcaaggtcttcgttatctgtaaactttttatcccataattcatcattagctcgtcggctctctttccgttcctcactcaaagtaatcatgcctccttattttgagaattaacattctgattgtatcgcaaacttttgatgattgtctagcaacaacacgaaactttaattttcagtaatatttaacaggccctttaagcggtcttcccatcctactttattgttttcagaaagtggctgactgaccggcaaaatcagtttagttgcccaatctgaaagctcataatcacaacaaaattcattcgaaccggcaaattgctcaccaaaatatgttaaaagatattctcttttacaaccgtcctctttgatataagcaaccatttcttgcaattctttttctgtttgaattttgcgccgctcaaacatcgtaattatttgctgcggcgtaaaagaatgttcaagataaaacgcaaataaagacgcttgctcccccaaaacacttgctgacaacttgccattcttaatctgctctaaaattgtaactggcggaagatcaacgcttgttaattgtcgttgaatcatttcatcgccatttgcatatagaagaactgccaaactctgcttaccatcacgcccagctcgaccgatttcctgtaaataattctctaaattacttggcaaatgataatgaataacgtaacgaatatcatttttgtcaattcccatcccaaacgcactcgttgcacaaattacctgtaattcattattcataaattgattttgaattcgaaatcgttcaattggagcaacgccagcatgataagccgccacatttaaatcagtttggttttcaagccattctgccatctgagaagccagcttacgacttgcaaagtaaataatcccgggaccagtgaatttttgaactagtttcagaagttcaccatccttttccttttgagtagcgatggacttaacagctaaaaaaatgttaggacggtcaacagatttaattacctggtaggcagtcgtcatccccatttttttcaaaatgtcctgtcgaatacgaggagtagcagttgccgttaacagcaatgttgtcggcgatcctaattgctgccgcacttcctttagtaataaatattcaggacgaaaatcagggccccactgtgagatacaatgggcctcatcaataaccattaacgcaatcttatttttcttaagcgcggttaaaacttgctggttatcaagcatttccggagaagtaaatataaatttaaatgatttcaaattgtggaggacgcttgctcgctcttttccgacaagctggccgcttaacataatgactcgtttttctccctgccgatgaagacggtcaacctgatcctgcattagtgaaatcaacggtgaaacaatgaggatcgttcctgacaataaataagctggcaattgatataaaagggatttcccggcaccagtgggaagaatcgataaagtgtctttcccttccagtaaggcgttaattgtctcttcttggcctggacgaaaatcctcaaagccaaaatgattttgtaaaacatctagaatttcttgcttatttttcatttgttattccttgaaatatttgatataggcggtattcataaaaactggcaatttgctcgtcaaatttccatgcggtcggttcgcccttatagaatcgactaagttcgtcacgcttactctctggcaaaaggatatcccaatctagcttgtcaggaataaggattgccgcttccaagagatgctccctaattgtattttctttcaaccgtcgctcttgagcaatcagttcaattggctctccctgggtatataagtcaaacgttacttgggcactccggtttagtggactctcattgatcagcggaaggagcaattgttgcagtggaccaggaaaattacgagcataagcgctaaccgctaacatctcgtcatgacgtaagtactggatatcatcgatttttattttcaattcttgagctgcttgattaattgtccatcctgatcgctgataaccaatcatgatattaaaaaggtccgttgtcattcgtggatcttcactttccaaagcgctgccaaaccgatggagatcagtatagagatttttaaccagatcgtgatgataattttgtcgaaaccactgcttcaccgcaaccatttcaccatatgaaatcgccaatggaacatactttctttgatgataagagaattctgatacgacttgaatagctaaaaaaagtcgttggattattcgttgcgtattggttaaccagtaccagtcgtaaaacgatgggatgtagaaagtttcttcttcgttttttaaaactttcgcgccctcttctgtaagaattgcttgggattgatcatcaatcgctaatagtttatcagcaacaagttgattaataagctgatcatattcttgtcgattcagtgttcgatctgcccctaaccactctaagattccatactgtcgagcccaaaagagagttgcgactgttcgccgacttcgcagagtgttttcaattacacgaattcgccgtggctggtgatagctaaaaaagcgcaataatttattcacggatttcacccccctatatatttatatacgtaatttatttaaaaattctaccataaaaataaaaggccaagaaaaatctcagcctcttaatctatctttttaaatcattctatgctggtctagccatggactcaaccgacccgcgataattacatatacaattgtaacaaccaaacccttaataaggttaaaaggcaacacaccgatcgctactaattgagatacgggcaaagttgacttccagttccaaactgccatatataaaggggtaaggatccacaaattaagcagagacattaaaacagtcaacgttacggttcctaaagcaattccgataatagcttgtcttttattactccagttatgatgacgccatacccagcagaacggaagcagaagagcgagggatgaaataaagtcgctggtaaccccgattaattcagctggcgaaaagccatgaatcattccgtgaattaagcatttaattgcagcgataataattccgccaactggcccatagatatagccccctagcaaaacagggacatcagaaaagtccagtttaagatagggcgccatcggcaaaaccggaaactcaaaaaacattaaaataaatgctaaggcacctaaacaggctatgcctaccaatcgttgaatacgttgatgcgttactgtcattaataacaacctccatctgagattgtctccatttggcatcctgtattaaaaaagcgttgccgacttaccatttgtttgtcagcaacgcaaataaactatttaaagattatttaatacagaaatcttctttataccagactgtactgtcggctctggaattacaccagatcaaccattaacaatgggttgcgggctgtcaccgccggtcgggaatttcaccacgccttgaagacaaacgttttatatttttacaagtcctattctaataggcttttactgtcatgtcaacgtttatagcttggatctttttccatgttattccgcagtcttccatgacttttcatattttttgctatatttttgctatatatagcaaaaaattttggggttctcagaacatccaatcgaactttattttagatgttagtttctactattatatagtatctaaaaataaactatataccaaaacccttttaaaagaaattaattaataaattttgataaattatcaagatttattttttgttcatcaatttttctatatagaattttccggcccattaaactaaaataaacacgatataaatattctgttttgtttttcttaacaaactgtaatttaactttacttaagcttattctttcatttaaaaataaattcaaatgcattgacggagcattttttagaagttctatttctcctcctgggcatataccgttatatggttttctagcttctactccacaaccagtcctatgtttcataccctgcgcatcaacaatccaaccatcataatttagaggagttagacttgcgttgcataccgttattgtccacttttttaaaacaatattatagttaataacatatgatacgttaatttgttttttacgaagtccaagatacaatgctacaatcgctgaaaagactgtgcctattgcgctaaaccaatccgctagatttcccgtctccatccttttttctcctattatgcgttatattttacttaattaaacaaaaagcgccctgttaagcactcattataaaaaacaattataacaaaataagccctagggatcattacaaaaaaaatggtaacaatctctagggctaaattattattgacgttgtgagtaaacaactgaattgagttgttgctgattgacgccattagcaatgtcattagcaaattggttatagctaataccccaacttgctaagtatccgtatggatcaacatgtgagccaccaatattttcggttacccagttatgggtcttaacaccgggagttcctgcaccaccagcatcaagagttagcggaataccatattgcttagcgtagtaacgagcaacattgatgtaagcagtgtaatccttaatgaattggctacggttgtatgttcgccctaattcaatctgacacggactgtatggattagcatttaaagcaccccaagaaacataacccggttcaccgacttcaaagacttgaccaccatcgccgacaacaaattgggtataagctgattcccagttgttgtgaagatagttagcattggcagcggcacctgattcagcgccgacatcgtgcatgatgatgtagtcgttgatagctgattgactacttccctcccagctggcgaggtcgtaggtatgattgatttgtgatggtgtaaaggcattagtattttcagaagtcaaaacaccttgactatcagcgtgatacttcacgccgttaaccgtaatatcttgattagttactaaggcaccatcgcttccgaagtaataggtgttaccccagttttggtagaactggttagtatatcgcgctccatcagcgccaaaataataagtatgaccccaattgttatagaagcgattattccagcgagcaccgtcagaaccaaagtagtaagttcgtccccagttagtataaaactgattggtataacgcttgccatctttaccgaaatagtaggtattaccccagttgttatagaaatagttgcttacttgattaccattggcatcgtagtagtaagtcgctccgttccgggtatcgaaaccattgcggaccatttctccacctttaccaaagtaataagtgttaccatcaatcttttgtgctttattagttaatcggtaaccgtctttattgaagtaataaagattaccgtacttatacaaccaattatctttcaattgatgaccatcagcatttttccaagttaccgttgagccagcgtcattagcactattagcctctacggtagtagttgcacccactaaaaaagcactagcaatggttgccagtgctaagttcttagctttcttaagtgatttatttttcattattttttaccctccttggtagattgattaggaataaaactcttgccactaaagatagtcttgtctgtattcaatttaatggaaccgttagaaatagttgtctttacaccatcaactccaatttcaacagtactggtggttacttccccgttgccttcaacaaaaccacaaagccccagaatggttaggatcgtgttaatgatcgccgctacttggtcccagtggccatacgtaaagccaaaagccatcatgacttgttgaatgagcacaattaacagcgtaataaaagacgctacaaccgttttattgatcgtaccgtctggattaaaaaacttctttttaagcatttgttttaaattcatttatgactacctctttccaagtttgtaattcgacgctcgtgatctttcaattgctcgtcgtgatgaatgaacttcttgtctcctgcttgcaggcgttcattggctctttcatattgacgattagagacttccatattcttgttgagtttacttaactcatcataaattgggccaagaatatttttctcaatattatcaatggctttctttgaacgtttgcttagccatttaaatccggtaatgattatcccaatgatggttagaatggctacccaatcctctagcgagtagccgaaaatatagtgaattgctacccagtgcatttactcacctccattattgagcggcgctacttgccgacgtatcagaggtacttgctgaacttgcgctagtagctgggtcagcagaggttggagtatccgacttagtaggctcgcttgttgctggcttattacttgctggtgtattgctcttagcaggagtcgtaggtttgccagcctcttgaagttctttaaccgcagtttgtaaagcagtaatttgtgatttaatctcatctaaattcgttgaattttgcaaggtgttaacttgatctttcaagttgctaagatcttctgaattcttgttagcagaatcctgtaaagcctttaattcagttgagttatcgctggcagtttgtcgaagagcattaaattgttcaacagtgacaaatttagatgcatcagcgtccttccctgcttgtccttctgcaataactccggtatcagtattaccaatcatccagtgcttcgtctttggatcaattgaaggcgttaaaccgtcattcccgttaaggcctggaccaccaggagttcccggaagtccttgaataccttgttctccttgcattccttgtggcaattgtaagttcagagtataggtatttggatcgctttgtaatgggactaaggttgctgatggttgagcatctggtgacaacttggttaccgagccaatcacaatcttcggggtctttccaggatcacccttagcacctttagtcaaagttcccactttttgcataaccgcattccaaaaggcattaattgtcattgatggaatgttagttacatctgataccttcattgagttttcttcaatcgtaaattgagcaaatccttttgagggatagacagcatctttctgcgtgtcgttgctcatcgcccacaattcaacaatatagttgccaggggttaattgtttaacgtcttctgttttaagaatgacattcttatcttgaatatacccggtagccgtagcggcgaagtccttagggtgttctaagtcattgtttaaggtactggcaatcttgaacgttaatgtccgattggtaaagtcgggcacttggtcatcgtccaatgcagtgaaagtcattactgcatcagtgtcaccgaacttccagtcgccccacttttcatcaatggttagatctcgcatcttatctctcctttctattttctacgtagtttcttgcccagttcatagatagcgatggcaattgcatatccgacaacgtaggaacacaaaaatgctaaaagatttgccattatttccaccttccttaccgccaggagcagagccaaccgatttgaatatattctggatcaggcttagttgcatcgtaactatttgattggtggtgcatccagatttgaccactatcaccagtgttgtaatcaaacattaaaacattattttcattctgggctgtcaaacgtgggaaagcatagataccaccattcattgccgctttatcaacattaataacttccagcccttcgtaaggcttcattggtggaaaatcaaacgttccttcaagcttgcaataaccgacatacttattgaatttgataagcgtacatttaacatcatcatgagcacggcaaccgttaactccccatgctttgaaatcgtattgcttacctgattcatcatcggccaaactagcctttgccgcattgattgcattgttagcatagtcataagcaggctgtaaggcattgccacttaatttatcaatttgagtagtcccatgaaaggtattctgccccgtaaatgtattattaccacccaatgtagcaacttgattagtttgaatggatgataagacggcgttcagagattgtcttgcaatttttgccgcatcggttgtcccgctcagcatattttgaagttgacttgtaaaagacgcaactttttgctcaatctgagctagttggttatcaacgttgccgtcatagatttgtgaatcaccttgtgtcagatagcccacaccttgaataacgctaaacataacattaatggtcgaaataacttgatcgttgttgtctttaatgcggaaataggcacgatcatagtcaccgacccgctgatagaaagcgcctggaattgtaaagtctaacgtccctaatgacgggttaaccatcgtcatagtattaccgctaatcttagtctttccagcggagtcaactcccaccaagtcaagactacgattttccatattgaacggatgaccttgttgtccgaccatcacaaacttaactactcgcccattgtcgccctgatgaccattcatttcatcaattcgggtgactttatcagaagacatggttacatcaagaaccactcggccattgcgataagcttcatcgattgttgttgccattctttcactctccttttagtacttgattaagatactgaattaaattattgagggtagtttcaatttgtccccaattatcattgaccgctttcttgtagacatcgttagttgctaactgatctactctctgtaagttcagagtcggtgtagaatcgcctgtttgtggatcaacaatccaattagcattgcaaaccttaatcacatcattgacaacactttctaattgttgaaaagacgccaacacataattacgtaagcttcttgttaatgcattgcctggcattactaacgatatttgagttttttgcggatcagttcccataatcgtttcaagattgctataaagctcattaaccttaccaataacgttgtttgccccgttactcacgttagtgccaattccaaataaatcattaaggcgatcaattttaatttgatcgattaattttataactggcttatctggaacaacgggttgatccggtttgttgtctggctgattaggtttgtctggattagtaggggttgtaggattagttggcttgtcatcaggcttgcttggctcagttggtatatctttagcagttgatttaatataatcagctaatcgttgagccatctgcatttgagtatcgaagttcggatgcaaacagccatcgcctaacaccgttttataattctgtggtgtaacaattggatcttctcgccagtcgtaataatggtagccgttctcagttgcccaactcttgaatacgtccataacttggttttgtgtaattcctaactggttaggactgtcaagatttgttgcattattaatgaatgattcaatcatcagatcaactaatacataagctttactgcctgaaactgagaacatggaactgaacattgataatccagccttaagagcatctaagctttcacggttaagtccccaatcattagctccatagcccaatagaatatagtcatagtctgctaaattaactgttgagagcaaagaaaccatcgatttatcgccatcattaactgatgtggcactaacagctcgattatctacttgagcaccaattaactcaccaattttgtcaggaatagttggatctgctcttggatgagcatcaccgtatcctgtcactccccacataattgaatcacctaagcatagtaacttagccatctaattcacctacttttgttcggtatcagtagttgtcgtttccttaattgcagtatcttttgctaactttcgccgagcaattgttaccatgtcacccattgctacttgcataaatgtctttccttctggtaaatcgctagagttaacccgaattgaggcattaatatattcgcctgatgtaacttcatttccatataagccaatttgtgctgaagtgatttgtccattatcaaagttgtaagtgaagttgtttacttgtaattcattcatgattaattcctcctaaatttttgtattaaaaaggcccacagcttacttattagcttgtgggtcttgttctgtttttaaatcttgatcattttgagcaagttttgcttttgcttcgtccagttgtgattgcagactcttatttttcttaatctcatttgctaaattaacctgtaaaattgcaatatctcgttcttgattctttgaacgatcaagcaatacatcaataacatcatttgcgtttgcagttaaattatccattaatttgtacctctttttttatttcatctaattgtttctttaattcttgtactgcgcccatcaagtaaccaataacatcagcatcagatcggcctgtcctacgctcattaataaattcatcaggtgtactgtactgtgcaacatcatgcacatcatcaataattggaccagcatggcgtttagtcatgcctccggctacttctgccttatattggtaagtttctagatcagtttccatgatcttgtttagagcatccttagtatcaagcttttcaattcttgttttactggaaagagtcgattttgtggtccatcccatgccttcaacgtatccattgaaacttgcccacccaaagactcggaggtgaaccccagttgcattaccagtatcattaggattaccgatattaacttcaccgttatgcatataaatctgttgattaccaccttcaatgaaagtgtgatcattaccgtgaaccgtagcataatcgtttccacgtaattctgccttatcaggtcctaaaaataattgtgagttacccgcataaacatcaaatcggctgctagtgctaattgaaatacctttagatagattgttagaggcatttgaaccatcataaacatgaattcgatagtctttattcactccactatctgcagaaccgattgatataccacttgttgtcccgtctttaagatacgagttcatcaaactgtaactagtagaagcataaaatccagaatactgatctgttggactattagggttcgccataccatttgactttacagccagccgaacagtatcatcgtgcattgttagaattgaccccagctggttagaagaatgaatctcaaaaccaccttggtattgaagattgatagtgctctttatcttgtcctgatcatattgagcaataccggcgccaatagtcgcacgtgagccatttccatagaacgtcagcttatcagcatcaagttctgaaatagcggcactcggaataaaagcacgaccggaaaatacgactgatgaagcatcaaggtatagcttatttgactgaatcaacgtattgccagcagtcaaattaatttgagataacaagtcaccgctcttgacccgcaggttgatgtcgtcacgaagctgggtgatctcactctcggttgcaccctgcgaccatgcggaccatttacttccgtcgtactgacgactgtaatgcagattgtcacggtcagacacggcgtactggacgattcggctgtcatagccgggttcaacctgcacataccaccaataaccaccgggtggcagatttgatccgcctttgacgaaaatcttctgctgggtaacgacattgttcaaatcgacgctatccgtgctcttccataaagtcttgtccttcaagtcattaattgcaatctgggcatcgcctatcttactttggaaggtgtttgaaagctgggtaagcttactcgacgtatcgctttttagattagtaacgttgccttgaataccgtcgatgcttacttgaagattgctgatttgagtaacggttgctaaatcagacggagccggtgaccacggagttgcaacggaaccacgctccaacttaggacgccagaatgaaaatagcgttttggctgaagctctgaagaacacttgtacataatggcaatctttctgtgtatgaatcgtctgagtgtttttcgacctatcatcggtattagcaactactcgcatatggtcaagatagtgaggtgtcgtattattttgatccttgtattccacaatgaaagtatagatattattgtagctgccaccgcttgctaccgtgttgtaataagtttcaaaagagagcgtatagtcagtatctggttctacgggaagaaactgcgtagcgtctaagtcaccgttccccttcagctggtctaactgcattgcttttccatcacgaagagtaaagtttgacccccacacatctttaagtttagttagatcagtgctgctgaaatctgtagcttttagcaggttgataccgccaccgttattgctcttgatcttagtgtcaagatcggtagcagtgacattccactgatccttggtctgcttaaccagcgtctgggcatacgacatcgttgcatagcccttactatccaagatgttgttaacggtagtgccatcaaccttctgcttgatctcgttagccatgacatcaatccgtgagctgttctgtgaagccgtacccttaaccttgtcaacttcagtctggtcggcttttaagctaatctgcttgttggtctggtcaatggcggttgagtttttcttaattgaagcgatagcatcatcaggattgggggaataatcagattcaatattccctaactctaattgcggatgatggtaagttgtagtaaagttttttccttctatatttcccatatgtccggcgtacaaccaaacgctatagctcactccatctttaggaatcgtaaatgttgttgagtgtcgtcgaccatctgctgggaagactaaactaccaggtgcttctttatcaagagctgagttccaaatccgtattgaggcttctttgaccccattggtatttgtagcagaaacagaaaaagtatatgtttcaccaggagttaaatcccgataaatcacccgattacaccatgccggccgcgcatccgttgttttagactcaataacaatatctgttccgctatttggtattaaatttcgtccaccaatccttaacccattaaccttatccttcaacgtctggtactcaacagatgacaccttttgactaatctgatcagccattaccttttgttcggcgctgactttgctaacagttccctttacattatctacttcggacttgtcagctttacgcaacaacatatctttagtttgcagctgctcggtactcaaagaagcttgcttagtttttaagtcgccagttataccggaatacttactatcgaagttatttaccgtaatgttaagagtagctaattgattaccttgaccagtcaacgtatcatgaatgcctttagcgtcaatctgaatattttgaatattcttttgagcgtcactgagtaataattgcaaagaatctgccttttgcgtgaccttatcaatattgccttttgtatcagtcaattcgctggtatgttcagtagcggtttgctcaactttgcttaatcgaccatcgtgatctttaaactcactaactaacgaagtagatgttttttgcagactggaaatattccccttggcgtctgccatgtcatctttcaacgttttactgtcagcttgcaaggtatggatattcttgtcatgatcagcaattgtcaatttgatgccactaacatctttttgcagagcagcaatatcaccttgggcgttagataattgttctagtgtccctttggcatcttgcttgatctggtcaatatttccctgagcgtctttcaacgtagtaacaagattatcagcagtctgtttaacctgtgttaagttgccttgcagatcagataaagtagtcgactgttcagaagcggtttgttcaaccttacttagtcgtccgtttgcatcttccagtgtagagctgagttcctttgctgttgcggttagttgtgcaatatccttactatgatcagtcaaagtagcgttcaattgatcagcttgtgcttttacgcttgcaatattgccctgcgcatcttttagcccagccgacaagccatctactgtatcagatacctttgtaacgtcgcccttaacatcagcaattgtaatagaaaaaccatcctgattatcttggatggttttaatcgttttgccctgttcttgggcttctttggaataggtatctaattgtttagcaagatcgtcattagcctgttgagcagttacaatgtcttgacgactttgggcaatatcactattaatcttagtaacactgtcattaattagcttttgattctgctcaacagcggactgtgctttagttaagctatcatgaacattatctaggtccttttgcgctaaaccaatatcacttttaagcttatctacactagccgagttagcagcctttgccgtatcaacttcattttggacttgcgcaacgtctgctctaatttgtgcaacatcgctagctgcattagctttcaattgctgaatttccgccgtagcactatccattgcggactttgcttcaaccaccgctgaactctgtgcaacaatcgcatcactattgaccttacttgcagcgatggcggattcagcaaatttcacagcctcatcggcttgtttgcggacgtttggtaagtcggccgtagcagatttgatttcatctgctactttatgagccatattaggccacattctttcaccatcgtctttatcatataatcgcccaaacattgtgtctgttacatgaaaggttgctccattatcatatgagtatccacgtcctaagatgccagtttttgtatctcgtccaatttctccaacaataactttaactgtttgttggttggttttgcttgttttgttgctcgacgtattgctcaattcggtctgcctcctcccttgtaatagttagaatatttgttgactgatccggataagatggtgcttgtttaatcgaatcaatagccttcatcaaactcttattacgggcattttgataatctaaaatgttttgtgtatttgagttcaatgtaactgaggttggattacttacactaaacggataccagttaaaaccaacaactgcttcattagtggaaatttgttggtctcttactattatgtgaatcatatcgccagctattggcttgaaatttgtataagtagttacgtcaacagataatgccggattaggttgaatttttgtttttgcatattcaatcatggcatttttatcactaaaacgaccgtcttcaatcggctctgctggaaactctccatactttttaattgattcttcatcacgatacataaatggcgcaaagtaataatactcaatggatgatgaagtactgctactttggttactactatctcctgccgagccaccgctaccaacaatggtcgccatttgatcattgcgggcaacccagcttggataaaaccaactagcaggttcttccttacaaacttcaccaggttgtggttcgaagataatagtatttgcatctaaaaacaaggaaatatggtaagaacttccatgagcgccataaaaaccaacatctccagtttgcggagaactcacttcatgaaaatatggttccatagcgacagtctgagcaggcacatgaataccaaaatcttgataaacctgtgatatataagaagaacaatccattccattacgtggattacctcctcgtgcaccacctgcaccaccatacacgtatggaacacccaagtaagaacgcgcgtcatcaataacaccttgtgcacttttagtaacgtttgccgctggttgatcaccgtcactgtctgtatcagtatcaacttcggtttcaattgaatacttaccaccaatacacataacttcattcgttaagctagtagaatcaaacgtccacttaaactcggtagtgttataaagataatcaagtcgatttccgtaatctttattgaactgatcttgggtgtaaacccgaatgtttttattgtctgggtaaataatcgcattaggccagtgatcagtaattttgcttagcatatccgacccactaccatcactaagttgctctatacgtgacgatggaaaatcaccaataacttgatatgaaaacccaagattgttgccgtctagccaatatttcaaaacatcatcgattttgtaagaaatttgattttcgtcagagtcatctttggtttcatcggtcttggtaacagtcgttgtggtggtagtatcgccattttttgattgagatgaagttttttgtgcattagaatcactatcatcactgctatcgtcattgccattatctacttgtgttccaccgttaactcttacatctgtttgcttatcattatcttgtgggtccacataagtcttatacttgcgaattcgtccaacttcaaaataaacatgagtagctaccacatctaacgagttttgtccagagttagcgtctggttctgcttgtttgatgatatattcttgaccatcaaaaaagacggacgcttgactatccaacattgaataggccaaggagccgtcttgataagcagtaaattgtaaactccaagttgaattaacttcccatgtaatgtaaaagctatctggatcaacacaattaagaggttcaatttcggtgcgtccttgtcctcttactgttattttttgagtaattccaggtctcatagataaataaaaggaaaactgaaagtaatatctatgctgttggcaccggtaacagcaatattattccagccagtatctaaaataaggtttccgtaatcagtattagcacttgctggttgtccattaagtgttgtgttaattccattaagaattattgtttctgatccatttgaggatttttgatattcccactcacttccgttagttgaatttgtaattttcatcgaatttccattaaagtgacaaacgacttgtaagtcatgcttttgtccatacggatcaattgcaatatcacttggattaaaaacttgaaaactactggtagtaaagtgataaacaggagcatggtctaaccccaattctccaaattgaacagagcccgaagaaaagtcatataaagagttgctacgatataacgaatagcgatatcctgatggattgtcaaagttcattgtaattaacgcatcatgagcataatcttgactaggctttatttcgggtaaattggggtaaacaaaacggacaatggaagattccacgtccgttctcattctaattaatttacgttgcccgaagattcgataaaattgatgtttagcaagtttgaagtcttgccaatcagaaaatctcaaaaagaaatttgcaacaatctggtatcgagaaaatgttgaatattgaaattgacttccatctactccagcaatatcaagaaatgaattattaattactggagttgaattatctcctagatatcttaggccttgaaccttatcagcaatattaaattcatttccatcaccaatttttagatataattgaggattttgcaccagataatccacctcctaatagctcatataatcatttaacttctgatctttaccataactactataaaattgtgctcgtttacgccgtgcacttatattatcgctaccattagccaaaatagcatcgatttgttgtttatttaggccaacaatctgcgctaagaaagtaacagcttgtttaagataagcagtagtttcatcattagattgactttgcactcgccgactacgtaaaccaccagttccgccgctatcttgttccatcttatcaagagtatgatcaatcaaagataaagcacgcggacgtttattaacatctagcggaatgatggcttctgggagtccttcttcggcaacttcatatagtccatgtttagtggcaaaaccgccagttgcccatccatgacccataccgacgttgccccaacctccttcaccgccatgttcaagaacattaatagctgctagaatttgatcatatccgctcgcacgatttttatgtccaggcaacgcatcagcattccaggtgcttaaagcaaattgcaaaagacctagtgattcgtttccaccagagtttttatcatgtacttgctgtggaatcgttgggttaccacctgattcagtctcaatttgtttcaacaacttattaactttccattcagctgcatcatagcctaatgcatggaaagcacgaataatatatggacgccaacgtgctacgccagcaccacccggattagcctcagacgccatttgatctttcaaaacattagaaatagcttttgcaaatgcaatagcagaagctggtcctaggtcggctacaagtggaactcttgaattccagttagtcattttaaggatcaatgttttagcagcttcctctggatgtttttcaaattgctcagataacttatccatttctgattcggataatgtcccattagcatatttatgaaccccaattgaattcataaatttataagtactttcaccgctcaatacttgtgtaccgcgtggagcgtttggaatgagggtatttcgatgctggggaagtaacgcttgaccattagggaatagtacaagttctttccaatgaggacgaactgaatcattgacaagcatatgaccacccggatgtccgccgttagtaccgttagcataagaaatagtagataatttcttgtcaccaccaaagttgctgatagttgagttgataccgctaatccctttgttcaagcgactaataatatctttcattgatgattgagcatatccagggagtttatcaaatcctttacggaaattacttacaacatcatcaatccaactatcccagcctttaagaaatgaactactaaacttagaacgagtactttgaatatcatcaagatacctatctacagaacgactagcagatcctaaatttcgacttactggacgatctaatccagaccaggtacttctccaatcgcgatcaaattcacgcttaaatgaacgtaatgcacgatccattgaacgtgtttgacgattaaattcattaacaaagccagacttcttaccgctcatcgccttgttagcaatattagcctgttgagcaataagtcggccaaatggattcttacgaatggtacggtaaagattacgaatatcagaatttagcgcagtaaaacctgtcttctttccatttaaccctcttacggatttttgcaatgtattaaatgaacctgctaaagatttaagcggttttgctaatgaacgccaatatttcgccgagtttttaacactcttatccattctagttaaataagtagtaacttttgatttttttagatctccagctaacttcttaatgtaagcacctattttttgtttcttaagagcattatttagatctgtaaatcctttcttggtagcttcaagtccattctttccaactaatgttttagttgcattttgtagcgtcttaaaagattttgataatgacttaacaggtgaagcaaattctttccacttttttgtagaatcttttatttcactactaatctttttaaggggtttctccaaagaattattctttaagctcttacccagactatcaatgttttttataaggcttttaccgtactttttaacagtcccatctagtttaggtaagtcatcattaaatgctgcaaaagcatcctttttagccattgagttagtaaaccgactaaggtatttaaaagcatccccaatttccttaatcggtttagcaaccttcccccaattacttgaagcaccttttaattcagagttcatatgacgaagttcagaagttggatcattagttttaataacaccctttaaccctttcaacgttttttcatatgaacctatttgagccgtcatagcttttaagttttgtacgtcagacttagagtagcgagtgtttcctaaagacttaactttattttctgacgtcgacttatgagtgtcagtggtagaagaaactgattgtttgcgagttggcttgtgaattgtttctttctgacgatttttcccaaaccaatcgaagaatccacgccaatcatctttaactcctttaatcactgaacgagcatctctacccatatcagatttccagcgtttcacattcaatgtgcctaaatcagcaatggtatcccacatttcctttaagccagcatggacatttctagcaaagaactttaatgtagcaaatgctgtattaaatgttccacgttcccatcggaaataacctgctataactgggtgtttcttttcaattgctgcaatccaattattatattttcgcgtagcatccttaaaatcccagccaacagtagccacaaatccacgaggtttatagtttttggtataaccattccaccccttcttaaatgaatcagtagttttgtaagcccaatccgttcctaatgatgctagctgaccaccaaatggtcccgccaaataccaaccgatcccttctgccattgacttaccagcatccttataacgacttttcgcttttgaatttgttaaaccagaataaatattcttggataaatctaaggcggttaatgctaccatgccaaagtctataattgacccaaaaatacccgctttttttattaagtttggtaacgatttaaatttacttaaaaatcctgttgaagctttagcaccagctttttctccaccctttttaccaaaatcggaaagaacattagaaaaccacctagaaattctcgatgatcttgtttcgtcaaggtacggtctgatctgaacatctctttcagccttttcaattttacttgcagcgcctttttctttagaaggtatttctatagcgttgccaatagctgaatctccaccagaaaccaagttatgttctttccaaagtgcaacatttcgttcaagctcatgattttcaagcttaattttatcgttttccttattaatccggaacaaacttaaaaagtcttgtttcagagcacttaaaccattaactgttcctttaagaatcttaaaggctgtaactagaccaattactccaccggttacttctcctaagtatttaggaaagtttatgtttcgttgccttattccaagtgctttttctacattttttgtaagcagaccaattgcttctccaactgctccaattgcatggacaacaattccactaatcttaaagactgcagtaaagccttcaacaaagccaccagtaaatgaaaagattgatttagaattatgactaataacacgtgcaaaattagaaacacttttactaaagtcaccaatcgctctttgaccatcttttgagccaacccaattactcatagcctttgctacatcattaacagctggaagaagcttattgccaagattaattgcaatatcttgaatattcatcttaagctgttgcatctgcattttagtagattgcatgtttctttgtgccaactgatgaacataattggtcttttcagccttttcttccttttgaataagatcatccatcgcattagcactttgagataaaatcattgcagcattttgtcccgttgttccaaacacagctttaaaaaatgctccacgatcggctttactgagattttcagtatgcttattgataactttcataatatcaggaagctgctttaaagcacctttctttgtcttaaagtcatccatcgtcataccatactttttaagagcctctgttgcgccagcagtaggcgatagtaaactgttaagcacttttcgtaatccagtaccagcgattgatccttctaatcctgcattactcaattcacctaaagcagctgtagtagtttcaatggactgaccagattggcttgcagaagctgatacataatgcatagcctctcccatattcttaaagtctgtagccgtcatatcagctgcataggccatagcattagttactcgctttgaattttgaataacttgttcagatgttttaccttgccgtagattaaacgcatctaatacattagaaacattttgtacaacatccccataatcatctccagatgcacgagctgcctctaacatagatttcattgaaccaattgactgtcccgcagaataaccacgttttacaagctctgtgtactgatctgcaatatctttttgtgagtaaccatattctttagagaatttagcagcatcacgttgcattgtgcctacttttctaacttcactcgcagcttcacttgctgatttagcaccaaatttaagtaaatttccagtagtaacccacgattgttgtaaattagcggacatttgtactgatttaccaacagcagcaccaaatggaacaagcgccattgatgcagtcataattccaccacgtaatgattgagcccattctctcgtatgtgaagtagctcgacgcgcattggtatcaagattattcattgcacggcttagacgagaaattccgctatcagtgacgcttagttctgctcgtgaaatttcgttgattgaagttcgtaccttcaatgcttgagtaatttgctttgcatattctgaatttgcattagtaatcttttcactgagcccaactaaagcagctgcttcttttctatattcactagatgcttttccatgttcacgtacagtttgattaacttttgcttgttgctgagaatagctattacgtagtccatttactttagactgtaggcgatttgtttcactgacttctgctcgaaattggttaattaatgctccatgctgtaacttgtaggattctacttgagctttagctgtacgaaaagcatttccttgactattaactgatctaacataaccatccattactgatttaacactttgcgcttctgtacgtgtacgagctagaccagtattaaattggagaatggactttcgagactcttcaatcccttgagttaatttgttaatttgatgttgagcattttcaatctgacgagcggtactagcatacttcttttcagtttcgtcaaaagcacgttgaactttttgggcttcttccgaattagcatcagcatactttttcgtctcttcaatttgcttttcacgtgctttagaaagtttttctagttctccacgaagttctttctgtatatttttataattttcaatctgtcgctcagattgttcaatcttaaaattatatgcagaaattgaaccttcaccttgtcgaattgtttcaaatccggcacgcatttcagctttcattgcacttgcggcacttcgcatttggcgcaaactagctacaacaccacgatcttgcatatcaacggcaaatgtatacccttcaattacagacatctattttcctcctttcctcaaaattttttagaatgtaaaggcatctgagccaaccaaagttaatggatcttgcggacgatcctttcttgatttagcattttgtgctgccatcacatcgctaaatgatgatttataaaaatcactaggaagaataccgttactcatggcttcttgggccataaagtcgatatcttcggtgagattgtctaaatcaagaactaatcttcggaattttgttttgggtcttcagcacttaaagcttgcattgcttgttcttgacgcttttgcatttcacgaacacttggagtagtcataccagtaaattcgttaacagcagttgaatagaaagtaaataagtcgttgtatgacatatcttctagcttctttgcgtcatccttgctaaggtctaataacttagcaacttgcttaattacttcatcagtaattacttcgttatattcagcaaaaaggactgtttctttcttttggtcaagagcatcaattcgcttgtaaatttgcttaattccctcattgattttcttgatgtttcccattgagtccataattgtgaaatctttaccaagtacgttagttgcctttaatgttactgtttttgccattgttaaaactccttctatatttaagtctatgtattagttacgtctcactattactcgtctctgttatttctttttaagcggtagttgagctaccgtctggattaattacttcagtgggcgccccactcggttgtggggttgctattttcccacgccagctgccttctcaccatcagttcggacatcaactacttgacctccatgtaataaaggatcaagagtaccatccttacttgccgtcacaaaggtttgtccagggaagacagtatcgaaaagcttttgcttatcaaaaccatctcgtccggcacgatcaaagccgtagttctttccattaaagtaagagtaccccatggaagtgaacgttaaggtatcactttcacgagtttcagctgtatctgtgttggtttgaacgttttgcgtcgtttcagtaaagatacccattccaaaactgtaataaacatcttccaatgttaccggaacttgagaaacaatcatcaatcccgcataggtaggcttatcagagtcgacccaaataccactggaaagttgttggcgaccaagcagtttttgcttaacttccggattaattaagttagctgtaattgcaacagttggtgaagaaggtggattagaaatatctaccacttcattgttaccgttaatctttgttggtgttccagaaagcgctgaaatattagcagtttgcgcacctaagttaaggtgtgacttattggtatcaattgcgtaaacaccagcttcagaaaggcctttagttgcatctacaatggtggttccatcttcgttcttcaatgcaacgtagagcattttaagaccgatattagccattagttgtcctcctctgtaagttcgttttgtgtgtagttgaatttcaacgtattcgttatgttttttgtatctggagtcaaaacgtgaccagtgttgagataacgacggattttgtgagcatacaaaaaggactcaactgatttttcaattgagtccatatctccgacatagttaatcgggtagtaaaacataattgatattcgctttatagtcgaaagaattgtgtcatttcccacgtcacgttgaccgtcattatcttctgaaacaaccaaaattggatgtgtattatcaacgttttcttcgtcaatcatgtaggcacaaatattgtcgacaaggatatcttccaagccgtcagcattatcacttaacaagcccactattcgagcggtaggagtcattttacttgcctaccttttcatccatgatttcttttgctcgttcagccatacgtttacccatttcatggtcacgttccttaccaatgcgagcaataaagtcgtgccactcactatatttagtctttggtgccgtaccgtaaggaccaccgtattggtttcgtggcttccaaccatcattcaaaaaacgagcgatataagctttcttccctttcttagagaagccaatctcataatgcccgtcttctttaatttcatgtgttagtgtatccgccaaatgctgtgtaccgtttttatacacaacgtctcgtttgtgttgtttcaaaaacgcatccatagcgtcttcgtaaaccttatctccaaccttatttactttctttcgttcgctaagagtaaaaccttgatctactctttccaaaaatttatcaaaattatcgttaattaaaccactagccatggtcaagaacctcccgatgacaagtaattaaatcaaatccgtcagtgctcagaccgtcatcataagaaatgttatcaataacaaagatttcgtcccctttacggattttataattacttgtgatttttaagtcatgacgaacgaagaacacaacagcctctttgatatgtgcccctgctagtgttattgcttggttggcacttaacgtccataacccggcatatctactaaagtgtgggttgaaacctttgattgatttccccgtatttggattcttttttccggtgggttcgtcaataccaaattccaaacggtaacgcattctggcaacatttacgtttttaaccattgtgatcatcctcttgtgttagattgctgtcccggtcggaatctgccgctgtttcattactactctcggcgtctgcgataccagaagtatagtcatctaaccatccgtcttttttagcgatttggtagcgataatcatctttcattgaattaattaatgaatacagagccattggaacctcaaaagtttgctgttcactagtagcacttcgatggttataaagatgagaaacttcaagaataacagcggcattaaatacctcgttatcatcaaaaaaatcatcaatacgttcacctacttggccgataatatcccgtcgagctgccttaataagcatttttaacagcacattatcgctttccatatcaggttctagtcgaagagaagttttaacttggcccagatcatcatcgcttactgtattctttaataattcgattgacatatatatcaccaccttttattgctacttattaaccaatgctaataagtcaggcttacttgcagatgacgcataactaatcttatgtgcatctaagtaggccttaatttctggaatagtttgattttcagttggttttacatccccattaggattgaaagtatcagctactgccggttgtgcggaagcagctgacttatcagttgaagaactatcgcttgtagtcgagcttgatggagctgaacttgctacagcactagatgcaggtttgttttgactctcatttgtgtccccacctgttttcggcgttgatggggttgtgttcttcccatcatcaccggatggggaagctattttgacgcttgtacgtcagcaatacggaatgcgcttgaaagcttaatttggtgatccatccatgcagttaagacaaacttttcaataccagtgtcaacgtccttgtcttggtcatagatagtattgatatcgtagttgtattgtgagtatgagaagtcacctacaactggcttagtagctgcatcagtaaatactactggcttacccaaaacagctgatggttgtgcaccgtataaagtgttagaaccgttagcaagagtcttaatgatcttcaagtaatctttgtatgccatcacaatagttgcattttcacggtaatcttcgtgaagatcagcaaccgcattagtaatcgcatcgtaaagatcagaaccagttaccttcttgataccaacagtgtcatcgtagaatgacatgtgcttttcattagctttaattgggttaacagcaaaggctacgttacgttccttccgagttacaccattagtaagttcttgttctacgtaagctgttaagttagcgtctgagccaagtaatacagtttcagaaagtccaaccttaactttgaacttgttacgggtaaattgaacagtgtcacccttagcttgaatttccttagcggtgtcaccatctgcaataaatccatcatcatctaaagtgaatgagagacgaggaatttctagattagtaatttgagtaacggttgaaatatcacgtaatggattatgttcttgtggtcccgtaataatatcggttgaaacagtcttaggtaagaacttattaccaccagttgaatcatcatcacctaaagcttggtacacagatgctggtacagcttgctttgccatagtattacgaaccaattgagcaaatgccttcgcacgcttttccttttcagataattgacttggttcactattaggttttaacttcttcttagcctctgcttctgccttttccatttgcttacgagcaacctcataacgttcttgggcagaatcaacgaccttttgttgagccttaatatcttccgttggagtttgcgggttagcaagcatttcgtttaatttttcattggcttggcgaacttcatcccccatatccatggcgtttttcttaatttggtaaaaattcatgtatttgttcctccttcattgtttgcaattcgttattaattgcctttaagttgttctggtatcgttcaagaagttgcttacgaaatacttcatcgtcttcttgaacctttgcttgttgtttttgaaccgaagcttgaataagctgttcagggacgtgccgataacgttgagcaaaatttttgctaatcgaagcagcagccttattaggctcaataacttcggttgcaagcccgtattcaacggcttctttagctgttaaccacgtctcatcatccattaattgacgtaaagtggcttcatcgagcttgtcacctgctgtatcgagatacgtttgaatacttgattcagtgatcttgtcgagatcatctgcttgcttgcgtaattcagaagcgtttccgactgccatcgtccaagggttatgaatcattaacattgaatttgagggcataaaaatagcgtcaccgctcattgcgataacgcttgctattgacgccgctaaaccatctacatagacgtttatgtgcgctttattctgtttcaacatgttataaatagcgattccttcaaaaacagaaccacctggcgaattaatatgtaaattaattgtctttacatcacccagatcttttaatgcatcccgaaaacctgccgcagaggtatcagtgtcgtaatattcgtcagttacgatttcgccgtcgatatacattgacgctgttttctgcttgctttcctgctttactgtcagatatttgggaatcactgttgtctgtggcatcattgtcacctcctttcaaagtactttttttgctgttacgatctgcaatatccgtatcaattgggtataaatcaccagtaatccataatttatccgcatttttagcgtctgatggtggtaattcttccaattttcgtaaatcgttagcagatgcgatcccattccggatcagcgtttggtagaacgctgtccgtgaagaggtatcaccacgaagcaaaccgttaatattgaacttgaaatagattccttgagatcgttccatattactaagcaatttacggttaaactccgattcgtattgcgtcacaattggaattaacgtcatttcaacaaattgcagcatgacttgttcatttgactttccgttgccactctccagtgattcattcaaaaatgataagggtacattaaaggcagtcgctacccttgaacgagtgattgagttcgttgttgatagatcacttggttggaagttactatcaaaacgattgatctcaaaccctttttcttggacgactgccccaccgttttctgtaatcattcgtctaaaatcattaattaacgcttgtcgattatcaggactaaccgaacgatcatattgaatgatatatgcatcttttttatccatttcgtttaacgagaagtcttcaactgcttttttgaactttaatggtccttttaacacatccaatggcgaaataccaagtgtccccgttaatggggtaatgtgtttgacgtgaataatatcggtattaaagactaagaaatggtactctgtgctgttaacgtcataccaaatagaattgtcatcaacatttcgtttaacagtaattgcacccggatcaattggccacaaattaattggggcaccattatcgtcacgttcaatccatgcataagcattcccgtccgtattccgcgatacttctaattgattaatgagttggaatgctgacatcgaaggattagcttcaccatgcaataaatcagatgcaggagtgttgatttggtcgtattccttgtattcatggatcggcaaacttgataacgtgttagctaaacgactaataactccaaagacttcttcattattgcgcaatatattgttatgagttccaaaaaagttactgttagcccagttactaaaatgaaagccttgcccttcccaatcaccagaacttgccttttgctgtggatcagtcgaaaataaatgttttacgttattccaaaatcccatatttgcacctcctttccgctaattcagttaacttacttttccctcatcattgcaactaaggcataaataccaataattgcaaataccattagcaaaaataaaaaccatagtccaagaacaataatcaaaggtgtaaaaatcactaaccatgagcaagtgactagcccagctaactttgcactaaataaaaaagccgttaaagcaacggcaaaccatactaataatttcatttcttcacctacttgaatgaaataaacgttgagaccggaccgtcataagttggttctactaacatatcaatcactgatacatgcgcatctagtgctgccgcaaatccatcaatttttcgtgattgtgatgtttttgtaggcaaccaattatcattacgatcttggcggagatggacattatttaggtaccacttaaacatcgattgttcattaaatacgaccttcccgtctaaaagaagttctttgaaattctggagcggtcctcccaaagttttaaagccttgtcgagctacctctgtattaaaaccagcttcaatcagttctttattaagccgaatagccttagcataatcgtatcgaattattacgatgttgtatttttccgattgttccttgaaccaatcaagcacgtatgaataatcgacatagtctccaggaataattgtaatatccccatcttgttcccacttcctaattcgttctggattcttatcacgttcataccgagcatgtggaatccacgaatgttccaatataaaaacgccaccatcatctaaaggaaattctaagcatgcggaggtgaagtcctcagtatctgatagatcatatccacctacgcattcacgacctaaaagttccttcaaatcaaggtgacgcttatttttttgtagtatttcaggagttatgaagcttaactcatcaacttccgagaaaatattgaattgtttagtaatccaatcagctaattcgttagggactcgccgattctttttgaaatcagtgattagtccagcaatatccatcatacagatgttgggatttgccttgacccatagcgaaggatcattcatttcttctttctcgtctagcgatgcgagataataaaatgttcgctcatcaatgtctgaatcataatttttaagggtatcgtggccctgatcaatcatatccactaatgggccatctaaaacatacccagctgtcgtaatatagacgattaacggttgcttccgggtaccacgtgaccgtttcatgacgttaattaaagaataatcttcatattcatgaatttcatcaaacaccccaaaatgaagattttccccatctttgttattcttttcagctgacattgcaacaatcttactgttagtttcaggaaagcgaatttcagagcgattaggaacaaattttttcgataaccaaggcgatgcagtaatcatgttacgggcttcttcgtacaaaatacttgcttgtttttgtgagttagctaaaaagtaaacattcgcaccgttttcatggtcaaaaccagccatgtagtctgcaattcctgattccaaagtggttttcccattcttccgaccaaggaaaactagggcttcacggtatcttcgcaagccagtgtttttatcaacccaaccaaagattgagccgacaaagaaatgctgccaaggttgcaaaactaatcgcttgtaatcaccttttgatggcttacatttcttttcaatgaatcggattgggcgccacgctttttcttcatcgaaagcccaaggatagtcaggatcttcttgcgaacgttttaagtcttttagatgacgttcacaggctaattttacccactttccggtagtgatatcgccatttaccactaattcagcatagatagtggttaaaagaataggggctggttgttccaatacgtgtcccaggtccttttcgtgttgaacgtactcttttgaccattcaacaacaccagaataattaaggcctagcggattttcttttagaatattagaactcatcgtcatcttcttcattttgattatctgtcatgttaatagctaatgatgctcgggccgcaggattaagtccgaggttcttcgctagcttatccagttctgccgaaatttgcagtttcagtcgtaaatctggattaggtttgccttctacgaatcgaccatttcgttttagccgtgcattacacgatttgtattctttcgttaagtcacaataacgtgcaatttcgtcaatatcagcctcgttcatcaaatcagtatccttgaatagcttaataattgctcggaactgttttttggctccaggatcaagataagatggtggatccatatgttcagcagaaacttttaatttttgctcatttttcgcacgccgttctaactcatcttttggcttatgattgtagttaccatttgcaactaattgaagaacatttttagctgtttgtggcatatcaaaacttcctcctttcaccgaaatttagcgcttgacgctatttttagttatgttatgatttagttgaaatatgagtggtcaaaattaacggacatccggtgatgggtgtccgcttttttgtgtgcaaaaaattttgaaaaacgagttttttacgaagtaaggcatggcatcgctccagtgattttaaaattttctattttttaggggtggggggcttgtttttgcactttttgcacacgaaaattatttatttttactttcagaccgctttaatcgttgctgtgacggcgtttataggcatgtgcgcttttgggttaaagctccggattggctttgaatgtaaaaatatcactgttcttttcggcttttagtttggtctgcttatcgtgtagcgactttgtacgttcgttgtgttcggcattgtggcaagctttgcagatagtctctaagttgttagggtctagccgtttgctatagtcaacccttaccgctttaatatggtgtactgttgtagctggtgttattcgccccgctcgcttgcacacctgacacaaataattatcacgctgtaacacttgttgtcttactgcttgccattctttcgaatgataaaatgcgttgtaattatctttatatttgtgttccatctactccccttctaacgctttaattaagttattaatcttttctgttaacttgctactgtattgccttatacgtcatcacatcgcaatataaagcaagccaaaataaaaaggcgctaccgtttgaggtaacaccttattaattcgtttctttcgacaatatcaatataacactaaaagcccctttatttttccgcattttttccgcgaggatttaaaacaaaaaagccacctacctaattaatagatagatggcatatataaataatagtattctattgcttgtttagttcttctcgtctgatatgtataagcttctccagttcgtcaagtccttcattatctgcatactgtttaatatatcgccgtgcatatgatcgcgcttgatatgcttttgctgcttccgggtgctttgctttatatttggccgttgcctttgcttgtgcttttgtaattgccatacttgcacaacctcccgcaaataatatataatatatatgtattcaaaaagggcaagcgttgcaccgcccaccccttttgctgacccaatatcaggaagccgttttattaggtgttagccgtaaaggttaacgccttttttgttggtcacggtatatctgatataatactaaacattcatctagtatcaatttcagatatgcgatccagtcgccggagctcacggcgcccgccctcctgaaattaggacttcagcaagtgaactattggccattagtttcacccgcctagaattccgcaacgctttctacttttcccaatatcagatctgtgttaattggccgttgctccgtaccactcaacaactatattatataacatatacatagaaagtaaatacattttaataaattagttcaaataaaaaagtcgcccgattaggcggcttcttttgtttctgtgtgcttgttgttgtcatccccgacaactatttttatattaactcccagcccgttcaaacggtcaacggttgaagctaacaacttcatcagtacacttttataatcgtcacggcttgcaaagtaacggcgcttgtagtcatctccaggatcaacaaacttcaaagcgtgactcttaacagtccgataatatgttttatagttcattgtatgcatccccttagtactttagtaggtaattaattgcgttgttaagtattgcttgttgtgcttgcttgttttcgccgttgtgaatgctttgagctagttcttcaaatagtatccccattatttgaactgttttaggttctaacccttcacagtaaccaccaacaaaacgggcgtatatctttgttgctgttattctgtttattgacggcgttaaattacagcaaagaacaaaccgccaatagttccgcctgaatgctcggcgctcgtgtgtatatacggcgtcactttcatataaagccctcataattcgcgtggcttccatcaagtaaagtcttactttatcatctgtatctaatagcgttaatgctttaattgttaaatctgagtaacttaactttgtaatatccatcatgttcaaccccttttataacttcccttctagttggctgtagttgtgcgcttgtccgtttttggaacatttacaatttctaacccttgcgcgccgtcccttgctgtgcgatcattttttcattcttcttgttcgggtaaactgttagagtataatcaccgtcgccatcgtcttcatagtcgattgtaaatttatcatttttaatttgttggccgtccttaatatgggtctgtgagtcctttaattccttgttttggtctgttaaatcgtcattagttgcactgaggtcttctacttgtgcggttgccttactcttggccgtttgttctgttctaatttggttctgtgcgtcgtgaagcttttggctgtcaacgtaccagttagcaactgcaataattaataaaatgcctaatactttaataattgaattcttattcatagtgattacctctttcgttagttgtttttctttaatatgcttttaaatagtcgtgtaagtctgttccatctgtattttctagtgcttcatgtgacgtgtgaaaattacactcacataaatactcaagaattcttttccctaatcgattgtttttgttttgcatatagaccaaacctaaaagcgcgtatctgtcggcggtaatgctccaatcatataaacaggctacttcttggattgttctatcactttctagatagttaaaaaattcttcttgttcgctgttaattttgatttccatagtatctacctcattattggttagttttcttttactgataatttatatagtttgttccaaaactcgcgatattttcgcccgcctagttgcttataggcctgatgtacagtgattttattttcttgatacaacttgatatacttttctacttttcgcattgcttacatccccttttacaaatcacaagaaatataattgtagtcgctgaaattatgttcttttgcgtattcattcatacaataaagagaatcgaactttagaccttccgcctgctttggggatgtcatttcataccccgttacattaaaaccgttgtttagtttttcgttgcaatatttacacttcatttttaagatctccttttctagccgttgtaaatttcttctagtgtttcactaaatccgctcaagtcatcattccaccaaataagaaagcttttaatttgcttactgtcgtatagcgttgtttgttcgtcatctagcttcattcttgcgactgttgcaccatccttctttaactcgtattcgtttgaatatccttctacttgatcgaatatctttttagctttgtttagtatggtttgttgttcttttgtcattgttattcttcctttcttttataacatcgtgttatatagtgaaattaaaaaattttgaacatactagatttttatctcaaatcttaaataaaccccttttctaacatcgtgttatataaacgattaaaattttatttattcgtccagttttttatcatctcatttcttttcttgttcctttcgacatctttataatataacatcgtgttatatattgcaataaaaaaattgaaattttttcaacttttttattcaagttcttttaatcgcttatctattgcgcgttttgtatctttcaaatcgccaatataatctatcctatcatctgtactattgacagctttataaactgctggggcttttttggggtctggatttatccatttgtgaacttctcttaacgacctcttatagtcattgaattctttatttcttgctctccatcgtgcgttggcttctagttgtgcttggctcgcttttgccatatatttcacctctttagcatttaatagaagtatataacaacgtgttagtgagttcaaacatatataagcacttttatagctctttcagtctttcatcaataagcccgcgtaattcttccaattcttcccgtgtagcgtcctttttaataaagttgcgcgctcttgacttcttttgattgcggtaggcttcttttttatgtgtgcggttgtattcatttacgcggtttatttgtcgctggtgtgcttcttctttagaatatttctttacttttggcattttatcgccttctttttaacccttttgcttgttgcctcaatttttgggcttctttaagtcattatccagatttaactaatcgatagctaacatatagcccaactaacagaattactatattaaatagaattttcagcatttctaaaacctttctatttttctagttccatagtataattatatatgtaaaagggaaccgcgccacgattcccaatttataagttttatttatttgttagccttttttaagcgtttagcccgcttttttaaggctttttcttttagacgttgcccttgccaataatctttatagcctttacaggctaaccgataggcgccggctattcctaaaagggcgcttactactgtaagcatagccccgaaactcctttcatatctagaatttgaaagttgggactgcttaagctagtaattagcttacacttatataatatcattatttttaagttgtcaactaataaaattaaaaagaataaaaaacttttctactatataataaatagaaatcatgttctatttattaagaacgtgacgcgctagccgtgctataaagataacgaaagccggttaaaagtagccggatattttatccagtagaacattaaaaccggataagaaaataaataaggcgatttttgaggcaaaattatgattttatacttggaaaataagccttcaaaaaagcatgctttttactagatccgaaaagcatgctttttctgcactctctagttcttaaagcatgcttttttcacttacttaaagcatgctttttcacgtcttttactttgtaattaactcttttatcacttcttgtgccgtcttattttcttttcgtgcaacttttactaacttatcatacagttttgtttcctccccaacaaacattaaagagagtcgtctttcttgttttccacaaacgtgggtataatttgtaggatcataccaataacaactttttataatgttcatatcatgggttttgaagcatgtttttgtacattctcggttaattgcttcagcttttattcgattacaatgtccacacacaagctgataattatctaagttagcaatctcttctgatggtagctctccaaaatatttaacaggtaacttatggtcaatttgtaatgacttttcagggaacctttgcccacaatatacacagtaagatccactaacctcaattaatctacgctttaagtttgtgggaggtaccaaacgaccgtatttttccttaggacgtaaattagcaaccttgccaagcttatattgagcaaccgcacgcttagcctgtggtacattaacacgacctggcttctcaataggaatgccatgatcttttaaatccattactgctcttggacctactgctgggttaatccctttttcctcaaaatcaaacttagttatagtccccttctcgattaatagatccgctgctgcccttgctcttggatataaattatcataaatatcgtgaatatattcttcaacactggaatacttagttttcatatttaacactcctttttaaaaaagtagcgctaacgttagcttataattatcgtataccagtttgcgcgacacgttcttaagaattgatgatatttagaacttgctagcaataataaatattgtttaattttctttctaccttaaagattctacaataaaagctttttctgctcttttttacacttataggcttacttgcttctccaggtgctagtaaatgccaatcaacatcatctccaatagtatgcctcatcttcttgtacactcttatttgatgccattcggagtcccatccattttacagtaacatttatattactatcattaaccacccaaaacctatattctttttctttatttccttcctgataggagtcaaattctatacttaaacttaccttaggctgtttattaaaatgatcattggctatctttagtccccaaaatgccattgctgctgcaatccaatctggtattgttcccaaccactctatcactatatcatccccaaaaaactattaggcattgctatttatataaaaaagaagctcacactcctttcttaacgtagcctatcacagcaagttgtgacttacgactactaaaaggaggtgagcttcatgtctccattcacacttttttgataataattgaaatcaagcgtcaggcaatgtctaaaggaggcgtgagcccctgcgtgtcttgcgcctcttatctacttttttatatttaaatgccttatagttgcagctctttctaaatatttcctttatatcatattagtagctatttaatttctgttctaacgcttctgttaaagtctttgaaaagttaattcctgcttcttctgctttttgggctaaatctccaggaattgtcgtattcttttttaccattggcgttttaacatgtttctttgcttcagctaaatcagaaaaaatcatcgtaaccaatgatccttgattttctttctgtatttcttttatatctgaaacatttggcaatttttcttcgttatataacattaatccaagcgcttctgaaccatttgccatagcctctggcactcccatgccttggcttattgctccaggaacatcagggaatgtaacagtatacatcccctttggattctctgaatcatctaaaatagcagggtatgctacaatccttttttcactcttcatacaagaattcctctctaaaatgaaatttttcaatccttacacgattataatacgcctcaatacgtattaaagcaacaaaatttacctaaaacaaacaatttattactaaaaatagtataatttttgtggatatattgattttattttcgaaatcaattttaattataaaaaaggaatgctagctggcactaacatcccttcatcttgctggcatgaattaaactacttattctttaaacctgtttgttttagaattgcgtttagtgtgcctgggtaaattgtgtcaccttttgggaatatgggactacagtcacgattccttctgcatttgcaaatttatggtgatctccattaacactaacttccttaaatccgttatcacgcaatagtttaattactttttttgcctttacctcgacaataatcaatcacctcgattctattaagacaaaggagcaggctttattattatacgcctataatgcgcattaaatccacacaaaataaaaagagactgaaaaaccagtctctttttattttagaaataataaagcaatagatcattttaagaacttaacaatagacttataggttccagaaagaataatatcatttgtattgttataacaaataacaagatgtttaccattcctgctctcaaaatagtgatgagaacctagtctatatttttcgttaaattcttcttgggctaacattcgcaaaagctctttcactttcatttgctttattttcccctctcgtaattaacagccttattatacgccttaatacgcattaaagcaaaagattttttattctaattctctttatagaaattttgtacttttagataatgattagaattagtaaacataaagttcggcaacttttccgttagcataaaatatttgaacgttatatccagctgctcgtaattgattgacaacactcatattgttttcttgtgtcaatccatcctcgtatcgaatactaaaaccttgtccctcttgcttaggagcttttaagattttattgtttatgttgtttacaaggtgttcagataattttgccttcatcattttatccaatacaaccgttttaggtataatctggttttggctcatcgttaatcacctattagtactctcattctttacagtcatttttcctgcaccattcagcccattgtttacttcggatatcacgcttttttcctgcattacccaatatttcaacagccttttttgtatcactcaaactataaaaacttgctgattcatctattctaaactcatcaacattatctatcccatcaaaatagtgtaaaacttgatacaaactgacatatttgtatacccgccatagattgtcaatcttatattgagaatagtgaatattccataatgatttacatagttgaatacgaggaaaactattccaatcatcaatcatttttgcttttgccatcgatttagtcgaacacacaatatacgtatgcatttttagccactcatccatttagtttcatctccaattcttctaagcacttttttgcctttaggtcgtgattccagtcgattaaaacatcatagtgttctgcctttacataattaccctctaactttctttttgacttactcgtcatataaatatgtttttctttcaagtacctagcaaaattttcatactcactatctggaatacctaaatagtcattaaagttaggtacaaataaatacgtatcgccccgcctatacttgcgaagaattatagatgtaaaaataaatttgaattgttccatatcttcacctcaaaaccatttgtgctttttgtgggttgtttggattgcttctataatcaattcttattgagagttatctgcgctatccagcgtaatataaaaatgaccacttccaatatctgacttataatttttctcacctaatcttctagtcaaggcaattagatatttatcctttatctgcctttcttttgatcctatttcaattccaacaaatttggctccagtagcaattccatattctaaagtttcgtttactagatcaatgatttcatctggaatttcgacattttccaattttttctttcatttcatcatgagtgaggatatctttcatttgtgcatcaccgtttcctattttattgaatatcattcaagcctaacttcttacgtcctccgttaaaccaagggcttaccgtaaatgcgagaatatcattgattacataaatagaactattaatagccatcgctagtgttgcatccccctgcgcataagtaataccccaaagaattaattggaaaattccagaagctaaccaccagaaatattggttgttgtagcgcatgaaacacataattcctgctgttaaactaatcgcaaaactaatagcgtcaatccaagggcgtgggtcattagttaacttaccaatcaaatatccagaaattacatatacaagcaatgttccaacaattgcaattaaccattgcttaccgccaaatttacgaagatgatttttagtatcatcattccacgaacgtacggctaaaatgaccggcaagtccagtgttaatacataagctacttgttcaaagattgataggtagttctttgcagacaggcctgcataaataaaacaagcagcgctaagaatcccaagaatcccgtttagagctttagcggcattgatggctagtacgcatagcacgccaagtgttgtccctataaaagtaatcagcgtaacacttgtaatctttgattggattaataaagccaattgaaaaccaaaactaaaccagaataacaaataattttgaagaggccacccctttaattgaccaagtaaccacttaaaatagttttgcttatttgttgtttgttccatttatttcattctccttttttattgttggactggtgtttagctcttatgatattcacgttagcgggcctctgatatcacaatatatttacggaagttcactggatttggttcaatgaacaacggttccctagtatctttaacgactattaacgccttagcacatgcacataaaagccacttcattgcttctttataatctcctagagtcattttgcttataacgttagaagttatcttatctattcgattaaaagtaacagatttcttaaagaacggaatatcgcgagtaacaacttcccattcggtagctaaatacaaatgattatcgtgtggctttaatgatattgaaaagacaccatcactaattaatttttcaccagcatttgatattttagaaggttccatagttaatgctccacgtacacctataccactaatttttaagtattttgtatcagcgtatttatatacttggtaatcattaaaaatacctaaaagatttacacaagcacgatagttatggcattcccagaaattcattgcaaattctgtagctagcgccttattcttatccgctttattgcaccgctctttaatagttaaataacttctccgtattatcgggacaacttcttttattgtgttctttaatatactcacctgttcatcactgattgggagtttatcagtgtcagctatgattaagtcagcgtaattattaagtgaagtaacagttcttttgataatttcaccgtcatcaagatcacttttacctaaagcgattgaccttaatatattaaccaaactatcaattttttgatcttcaaattgaattttttctttcatgttctctaatttctttctttattagcctctagcagctccaataacgcatcatattttccttgttcaaattgaattctaaatgtttttgtttcaatagtatcaatatcgatatagtgcatttcctctcgtaatgaagttaggatggtaaatgaatagcctgttccctcaccttggtggtacatatgaaaactatagttagacaattccaacaaagtaaccgcttgccccgcattatacggatcagatgtgtaccattggatcggcaaataatcgtctgacctgttgtttatggcttctttcaatgattcacgacaatctaatagctttcctccaaacgaaaaatgtctaatttgttttgcattaggtaataaaaactctttattattcccactagtgttacctcctagacatcaaaaaagcgggtagcagtttttacaccgctatccgcttctatgtatggttgcccattggtttgggtagttcaccttcattggattctgttctgccacaggttcatacgggctcactaccggcagacaactccgatagctccgtatggtttacaagacctgaacacggatctattaccgtttaactttcactcgacatgagctaatattatatttttccttatagctgtaagaaaatgctcttgggctactcgtaccaacctcgttagttatattctggttgccagacttcacaagctacgatcttcttggcttcccactttggttctcatggtaaccagccatgatttactgtgggtttaatattacgatcgcctaacgggttgtgcaatgaatttcaatgttggtttctagaacaaacaaccaatcgactttctttcatcgacttcactaggtattaattagctcttttgcaaaatatatcctatcgaacatattcggcttattggtcttacgttcattctgtacaggcgaaatgtcactttcttatgcactgccttcaaccatgattaattatatcaactctgtattttattgcacgtttagacacgtcatttttcaaaaatttttgcaagttctctaaagttttgagaacaattgttaaccattgcctcgattcctttttgaaaaaccggatcggaaaacacttctacaagtaagttgtgcgtttgttgacggttcattctctctttgtacgccttagttagttcacgcttagccttacgctttttcttattcatcctgcatcccctcagctaatttaattattacgacgagaaagattcttaattaccttttgcaatgaattaatctgtttttgcaattgaataatttccgagcgatttataacttgatatgaaggcgtaatgattgaatccaatcgatagttgatcaatgttccccttttgtgggctttagttaatctccgcttcatgtaacgctttcgtttattcatagaacaactctctcctattttgaattgtagataacattgtctcagttacttgaaattcaatatcgccaagtactaaatggttacttaatacttctgtgctaaaacaagtaacatttagcctaaccttatgaccagttttatcgattaaatatattccaggacgtgttccgtagtgcgatcccttctgctttggataacggggatgtttccttttatttttcatttacttcgtcccacaatttatccaaaatgctcgtatcaatttgaaagtcaactccacgataacttgttaatggttctttataccatccttttgattcagccactttatcacggcttggcacttgtgtctttacgctgtcaatcatttgtaaagcctgcatcgctacttcgaattcaactgatgacgtcggggattgaatagtggagataacctcttcaacagtcatttgttttgccaacgcttctttttgtgattttaccatttcacttaatttatttaattcgctgtaactagccattaaaatccctcctgattatctgttttttcaaatttctccttgaattctttcgacgaataaactttagagtttccatactcatctgtaacaatccaatcaccacttgttacccaacatttttctgtacgattgttaacagaatttcttttaaatacattgtctatgtaataatttttagttatttcatatactggcacgtcttgcattacttcatgttttctcccaaacagtccctttttggcttcagaaaacacctgtacaggtcttatagcctcatgaaccattggatatttaataagaccgtatttatttacaaagtcttgatcaaattgaacggcattatattttcgaactttctcttttacgatatccattaattgacctcgactttcttaaagcgttcaaggaattttttgttagtaaccacttgacactctccctttgagttagttaatatccaatctccatcagttactaaacggtcgtcgcatgtatagtaagcatatctttcaggaaagatattagtcgtttcaataatttcttcgttttcggctaccatcggatataaggctagtgactttttagctatttcttcacgaaactgaattgctccaaaatatcttacgttttcttctttatcttgaacaatcatattctcacctattccatcccatcgttataaccgtgaacatagcctttatagtaagattttgatacctttccttgtggctttgaatgcttgtgtgactttgttctcttatcaacagagccattcttgtatccatcgttgtagcctttagtatattgatctccgcgatgtccaccaggatgcgttacaccatacatccaagttgaaaacgtatggtgagtagcgtttggagtttctgaatgattatcgttagttatggttgttgtgtgttcaccttcagtagttgtatgtgttgctgtcggatgagtagcttctgcatgtgtagctggatgtgctgccggatgcgcagtagcatgagcaactccatgtgccgcaatcgcatttactggttcagcttggttatatcccacataaaatcctactaacaccgttccaagaattaataatgttttcttcatcaataatcacctttaatctagttgcttaattgcttcgtcaaccatttcagcaattaacattgttttttcttcactcaattcttcatttacaataatcggcatgtctattgcttcatcttcccagcaaagtttaatttcaggattgataagaagtaaaactttgactccatagccgagtttgtataatgaaaccactacttctacaagcgcccgataattaacatccccattattattcatataaaagtaagtattctttttacccattcgagcagcttcttcaacagccttatcagtatttttaatagcttgatttaccatctttttcgtattagataacgctcttgcttcatctgctgtcgtcataaggtctaacgcactattcattgtcatcatctcaagctttcatttgtaaaatcttcaacatttcccacactttgtcctttaactacgcttgccttaaatttcagcttatctcctggacgaattaagttagcctttacgtaatcattagtgttaactgtataaacaatgttgcttccttgcagtgtaaacataactttatttttatctgatactacaaccgaacgatcgacagtaccctggatattcttttgcttggtgcctggcgtatttctagctgtcgcaccattattaactaaggcttgacgaaatgcgtctaatgcactggtaggattatttccactgccataaatagactgatcttgtgcatcaaggtaataatatccacgaattgcatgcgaactatctagaatagtcattacccatgttggtcgtccgttaacgttataaagaactggcatctttgccttccattgttgtgctttatagttctggttagcattttcctttgcaccagtactatccatgattccatttgcagaatagaaggttaatttacccgttcgagcattaatcattgaataccccattgccgagtccgctttgctatttgggttagtaaaatcagtaaagtaactaattgaaccatcacgattaaagattgaggttactccatcttccggtccgttattagttggtttaataacatctgtacgactaaagttccagaaaccatgcttatatttaccaaagactttgttcatttgggctgccgagtcacttgtgatcccttcatcaataaacttaggcaagttctttattgaataagtcttttgtgaaccagtctgtgcattcatcactactacatgtaattgttgataattaactcggtggctaaacgtttctgacttgtagaccgtttgtacccaataaggcgtgccatcatcatcaatttcaagctgcggtttgctcatcgtaagccactcagggttattgcgataaatttggcgatctacatcatggttaaagtaagcgcttgttgcatacttataaggttttttaatgaattttggttcagcattttgattagttgcatctactatgaaatatccagggatttcttttgctctgcgcattgcgaagaatccgttatatttcaatggaataatataaacaggtttgcccttataatattgagcttgaactgtatctggagtatcgaagtactgactgtttggaatatccgacatagacttccgtacacgattaagcactgtattaggtgctaaagcgacaggggtttcattacgcttgaatgttggtgcttcactagacttactatattgtttcgagattgattgccatgttggtttaactgacagcttagaatgaacctcaccgatgcacccaataataaagacacctgcacagacggatatgcaccctaataaaagcttcgaccctttcttatcaccgtttgagaattcatcccaagctgatagagcaattaattcataaataattccccagaaaccattactaattaagatactcaaaagattacgcgacggtaaattaatatatacccgtaaaaaggtcacacctgcaaatagcagtaataacaatccgtttaatataagccaactgttatttcttcgaccataaatgatatttactaaaaacaaaatcattggtgcaatcatgtacaccagcatcattgttcccattacttatcctcctctggttctttcaacaaatcgataaatgttgaagcggttactttacttggactcaaattaataatttcaggcgtcgttacactaaccttggtatatagctgtttgttcgcaccagtaaatgtaccttcaacctttgcggacttagtaatatcttcttttaacatttccaaatcattttggcttgaaatgatctttccgcctaagagcttaatcagatcattcaccgtaaattgttgttctacttggttctttaagatttcaagtagtagttttgtggaattatcaactccaggtacttgttgatttccataactatcaccagtgaatgcaaccttaaagccgcttttagtcggaattactagcattagtgtctttgatttatcgtcatttgatactttgctatggaatagaacggatttgtcaccaatctgggttgctactccttgttttgcatgcgtatcaacatttgcaccggtcacaaatacatcaaatttaacttcggacgaactgtaataatcattaacagttacaacaagtggatctttaattgtgtttgcagaaactttatagaattctgctgcatgaccatattgatttaagtgcgtcatatcaccagagtaagttacttctccctgataactaccattccatccataatgatgaccacccaatgacatcatatgtaaatcaagatcagcttgaggttcgtcccatgcaattcctagcgatacatttttaccttcaaaatcataggtagtcatgtatggcaactcgccgataaagtccttcgcagttgttggtacggcatactcaacaccttctggaatataaaatactttattacgccaattgccatatcgatgttttaatacatctagaaccatgttgtgtaatttttcgctacgcaaggttcgccttagctcatttacactatctttgttattcataacttttaaataggtttttccgttacgaattttgaagtaacgagctttttgtgttccatacatacgcagtaatgcattatctaatttaatgagcttataaatgggagccttaaacattgcacgttcaatatcactaaactccacatcataatccattacgtgttctaacggtgattgcttacggggttcatacattcgctttgataagtgaatagctcgattgattaaggtcttatcctcaaaatgtttccgtaacactaaatagagtttgcgataacgagtaatatgtttagcggcttcttctattccaaaactcttaacatatcgttcaaatgttttttccaataccatataattctggtcactactccaagaattacttagatgtcctagacgattgatcatgtcacgagatttaattagcaacgtactatcagttgcaaggtaaattagataacgagtaaattcatcgaaattctttggtaagagcattaattcttcacacacatgacacatatattcacgattcttgatttggtctacataatcaattgttaaatgatagccatcgataatttcagaaattaagacttgatcttcgttacttaatgcaattccgctagttagcatattcttaactttctttgctaattctgcttccgtaattgcatcaatataaacaagttcatcattaatatcgatgtgcaaaccatttagaaattctggctcatagatttcaatatcatcacgatcaattccacgtccatacgtactcatataatgggctaattgttcaaaccgcaattgcaattcactacgaccttcgacatcagaaaatcgtttatagaaggttgaatttactttctctgcatcaactccgtattcccatactgctgatttcacaacagtcttttgttgttcttgagtacgaccatctaatacatgtggattaataaagacacctttctttaacgcatccaataataaactgggttctgttgcttgcagattgctaaacttatcttctacaactgctttgaataatttaatagttgcttcttcttttctcatgttcggtctcctttcagaaaataaaaaaggcgaccttaaataaagtcaccttagtttatatatgacaacgcgaaacgtaaacatgtcttatatttgctgtataaattaataggaacgtttttctgcgttgtgtttatagatacggacggtaattcacaaaagatttgaagtcttgtttcaaataggaaccgtcttctgtatcaattattgaatacgaacagtaaataagtatttagtttaacagactaagctataggaactgttttctgtattcagaatacatattctcggaatcgaactgaggttttcacacgggggatggtgacgacttgccaattagtctaaatatgtacctaaattagggatgtacaaagctcatttgggattaactcccaattgcggtgtaaggaatcgaaccttaacaaaactgcttatgagacagtctagcttccaaagctctcaccgccataaaaactagcgaatttgctagttacattacatcaacgtttagcttctttcctaattcaactagaaaactattacgcaattcgtacgctttcgtagtgctaactgggataatttgtcgatcacataaatcaaccatccgtaacccgacattgcctttgaagtaagtttcttgaataatcttttcagtaaccacaccggattcatctaagcattcatcaattgcttgacgttccttctttaattgttgaagccaccgatcatcattaatagttattacttctcgaccaactggatcactcagtttattcagagctcgaccaccgccaacattatcgtcttgttcaggcgtaggatatttcaattcatcttctcgttgcttaatgtaactgggaagtttgggataatcacgcagtatgtcttctagcatatgttgtactgatttacgcacaacttcacctcgaagatctcttatatagtagtcaatttcatgaccaattttggtgtccggacttgaaccagaattgacgctcaccacttgagcaacaccaaaccaaagtttttatattgggagtgccactaaatagcagcaatgttaagagctggaatcgaaccagcttcatgcatatgtgttgtggttgcaagacacataagctctcaccagagaacgttaacaatagtagctgacccgtaaatgtaaactactataactgatgctggagattcatcagtaattacggggactggactcgaaccagtgaatcacggtaccaaaaaccgttgccttaccaacttggctactccgtaataacatcgtaagctaagcgaggcctctttgatctcctatacttaactcttgatgtgcctatcgtcataggctcctctattagagattattagctaacataccagcatctgtggtagtgatgatttttcccaagaggactatgctgattgatggaattgaaccaccgcaacctaccgcttcaaggtagtgctctaccttctgagctaaatcaacaaaataactacccagaaaacgcacgacagtagttagacaagttacttaatcttcattgtatgctaagttacaatttccttaagcagagcttgtgtcttcattttataacccgaggcttagctccctctttttaaggctttcgcggtgaattttttgctaggcttatatttagatagagtcctttaggcttccccttatctctacgtttattcaagtggcctccttgaccaggacatgtactttatcctcttcggcggtttagtgcttccgtcaagcctagactaacattctcggacaggattcgaacctatcatacgcagttgctaacggagcaagcggtgactaatactccgaccttccataggcaacgagaatacagagttgaattttatttcggcattacgcctataactacggctggagtcgaaccagcgaaccgacttgcaaaacggaaaagacaattcaaacaaacgatttcagtcggatatccaacatcgtagttaccaataatcgaattgaatacaattattaagatactctttttaaaaattaaggcaattttagacacgcgatttgcaaaattttttctaaaaagatcattagtcccctaaaacacataatatgtattccaataactaatactagaaacaatgcaattaccaccatcataattagccaagatgtaaatgccatcactgtacttttcattgatgtcgcctctgttttaggagttccactttctttgaggacaagctccctaggtctactaatttttcttcaatagtatccaaaacaatatttctatcttgaatcgactcaatgaaatcatactttgttccatcaatgactaacaatggacttgcatcatattatttttcccacttctcatagtgttcgattaaatcatgatagtactgtactaaactaggatcataatctatttgttcaaacgccctaccacgttttttaatcctagaaaccatcgtgtcatagtcaacctttattagcaccatcaaatctggtgcttttttataaggagaaaagttaggatattcttccatcatggtgttcagtaaatccttatatactttccactcttcctctgttgcgtgtccctgctcaacattcatcctcataaaaatttcgtcttcatagattgagcgatccaggatattattatcctcttgtacggcttgtttaagcatatcgaagcgtttacttacataataaatttgtaattcaaaggcatacggatttgtttcccatttgccttcttcaaccattttatttccgtgataaaacataggtaaaatcgggttgttttgtactggttcatagaacgcctttgtccctaattcttgcgatagaatttcggttattgaactcttaccactacctatcacaccactaattgtaataattataatcaacccctactttcattattgtctaaacgtacatatttattcacgccatgttcatcaagagttaaatgccatttctgacgtttaatctcttttctaatttgccacgctcgtaataatgcatcgtcttttaaatcggctaattctagcacctgttcgaaagcaattcgccgttgctcatagttatcgttgtagtgattgcaatcattaataaatgcgttctcggcgatacagacatcacgatacatattcagaattttctcaatggcaacgctgttaatttttggctgtttctcatccataatttattctcgctttcttggggtttaagttttcaacactccactcccaattgtggcgagtaattaatctaacagctttaataggaacatttttactccgagcccattcacacatagcaatttctatttcatgtgtcatcccattttctttttgatcataatacatttctaaaaaatgcattgccgattcaatccaaggaagatttcttccagcgataaaatcgttaagtgtattaagtgcatcgcttcgttctaatgaaacgcgataaattatctttagggtttgactattaggaatttcaatcattcctagaatttctttatccttagcagtgagccggttttcttcacgtcttactgctagttcatacatttggcgagcaacttttaattccaacttgacaccccacattcgttacccgttgtttgtaaccttatatttctaaatcaccaaaagaaacattagtaattgttcgttcgtctaatgtcaatccaattgccgaagctttttgcaaatcaacagtttgattgagtttattgatgccaacaatatagtaattgtgtttgtgataaatcactggtgtttcattctgacaatatttaattacttcctgttcttgcattacatcaattcactttcttaatcactgaaccaaaaagagagcgcaaataaagcaatagtaccagcaactacttccgaacttgctttaaatgctatttcagcaattaaaacagcagttatgcataattggggaatgtaatcacttatatatttcatttgtttgcttcctcatcatagattctgagttgcgccatcattgaaccaactagtgcagcaaacccatctcgggtatattcaagattaacttgggttttcttttcttcaaccccatcatcagttaaatattgcttaaacttttttgcagtaatgataaatttaccagttttaggactacagctaattgatccaccttcacctttcttcacattaaataatgcttcgttttcaattttcattaatctatccccttattttgatcttcttctacaatttcgtttaatcgttcgaatttatcatctacatcgtttaaggcaacatttagagctctcacagcttgaaatgctttttctgttttcgccttatacaattctgcacttacagacaagtcacaaatcatactatacatatcggctaactgcgtatctgcaaaagttctaacattgttttcatgttgcttaatttgcgccattgcttgttgtaatccaagcgcccataatcttgcacgatcgctaatccggcgaccattaggaatgccttcccaccaatcgggatcaaaatcaattagcttatcgcgtaaatcagaagcaaggtcatactcgccagtaaattcatcaaaacattcaattaaatcttgtttcatttcttgacgatcttctaggctcagtgaatattcttcttcatcgtccaatcctaaataatcgcttaattctttttctaaagtatctgagtcatattcgtacttatcatcagacgtttccatcttgccgacaaagtaacctaagctcttgctgtaatcgacaatattatcaagagtatttcccgttgtattccaactaagcacagcactgcctaaatctcctgaaatacttagagtagaagtcattcgattaaaaaagtaatcaatacgatctttaaattcataacctctactcttccagattagaaattcataaggcccatagtgatgataaaaggcaatatgatttttaaaaatatccttgttcattacttccatcccttaatctctttgattgcttcatacaatggtttatccaacccatctaagctacagtaggcatttattacttcttgcttatgtgggtacactacaatgtcattttcttcgtctccgcttgtccaagttgctaatattgcgattggataaccgattaatccaacacccttgccaaaagtaacgaagaagtcatagagtacttgttcgtcattatttagtttcatctttgttacctcgatatataaagaaaatcaatattatagcaagcgctattagcggaattaatcctaagcaccattgaaaaaatactggtgaagaaaaccaaacaattgcataccacgatccccaaaccattccgcctagcataacaaatgttgtaactgcaaatgcattaactaatttatccataaatttcattactcttcctccttgtttagtggtcgcttgcaaaatgggcaattcggaacttttaatacattgattatccctaatgttgtttccatgataggtcctttaccaagtacattgcttataccctcatacactggtccattaccgctacccaaatccaaatcgttttcaataccagttgaaataaatggcttatatggaacgtgacagtacggacaattcttttgcttttcagttagtttcattagcttttcctttctactcccatatattcagggccaaacatggcataagtcatttgtctagcgcttttattggtttctcgacagctttttctccaacgtggtttatgcctgtagccaaatttatgtgctaaattccttgctacatgatacgtatgttgtcgtgacgctacctcatgatgtacttttcgttgtttactcattttctctcctccatgtttccacacgtgactttactacataatcaggcgtatctattttctcgtgtttcacaattttttcgtggtaagggcaaaaatcaattaagccgtgatttttagcacactcatcacacaaagcacaatcacaagttatttgccgttgtgctgacaaaaaatcttgaaagctcgttcttccgcaaataaatgttggtgactcgggatattgaatcacgtaatcgcaccatttagtagcaaagcgtttatggcacacaccgcatttttgctttgaaaaatcttctttaattatttctgccatttttaataaagacgctccatttcgtcttgctcttcatatcgcctaatattggttgctggccaaacgcttcgaatatttttttaatcggtatctgatcttcgttccatttgaatagcattattccagttggtttaagcactcgcattatttcttgaaaggcacaatgaaaatcatgtggccaagtcattaaatcaatggttccgtacttcttagcaagccatgatgtcttacccgcacggaccaaatgtggcggatcaaatacaactaaatcgaaagtttcatcagcgaatggaatgctcttccaatcagcctgcacatctggataaatttcaatctttcgctcattaccacgatccattgctgtgtagacagctctgcggatatccatgtaggttgtatgtggttcctctttgtcgtaccagaacatgcgactgccacagcacacatcaagaattttcatagaataaaccagctttccatatcgtagataaagctttccatctttcgtttgttaaattgatatagcaaagttgtttcatcgctgggacttcgaaacacaagagcttctttactaacttctaaatatccgttgttatcagtatttttatcataaaattcccaataatctgccccaaaagaattagcttctttgggagtaaacgtcttccagactttttctgcttgttcctttaagaatttaagtaaatcaatgttatctaaatagaaccgataatctagaagatcttttctttctgtgtggatttgaatattagacctattcacccgcacaattaattttctaccgtgttcgtcttcaaaaactctctcttccatcattctttccttcctccgttgctatcatcaactgcattaattgaactgccggatctactccctgttccttacataacacggtaatcgcttgatatagaactcccataatctctttaggttcaaaacccagagcataaaagccagctaagcatttatctttattaacttttaggacaatggtttcaccaaattcattcatttcttcaaactcctcataaatcaattaagttggcaactacgaaagcaataatcatcaatccaataatcagactaaatattgtttcaaggctaaccttgcagataatcattgtgataataattgccgttacacaaacaatccccacacataacggtaattgcttcattacttccacctcttaggctttctagctttcttgtgccaccattgtgaccactcataactcgtgtgatcgtgccaagccatcatatgcttagccttagcaatctgacgcttacgagtgcgcttgatcggcttatatccatgaagcatatatttgaaatttttaaaaaattgcttcatttctggcgatttaaaaaagttatccacattttcttgcgtaatatctatatcttcaatacgtttattcattcttgtcctccacaggttctttcattgcatcaattgcatctttaggaaagaaatctgaaagactatctagtttcttttgcgtaaattccatagcatcagctttttcattagcaaatccaaaatggaactcaacattattagcgcttatattcattgcatcaacatattgcttaacaggcactggtccctcagcacatcgcattgcagataaaacatatttcttttcaggaaaacgttctttaataggtgtatcgacatattcctttgtgatttccaaaagattgaaaagcccgtatatatcaatcactggtacagtatttaaatttaatttaacagtgttaaacatgcttgaacatcgatcaaaggtaagcagtgggtatttacctaaataaattgtgagcaaaccatcaatactttcagctacactgaaaccatacctagataatttctttttgaattcattaattttcaatattctctctccatcaattcttttactgtcgtgttgcataagttagcaattacctcgagccttttcttgcttggcattgagactcctctttcccagttactaactgtccctgttgaacacgtagtcgtacctaaaattttatttatcttatcggcaacctcatcttgcgttagattcatgttcattcttaactttagaatctctttgccaatatgttctttttgacgagcatgccgtagtttcaaactatcaaaggacatctcttttcgcttatctatcaacccttcatacttacttctaagtttaggattagcttcgattgttcttcgaagctttggcgtagagcaattaagtttttctgctatttgttttagagtaagttctgtatttagcagttcgattaaatctcggtgatttattttcgctctccgtctatcttttactaactctcgaaattctaaaatcgcttggtagtcttcgtgatcgctttgaactaaatcatctaaattgaaatcatagtcatttaatcgtttaccgtacttatcttctaaattccgtaagtgagttagaaagtcatttttagtaaggtaatcagtcatagttactcctgactacttgttcaagttgttctggatcaacataccgacttacaaattcaccgaacttttcccgttcgtcctcactaatcattactcggctgtgatcataatcaacactaactactgagcacaaagtatcttgataaagaactaaagtgttattctttagcgcctgttccgcctctttcatcttcattttgttctaacctttctacttcaatttcaatacgtggtcgatcactgtagtacttttcagcaactatctttacaatctggttgtcatcttcccatagcagaccgtttaagccatccaaagtagatttgatgtaattatccgtgtccggttttacaatcggtctgtgtattcctgagaggcgcaattcacgctcttttttcgatacgcttgattgaacttgtcgataaaatttaagactaacaattaacgggccagttagtggcttatccttgtactggaatttgcacatcatccccaactgtttcttgtaggtcgatacctttttcggatcatacaagcgtattcctttccacgttttagttgctctaggccgtgcctgttcgacgggctcaatattgaatattattttcattttcacctcgttctttagttcaataagtctttaataatcgaagcaattggtgcacaagcgtgaataatattcaaacataatgccattaataagcagacacttattgttcctccaaacattgccgtcatcccagaaacaaaatcatagctatcatgataatcacgatgcttcctaaaaaagaaaattgatagccatatagtgccagttaacgcagcaataaaaagcacaccgcataaaactgatagaacgattgctgacatttgatattgttgaaccattgtcttagcaacggccggcaactcgctcaattgtccattaagtgttttcagtaattcttgttccgcttcatgtttcatctagtcgcacctctcataagttcgttcaaatatatcttgatcaatagcccagtgctcttcatctatgccagtagcgatgtaatcgccaatgtgcaataacatctctccctctttagtaggtagataataagactctacttggtggtggtgacctttacttctatctaatcctatatgataatcacttatctgcttattagtagccttaaactgttcagcctcgattaaggctgtctttctgtatttatgtagcattagtaaatcaccgtttcctctctataattattaggatcaattggatcgctaacttcaaaatcagtaggcctgtagaaaatagcagtctgaaatacattaagcatatctgcaactaattttttagcgctttcctcgttcttagctatcacaatatgtctgacaaaatataatcccttagagcgcgtgacttcgtaaatgtacattattctttctctctcctttttatagcaattagttttgccatatcgttccattccacattaattcgctgtatcttcccaagataaggacgagtaacaattatcctgtcactagaaagaccttgattaattatttctcgggttgattctcttactattaactcaaaaccattgcgaaatataatctgcgttcctgttaaatactctctttccactagctgctcactttctttcgatttgcaatccgagcctttaatttagcaatatcctcgggggatgctttcttgtttaactctttttgatcttttttactccactcaggcattttctctcgaataggtggacgttttccgtgatttaatctaaattgattaggcgtaatgccatctgttacaaggacatcatcaaatcgcccattaaaccacgttgatccattcataggatgataccaactattgttttgttcacagtaaactaaatacttcttcaattgctttgccaggtaatcatccgtattcttagtggattcctttcgccatgctttgtaatggttaaacgcttcttttttaccctttttatttggatagtctttccaaagtttctcaaagctagttttaaggacagatacggacagtgcattgcctggcgatgcactatgtttattaatatcagtattagtattattagtattagtactatcagtatttagtagtgtcggatttaccgtatccggtgaatccgtatccggtttagccgtatacggaaaacccgtaagcggttggtccgttacgactaagtcttgattaccgaattttccattactatttcgcttctgttttctagtcacatagccatatttttttagttcgtccatgaagctatatgttttatctctgccatctttgttactatgggtgattaattcactcatatgaaatttccaatcgtcaggttttgatagcatatattccagaagacctctagctccccaactaagccttttatcctcaataattcggttgtctataattgaaaatcggtcttttcgcttttgcctaataattgccatttctaatcaccatattttcctttgacccccagtttctttaagatttctggtggcagcttaagtcctttaacatgtatgtggtattttgtttcaaaccttttattattaagtctttcgatttcttgatgatgaaatcgacacaacggataaagttcccgtttagaatgatcaattttgttgcgattattccccataccaactactgacccttcgacatggtgaaagtcggcctttttgccacaaataacgcatttgtctttcagcaagcacttgtaaatgaagtagctttcattacgtggcaacagcttataaccatttctaacaggaacatcaaactcaaagataaaattgataacatccttaataagcttatttgcgtcacttacagtattttctgtattatcagcaagactaatctctttaccagatgtcatttttgaatatcttttatagaaatattcctttaatttttctttaggcatccctgaccactcatgaatatcattaagcaatgcgaagaatagagtgcgttgcttagggtgaaccttgcgaggatccgtaaattcaaattgaataggaactccattgatcaagccatcattcaaaattgcgatatgttccaaattaatatttttatctggaacaattacccacatgttattgcgatagtaagcttttccactttccatttagaatggcaattcgtcatcagccagatcaatactttgtccaccattgccaaagtcattattctgattaccgtaatttgactgagcattctggttttgctgaggactatttgatgttgcgttgtgtgcattattatttggtacctgtgaggaatagttattattagattgttgactattttcttgacgtggctctaatagagagaaactatcgacattaatctcagtcacgtaaactcgctgtccttgcttattctcataagtccgagtctgaattcgaccatcgataccaacaagtgagcctttgtgagtaaaattagcaaaattttctgcagcctttcgccaaataacaagattgatgaaatcagcttcacgttctccttgttggttcttaaattgacgatcaacggcaatcgtagcttgtacaacagccgttccacttgtggtataccgtaattccggatcacgggttagacgtcccgttaaaattgttcgatttaacatttacttctgtttctcctttgatttatgaatatcttctacaaaccatgtatttagattgtcagcattgatttttagcaaattacattcattttgtaatttgcttaaggcatatacttccttaccaaacgtttcgccaccattggcttgtgttatcatggcagcaatcgtgtcaacacgtgtcatcatctgcattaataatgttagtgtaagattttcataggttggatgaataattcatctggtcgtggaaatcttttttgtagaccaatttacttatttacaaaaaaagaaaagaccagtagcctttagtgtgtcgaatactaagcaaaggcaggtctttcctcatggatattttaacagaaatcgagcagaatttggtgaaatcaggcagtttatttgaagctgaacagattattttaaaaggggtattggagttaggacaagtaatcatgcaaaactttttggaaagcttagatcgaagcttaaagtcccaagctccagcgaactatcaagtaattaataaacagccacggacgcttaattttatctttggcccggtgacttttcaacgacggtattatcaggctgggacaaagaaacgtgaattttacttagaccaacaattaaaaattaaaccacgtcgtcgtttatcgccacaatacttaatgatgatggctaagattgcccaaacaactacaatgcgcaatactgccgacattttgaaccttgtatttgacagcggaattactgccgattcggtaatgcacgccgtgcatgagttaggaaatcaggtagctaaacaaactcaagcaaaagaacaccaagctactcctcgccatatgcctaaaaatttaactattgagggtgatgcctttatgattaaaggtaaaaaagaagcaggtcagctgactcttgtgcaccattatcgggtttatgagcgagtagctaatcaaatcattaatcggcatgactttctcagtgttgggcaccaaggacggcttgaagcacgactaagtgattatttagaccgccattataagcttgccggtcaaacgatctttttggccagtgacgctggcccaggttacgaaccagctaagctattaagtctagttcctcaaggtgcacatggtgaatactttctcgaccgctatcattgtttacagaaaattgaacatactttaggccggcacaacgagttagccatgcgagcaattaaagccgttcgtcatcatgatcaagcagagctaacaataattttagatacttatgaatcacaaaacctaacggaaaaacaagcagacgacctaatgcgtttaagaaagtatctacagcgaaattggcggtatatcctctcaccacaaatgcgtggatttaaggatattcatttaattggttcagtcgaaagttctcaccgggcttttacttaccggatgaagaaacagggcaagtcatggactaagcagggggctaaagccatgattggtttaattgaagcccgaatgaatggtgaactgcaagctagtttaaatacaatcctagaacaattaacagttcttcctcgagtggctcaaaccagcctattacaggaaatgcatattcgaactggagagtttctaagaaaggcaccgacaaagccgtcaattggagcagtacaaggaataattccgattaacacggccacaagtagaccaatgggacaactttttaaggcactaacccactaaaactgtatatttaaaggctacctatgaaaacttgacagatacattaataattgttgtttcgtatttttaagtgtcatgtgttatactcaccttgtgtattgttttttgatatgagcttttaactatttgcggtagttttaagctctttttctttttgcttatcgactttttcaaactcagcagaaagaaactcaaatatttcttttgcgattggtacttggtcttcactcatttcatcaatacggtgcagatcaagtatctttttcattggtacataaaacatttgttgaacagaattgtaagacgtttttcgacgccattttgaactcatatgatcgtgacaatagctgtcgatacgttttcttagttgcaaccagccagtagtaatcttcggcgtattccttttgttcagcgcttcatatacttgatacttaactttgtgttcaataattctgtttaactcttcttctgaaatttccatttatatcacctcccctcattgcaataagttaggaaataattcgcctagcaagataagaatcagtaagacagccaaaggaaggactccaaatagtgtccaaccgccaagccagcaaatgaacatcaagaaacatattcctgtgcatgcaaaagctctcaccatttacacctcaaatccataatcgtcaccatcaccactgaactctaagaccgatagacttcttaagagacaatcctttgagcaaaaaatattatctttaccatcaggatcatcaaaataattacgttgcagatagttgtctcctacaatgtaataggtatcgtctgggtcaatatcttttccgcactctgcgcattgttttaattctggttcttcaaacatttttaaaactcctttttctaatattgtgtcgcccacgataacgtggttttagtattttgagactattaccaaccaaagtatcaattattgccattaagatgagacacattgctatcacacaaattgaaacaataaattctgtcatcctatgctcctcttcgtaaacgtccagatttttgttgatgatactttgctgccttgtcttctaaaaaggctacccattcattttcatgaatccagtaagtccgaccagtaattctaataatcgccgtactaaattcatcattgagttcacactcagccacaagatcgctaaattgacttttttctagcccgtactttttcattatttcgtctttggttttcacgtcatcacatttcattactgatcctcctcatcaagattcgtaaaccgaatatgagcaccttgtgactttaagaagtcgattagtaaatcacttcccgtttggcgttgatgaaatttacctaaaatgttcataattcttactgctgtaagttgtacgttgatattcaagtattccaataagaacttaatcccatcaggaatcttgttattccagcctacgttatcccctatccaatctgtaacagtgtaataatctttgcttccccaagtatgtcctttgtattctttggtgattggaaatacttgagcaaattggagaggtgttagtcgcttaagtgtttcgtctagcattaagacccatgccttttgcgtttcccagttacattcttcaatcacaggtgtccaataatgaatcaaaataaaagctagttgctgtggggttcttttctcgctcatattcaatcagtcctcaggtttagttaatggcaatttatgaaccttttcccacttattaagggtgactaattgcgattcagtaatccgcttagcattttgtggaagactgtagtaattaagctgattagcataaccaagtgcttcttcaaagtcactatgaaggattgctgtatatttaattgctccaaaatggtgcttagttaatgaatagaatgcacgaacaatatgcccatatttcttagaaaagaattctttaccaccatattctgggttattgaatttatgctttaaccatgatttagtggtcactgcggctcgacttgtaattgcttgtttaagccgatttgcttctccatcagttaaaggaataaacttcttaatctcctcaatactctgattggtatattcttttaattcttgctttgcttgttccgtagattcagcaattgattcatataccattttgttaatctcggcttggagtgcttgtgcttttactaaatttccaagcacagacaagctagatttctctttactttttaccggtgctgttaatgtttctttcattactgataatctccttctataactcgtcgaccgcctaacattgaactaagtcgatcaatcgaatgttgtaataattcaagacgcttttgcagattcttttgtgcttgttcacccatctcatcaatatcttcttgactaagtttctgcaattcaggaatccaatcattaatttttaacgaagtgctatagccgttaatttcagcttggcgcttttttcgtttcaattcttgttcctgtaacttgtcagaactattggtattttttttaatacgttcagcggctttaagttctcgtttgtaatactcaatattttctttgtctttagcagactgttctttcaattcaacaatcttagccttaatttcgtcataatcatcgggcttaactggaacttctttagttactgtcttagtaataactttttgttctggttgctgcttagataattcagaattacgtttgttaagctccagttgcactttacgattgtcctctaattcagcttgttgattagcaattgtttcgtcacgatcagcaagttcttgttcgcgttgtttgagtttagcttctagtgctttgtactctttatgagttttaatatcaccgttaaggactttcttagttaactctggatcagcacttggcttcgaaatatcataagttaatgacttgggcagagactcaaacgcttgtatttctttactgctgtccaaattttgaacagcaacatatctattgatgtagttgtaagctgaagttctactaaagccgatgtactcaatccatttggcaaaggctccattgttatggaaactagctaattttttctgtgcatcatataagatttttccgatttgagtagcactatccgaaacaacgttcatgagctggtgagtactttgattgaggaaagctattgttgaagtatctaagctaggatcagaaaaactcgttaaaggcttgttggtattttttcccattgatagctatatcctcctttaattgttgtacatatagtcgttcaaccatcctgtttgatatgcgaattgttttgatccctttgttttcaaagaatttgtctcttagtgcatctgcaacctgccgatatttagaattgtgactggcaccatcaatttcaaaaattgtattagtgtcagggtcaaaaaagtcggcgacgtatttcttcgatccccacttggcaagaccacccttccctgttccaaaagtgacttgccgtagtagctttggaaacatcgttccaaacatgaattcgtgagtagtattttgaaaacttgggtgatttatctccggtatagtagtaacaatttgcttaatcgcattcgtgacaatcactccttttctttagcttgagataagtgcattaaatactgtggtgttacgccaagataatctgcaacggcttgaagtaaatcatatcgaggcaacgcagtattccagcgcccgatagtgccatttccgatttttaaatcatgttctatgcgatagatcgatttgttctgctcacgggcaacctctttgatagctgtatatagaggcacactttcacctccctagtgtgagaaaactgcctaattcttttgcctattagtattgacaaataatagactaaaatctattattagagtataagaaaaacaagggaaaccactaaggctcctaaatcagaacagttatcgtaattgctatgtgctccctcaagcacaattacagtatattagatttgtgcctaatggtcaacccctattttagatttgtttctattaggagtgactttaatgtctattaaaagcagaattcaaggcctagccgcacaacgccacgagacactcgccgaattggaaagaaagctaggtataggaaacggaacaatcacaaagtgggataaacgatcaccatcatctgaaaagttggcggcagttgccgatcactataatgttacaactgattatcttctaggacgcacagatactccacaatttactcggaaagatgaacgagatgtacaaaagatattagaagatattacaagaggattaaataataaatctgatttagcgttcttgaaaaatggaggcgaggaaattgacccagaagacgctgagttattaagtgcctcgcttgaaaatgtaattaggcagtctaaactaattgctaagcaaaaatttacacctaaaaaatatcgaaaagataaggattaatgaggtgacttatatgttatctaaagaatggattaaacataaagctcacgaaatagtctattcaactggaacgcacaatccttttaaaatatgtgaagaaatgggtattccttattattatcatgatcttgggaaagaaattatggcttatcatactaaaatactacgagtacctgctattgttttatcaacacgaaatagcaattttgaaaatagatatgcatgtggacatgagttaggtcatcatttttgtcatcaccaagggaatactgaatgtcttaatagaagcaatcgaaaatttgttacttttggtgaagaatatgaagcaaacaaatttatggtagatatgatgcttgatggagttaacgtccatgattttgaaacaagggaacaactaatgagatactgtcgcatcccttcttgggccgaacggtacattgattgggaattattagtttagccgaataagaaattggggggattattctatggaaaataacaaattacgcttatgggcaatgcatcatccactaaaagcagcatattgttggagctttattgttttaatttttgttgttaatctcaatatttcgggtttactcttaaacttcatttttattttgatgaccattatatggatatcatctgatatccaatcacaacttgcaactaaaaaaagagctattaatattcctaataacacttatcgtaatcaaattgactttagaattcctctatacttaaatgctactctatttgcgtatcttgctataggaagttttgttgaaggaaatttattaattggcatttgcttatcattaattgctatctgttcttttataccctttaattatcaagacagtgagtataaccatatgcttaaacaaagcaataaattacatgaacaagacgaaaaattaaataatacaccacccactaatcaagttagtactactcctatcttgaacaccgatgttgaagtttcggtgcctaccaacgttgaaaaacatgttttacaccataatgagatcgacttgattaaggagcatgccaaattagttaataacaacataacgcttaaatcgaagaaaaaaacaaaaactactagtaacacactatatattgatgtagcaggcactaactattatcgattaaaaaatgccgttggttatgcaagaagtaatgatttgttttttgtaaggtatgatgatatgacagcatctgagatccgtgaagatttttatactgatgatgatcctgtctatgaaacggatctcactgatgtaataaatgaaatcaaattaattccgatctatgtaataaatatgatagcaatgccgttaaagtcattatttacattgaatctcaatcttttatgatcggatacattcctaaagaaaactcaaaagatattaaacgattaattgaaaaggaaagggcagatttagtaaagcttacggtaaaaggatatatgactggtggaaagtataaagcagtcaatcttgatgaccatatttatactggtgagaaaccttattcattcagtcttcaaatttcagtagaaaaaacaccttttgctcaaacaagtaaagggaaaaataaggaacatataattgatcagaggaacgaattaataattcataaactaagaaaaccacttaattcgtttgtgtcagtagatatagaaactacaggactaaatgcatcttttgataaagttatccaaatttctgcagttaagtatgtagacgataagctaattgatacgtttaatagttttgttaatccgggtaaagagaaattgccactcacagaatttataattaataaaactggtatcactactcaaaacgtgaaagctgcaccaacttttaatgatataaaaggttcatttgaaaaattcgtaggtgatcttccttggatcggtcataatatctttgcttttgatattcctttcttatatgaaagtggtctttcaattaacgagttctatgccgaagatacttttataatcgcacgaaaacatttagatcgaacagtattaggaaatttaaaattacctactctaaaagaatattatggcattaatgagccgtcacataatgctctagctgatagtaaaactgctgcacttgtctataagcatctcagagatgataagttacctaaaattcttaaagatgctaatgataagatgctctcattaaacggtattcatttcttagtaattggtagcttcccagaattcgatcatgatcaaatgattgagcaaataaaattacgcggtggtatcattgaaaatcgctggactaacaacactcaatatttaataaatggtattactaataagcattacaaatctattcaaaatgcaaaagatcataacgttcaatttttaaattttaatagtcttgttgctttaataaatacaaaagatcaacaattacaagtattcgataactaatgaatttaaaacggtcaaatccgtggccgttttaaaaagcacgttaaaagaacacctgtttgcattttaaggaggtgatgtcctatgaaaaataaaaaagcccattccctactgcaataggaaataggcttgactaatttcaccaatcttcactgcaatggagattgattgaggagttaaaaatcagttatatcccctaatttttaactccttcattataacatttatgtttatttgaatggaggaacgttttcatgtggattaattcgtataaaactagcaaaacaataaaaggcaaaaacgttcaagttatacattatcaatttcttgaacgttacaaagatcctaagacaggaaaaaataaaacagtttcagtatcatatgatcgaaatacgccccaagttcgtaaagaagcaactaataaactagagaaaaaaatagaaaaacgtattagggagataaaatcaagcaataccaatattacgttacaggaactgaccgatgaatttctcgaatactataagcatcgagttgctcttcgaacttatataattaataaaaatgttctacaaacaacatgtaatactcttggaggtgacacgttagcaaaacgtataacaactccaatgttaaataaatattttgataatcgcctttatgataaaaagcacccagtatcaaatagtacagttagaaatactcgcaaagccctatcattagcttacaagtttgctaatcgttatggatatttgaatattaatcctgtgaaagatacggaagtgaattggcgcaacgaaatagatgcacggcgaaatagaattgaaaacaaatatttaactcatgctgaatatcgtaaaattatcaagtattgtctcaaaaagcacaaacaatactatgccgacgcttttaagcttcagtatcttacaggtttacgttttggagaattgattgccttacaagttaaagatgtgcttaaaaaaagtggatatacttatcttgatatcaatggaacaatggtagttaccgacgatcactcaaagcagatcaaatcagatcgtacaaaaagtattgccggaattaggcagatcatgctttcgccaaaagccataactattgttaaacgcaacatgaaggataaaaatccagatgactggttaataacccagccactcacacctaagcgtccagaaagaccactgagattaaatacagcaaacgtctttcttaaaaaagcttgcaaagaattaaagataaataaaaaagttactactcacttttttagacacacccatgtatcaaatttagctgatttaggaatccctttgcgggtaattcaaaaaagagtcggacacgctgacagtgaaataacccggcggatttatttacatgttactaaacgtacaacaaaaaagtttattgatatgatcgattcaattgatgagtttgactagcaataaaacttttcatttctgctatatttgtgctatataaatcaatttaaaatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactgtgtgcagttcgccagtagcccttgcgggtactagcgaagacatatgcatcacgctgggacagccccagcttctgtaagttagttaccttagttttaagcttcttccattgcttccagatatactgtcttattcgggccctcaaccacttgtcaaggcgttgaataaagtcagttagtttcccaattgagtagtactgaagccatccacgcatttttcgatgaatttcttcaaacattcttgtcagggatattccacgattacgtttagttaataacctcaatgctttctttactcgttgttgcgattgttttgctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttatccaactcatttagatagatattcgccagtattggtgacaatggccctccttgtggggttcctttttcactcttagcgaaaagcccatggtctaagactccgctagttagaaacttacgaatgagccttagtgtccatgggtcatcaatatattgttgaagatacttaatcatcaagtcatgattaacattatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaattccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctcccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcgcagtggacacccttgtcctcagctcatggttccgactactacggcccatagcggactctcaccgcctagctaatacccatgccgggcgcacacgaaaaagaaacccttgtaagtcgtggcatacaagggtttctttttcgtttttcatcttgtcttgaagacaaacgttttatatttttacaagtcctattctaataggcttttactgtcatgtcaacgtttataacttggcttattttccgtactattccgtagttttccgtaaaaccagatatcttctgccccctcagtgcgccttcggattatttcacaaattcaattttactttttctttaataactgcacttcttcaggctttaatgcacggaattcacccggctgaagaccatataaatttaatggtccatatgtttcacgatgaagtttagtcaccggatgtcctactgccttaaacatattcttaacttggtggtttcgtccttcgtggattgttaattgaacaaggcttgtcttcttggcacggtcaacattcaagagcttcgatttagccggttttgtctttcgaccatcgatgactacccctaaacgtaattgttttaactcatcatttttgacgattccttcaaccttagcaacataggttttttcaacttcatatttaggatgcatcagtttatttgccaaagcaccatcatttgttagaagaagaattccagttgtatcatagtccaatcggccaactggataaatgcgttcatcaatctcagcatcatgaataatatcaaccactgttcgacggcctttatcatcatgagcacttgagataactccccgcggcttatttaacaagtagtaaacgtgctgttcgtgatggattggaacaccatttactacaatctcatcgtgaacgctaactttagtgccaagttcagtcacaatcttgccattaactgcaactttcccttgaaggataagtttttctgatgcccgacgagaagctactcccgcttccgccattgccttttgtaatcgttccattaattatcgtcctttcgttcttctcgcgcctgtaatgcttcaaggaaaatatctccattaatattgctcatttctaattcgtcttgatcggtaacggtgggagttcatctaaatcgcttaaaccgaaatagtttaagaaagccggggttgttgaatataaaaatggacggcctggtgcatccaaacgtccatgagtgtcaactaaaccacgaaccattaatttttgtaatgatcctgaactttgcactccccgaatatcatcaatttctagccgcgtaattggttgccgataagcaacaatggccaatacttctaataatgctttagtcaatggtaccgttaacgggacttcaaagtaatgtttaatgacctctgctaactgaggcttggttgctaaacgataggtctgatcactttcaagcaagataaaagcagatgtgggatcatcttcatacttcttttttagctcttgtaatattgttagaacagccggtttcataaaaccagaaatttttgctaaatcgcctagggtaattccttcgtccccactaataaaaagtaatccttcaatctgcgcttggttggttagtttcgtattcgtcactcttagatccctccgctaaaattattggttcaaacaagccaccttggttaataacaatcgcttgatgctttgccagttcaagaattgctaaaaaagttgtaactaagccatcgcgagtatgtaaatcttcaaacaagtcttcaaacctaaccggaccatcatgaataatttcaatcacgtggttcatttgttgaccaacgcttactttttcagctgctacagtttcaactaatggagtagctaattgttggcggcgaagaacggctgcaaaagcttgttgcaaatccgttaatttgatgcccggctccacgtgagattttaccatttcacgtggaacttgcattgctggtcgagtatactcctgttgacgcagattttctttatcttttagtcgatctgccgcttttttataacgctgatattccaaaagctgttccactaattcttgtcggggatcaagctcctctacttctagttcatcatccaatactggcggcgaaggtaacagcatctgacttttaatgtccatcagagtcgcagccattacaaaatattcacccgcgacttctaattggtggctttgcatctggtgaaggtaatcaaggtattggcttgtaatttgcgaaatctgaatatcataaatatccatttcagattgctttattaaatggagcaataaatctagtggtccttcaaagtcatgaacctttatgaccggttgaaatggattttgtggttgcacttgcttattcattacttctctcccacatgctaattattggttgggttgctaaggttcccatgaggcgtttatgaggatattgatcgtgaacgccatctaataaggaaaaaatattataccccgttcgttcgcttggcgtaaacgataagcggcgaaccagcacgtaacaatcccctatttctatcatcacaattccaataaagtgactatcatccatgtctttccacaaaaagattggccaatcattagccagtgcccagtccatctcttccataaaacgattatcttttcgaaggtcttttactaaggacaataaacctagggcgattttttggtaatcttttcgataacgaactaacatcgtattttcctttctatgcacgaggatgatatttcatatagttagcggataactgttgcggcgagacctgtaaatatggttggagagccttcatcgcgttataaccaaggatttcttggattaattgaacatcggcgccattttctattaaatgaacagcaaaagaataacgcatagtttgaggagtaacttcttttttgattttagcctcactgacccattccttcatttttttccaaattccttgccgcgtcaaaggataaccatgagcatttaagaacacccgagtttcgtgatcatctctgagcaaaagtggtcgaccacggtttaggtaaccggtaagccacttgactgctggttgacttaagggaatcatccgctcacgttcattctttcccgttagttgtagaagcttaacgtcgagatgaagtgctgtcagatccaaggcaattacttcactaaccctcattcccgttgcatccataatctctaacaacgctcgatcacgaagaccaattggggttgaaacatccgggactgccaacagttgttcaatttctttttcagttaaaattaccggtgcaggtggttggttaaaggtatactggtgatcaatcatttccattggattaatggttaggttatggtgacgaatcatgtatttataaaattgccgtaaacttgaaatcacacggttaattgttgaattagcttttccctgctgacgaagactattaaggaggtcaattagcaaatagtggtccacctgttgccaatcatcaattcctcgatcttctaaataagtcacagtttgttctaagtcccgttgataactcatcaaggtattatcgcttaattgtcgtttatcttttaaaaaagctaaaaacgcagccacttcattattcattaatcttgattctcttttactaggattaattgaccgttttcttgttttactaatttctctttaagcaaatgcccaatagcacgtttaaactgccccttgcttatgccaaagacatcgcgaatgatcgatgggtccgtcttatcagtgtatggcaagcggtgatttataccatgttctaacattgtcaaaatcatttgtgcatcttcaccaatagcttggtaggcacgaggcttaagggagagattgagactaccatgtgacgaaattccaataacccgcgctttaactcgttgacctaatcgcggttcttggtctcgttcacttggatggatgaatcctaaacgataatcatcagtaatcacaaaggttccactcatcttaagacggtaaactgtggcataagtatcatggttgagcaagcgtttatctggagctgctgaaatagtttgatagatttggtcatctgctaatttaccccatagacggtccttatcatcaacttgaagggacattaataaacggtcacctggttgtggccataagtgtttcaagcttggtaaatcatctaaagagacgacaatatccttattgggaagaccgatatcaacaaaaacccctaaatcacgacgaacattaactactgtaccataatcgtaatggtcaacctggatcgttggaatgtgtttacaggtcatctgtagttggtggtcctcattttcataaacaaagccgcgtacctgtccaccaatatgtaattcttgaggactttcgcttttcggtaatcgatacgtttgcccattacgatctggttgaacaaaataatcggtatcattttcatcaatcattaccgctgtaacaacttttcctaatgctgaattcatttttatcacttatccttttttattctatatcgattttacacggtaaaggcttattttgctagtaagatcaatgattatcattggtataaaaaaagaccggttactaatgaccgatcttttcgcagacaatattataaaatattagtcgatagtcttaacacgcatcatgttagttgcacctggtacacccaaaggaacaccagcaacgatgatgatcctgtcgcccttcttagcaaagccaagttcaacagccttcttagcagctaagtcgaacattgtatcagtgttcttcatttcatcaacaacgtatggttgaacaccccagttgatcataagtccacgttctacacgttcgtttggagttaatgcaacgatatcagcattaggacggtacttagaaatcatcttagcagtgtagcctgaagcagtgtaagcaacaattgtgtgaatgtctaagtctttagctgcgttagcaacagcagaaccgatagtttcagttacgtcagacttgtcccaatcgaacttttcagtaccgaattcccaaaggtggttttcagccttgatgtcaatgttgttcatcattgcaacagattcaactgggtagtcaccgttagcactttcaccagaaagcatagtagcatcagtaccgtcaaatacggcgttagcaacgtctgatacttcggcacgggttggacgtgggttttcttgcattgagtcaagcatttgggtagcagtaataactggcttacctaattcgttacaacgcttgatcatgtgcttttgaacaattggcacattttgggcaggaatttcaacacccatgtcaccacgaggtaccattaaaccgtcagaaacagcaatgatttcttcaaagttgtcgataccttcttgagattcaatcttagggaaaatttgaacatcttccatgttcttttccttaagtaattcgcgaatgtcaagaacatcttgagccttacgaacgaaggatgcagcaatgtagttgatcttgttttccaaaccaaaacgaatatcgctactgtccttttcagtaatacctggtaagttgattgatacaccaggggcgttaacacccttccgagaaccaagaacaccatggtttaagacgtgacatacaagttccttgtttgcatcgtctttttcatcaataaccatgtcaattaaaccatcatcaaaaagaacatggccaccaacatgagtatcatcgtataagcctgggtaggtaacagcaatcttgtcatgagtaccttcaattgaaggatccattgaaatgcgaaccttgtcgccaatttcaaagttgatcttaccttctttttgaacagtagtccgaatttcggcacccttagtatcaagcataagaccaacgtgcttgccagtaatttcttcagccttgtgtacgttttcgatccgacccaagtgttctgggtggtcaccgtgtgagaagttgaaacggaaaatgttagctcccgcattgatcaacttaacgatcgtatcaacatcagtacttgcaggaccaagtgtacttacaatcttggttttcttcataaatgaatctctccttttgcatctatagcatcaatcacaatctgtaattgtatgcctcatttgcacactgttatgatagcacttttcaaataacgtgtctttattttttatgcaaaaggttttaaaaaagcgctatcattctaaaattagttattttttctaactgttatttaattttatagctttcagtgattactattaagctgttgtaagacaacgttttcttggccaagaacggcgacaagcgccttttttgctttctgagaattttttaaccatcgtttttggtcaagcaggatcttcttatcgtttgctggataaaacaacaagacaggaattgaaccatggtattcattaaaaatattatttaactctcgatgcaccatctcagtgtctaatgacggtaagattcgtaaaacccatcgttgcttgcggcgtttctgttgaacttttttaacatcctgcaattgattagcaactaattgtagaccccgtccctcacgatattctactcgacctctgacaattaaaatcttatttgtttctagttgctctttgaactgctgatattgtttgggaaagacggtaatatcaattgctccggtctcatccgttccattaacaaaggccatttcccgatgttcacgtttagtataaatagtcttaacgtgatttgtaaggacaattattgtcgcttctgaattcgggtataaattagcaattttagttgcatggagctgctgtcctaattggtaatattgggtaaccgggtggccggaaagatacactcctaagtattcattctccttcgttaaacgggtcaacagagggaattcatttcgttggtcaattgccgtttggagagccggatcgtcaaaattagcaaaaccagcaaacaactcaatcccggaaattaatttaggaagggcgtcaatcatctccgctcggttatattccatcttatcaaaggccccactatagattaacggttcgattaattcttgcttttgccaacgttctggaatacgcgcaataaaattacgaagatctgtaaacttgccattttcctgccgttcttcaagaattgcggcgacaaaatcacgacgtactcctttaatagcagaaaagccaaagtaaactgtcccatcatgtaatagaaaactactctcacttatattgattcgcggcccactaaccttgacgccaaattgctttgcatcccccacgtgccgtttcaatttctcaatattagtttctgcattcattagggctgtaaaaaaagctgcagggtaataaactttcaaatatgccatctcaaacgccatcatagaataggcaactgcatgcgaacgattgaacccataattagcaaagcgatcgatatattcaaatacttggtgagcaacttgtgctgaatagccgtgttctgttgcgccggcaataaattttgtccgcatatcctccattgtggcctttttcttcttactcattgcccggcgtaaaagatccgcctctcctaaggtaaagccagccattaccgaggccaactgcattacctgctcttgatagaccaaaataccgtaagttggtcccagaattttttcaagtgaaggagcaggataagtaattttctcttttctagctttgcgggcggtaaaatgagaaatattttccattgggcccggacgataaagtgcattcactgccacaatatcttcaaaattcgttgggtgaagattgaccaatacatttctgatcccacttgattcaaattgaaaaatcccttcagtttttcctcgctggaacagttgaagagtcaacggatcattaaagttaattttttgcaaatcaaaattagggtcttcttgccgaatcatttgaaggatgttatccatgattgaaaggttcttcaatcccaagaaatccatttttaatagccccagcgcttctactgtgtctttggcaaactgcgtcattaataagccatcactaccatcttgtaacggcacaatttcatgtaatggctgctcagaaaggacaatgcctgccgcgtgaattgaataatgacgcggcaatccctctaattgctgtgcaacttgaattagcaaacgaaatttaggattatcgtcaagaagattttttagttgttgtgactcctttaatgcatctttgagtgtcacgtgaaggccatgtggtaatgcatcgattaacctttgcatatcgtaacggggcaagttaaagacccgactcacatcacgaacgacttgtttagcggctaatgtcccaaaagtaataatttgggctacgcgttgatgaccatatttttgatgtacatactgcaaaacttcatcacgccgattatcaggaatatctaagtcaatatcgggcatttgagctcgttctggattcagaaagcgttcaaataataagtcgtattgcaaaggatcaacttctgtaattgctaaagcataggcaactaatgatcccgcagctgatcctcgtccagggtcggtcgtaatcttttgctggtgagcaaaattcattacgtcccatacaattaagaaataatcatcaaagcccatttcatggattacttttaattccatcgctaaacgttcttggtactgttgaatagtttttcctggtgctactcgtctttttttcaatccttgaatacatagagaacgtaaatattgttgagatggtatccctgcttgatttttaaaatgaggaaggaccggggccctaaattgaagttcaacgttgcagagggctgctacttcaactgtcttttgcgcggctgcactaagtccctttgcattgtaatcttggacaatctgttctttcgaatgaagataatgttgtcctcttcgtcccgcttctattgtcggatcttttaactcaactccggcatcaattgcttgtaaaacccgactagcaaaaaggtcattagcatttaaataatcaactggagacgtccctactaatggcaaagatagttgttttgataattgttgcaaggtatctatttgaacgtcatctaaccgcgaattgactcctaacagaacgctatcatcatcccccagattagcaagctcagttaaaattgatgttggctgagcaagtatactaaaaactgtactttgtgggggataattataaacaattcacccaataaacaactaatttgcgcaatcgttaaaggtatttttttatcttttcgtgtttgctgaagcgtcgataggtctatcagatgctgataccctcgttgattcttagctagaaatactaaatctagcttggtaccatccgtctcatttaatgcaactaccagccgcaagccgagaatgggtttaattcctgctttttttgctgcattataaaattcgacagccccatataaaacattttcgtctgttaacgctaatgccttataccctcgttccttagccgttgtaactaggtcagaaatccgggtgggactttttagcaaactataactactcttaacatctaagggcgtaaaatccacttcatttcacctctcaataaaattatatcaaatcaaactaaatagagaaattaacccaaccctttcaaaagcattaataaatatgctagaatatggtatgacttcaaaggggatgaccaacatgaactttttattaaagaatatcgtggctggtatttgggcacttattctgggtgaggtcctagcttacatcacaagtcaactagaatcgatgacaccagactacacccttgtcggctggtgttctgtaattatgggattagtcgttatcaattgtgtggataaaattaccgcagatgcaaatcctagcaaaaatgaagattaattaaaaaggattgagtccaaaatggctcgatcctttttaatttatttatcttcttccgcagtcaaccgcacaatctcaagcagggtgtccaatgcgcgttccatcgtttgcagtgatacatattcaaaacgcgagtgcatgttttctccaccagcaaaaagattaggagttggtaagcccttataagaaattgttgaaccatccgtcccgccacgaactggatagatatccggtttaatgtctagattttccatagctttcttcgcaatttcaacaacttccatgtgattcttaagcgcatcttttaagttgtagtattggtcataaagattcatcgttactaggtctgcaccaagttcatcatttaggccagcaacaacccggtcgagtaaatgcttccgttcaataaacgtttgcttatcatgatcacgaattaaatatgtcattgaagcatgatcaacagttccatcaaacttgtataagtgatagaatccttgccgtccatctgttcgttcagctcgatcatgtgctggcaagctattttgcaagtcaattgcaacctgaatagcattgatcattgttcccttagcaaccccagtgtgaacatcttttccttgaatctcaatttctgcctgagctgcattaaatgtttcatattccaattcgccaagtggaccaccatcaaccgtataggcaaaatcggccccaaaatccttaacatcaaaatgatcagccccggtgccgatttcctcatcaggtcctaaaccaatcttaattgttccgtgcttgatttcaggatgagccatcaggtaagcagccattgtaacaatctccgctactcctgacttgtcatcagccccaagcaaagtagacccatcagtagtaattaaagtattgccctgatatttttccaatgatggaaattcagtagtagttaaggcatattggccatctttatcaagcttaatatctgacctgccatcgtaatctttgacaatctgtggattaacattatgagcattaaaatctgcagtgtcgatatgggcaatgaagccaaccgttggcacatccttgtcaatattacttggaattgtagcgaccaaatatgaactttgtggattaatatgaacatcactcaaccctaaagatatcaattcatcttttaattcatcccgaaatgtcaatttaagttagaaagaaagtagttgctcatcagtgacgtaggacatgaatacctcatatggagttcgatagcctagtgatttgcggggcaggttatttcgcttactcatcagttgggtcaccaattcatcaggaagattgcggaaatctagctgttttgttaagccgtcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgctgcgggaatttccgaagccactgacctaagtgttggttaatcgcatcagccgtcttttcgtgcacattgagtacaatttcgaccttcgattggcgttcggtcagggtcattaccgccccttggtgctttttgccttggacggtatcagcttcaaggtgtccaaattcagtggcatagtgcggaaagtccttggcacgctcgtgaatacttcgccccaattggccagccttcccgcggcgctcaatatagccattcgggtgccgcttacctcgcatgggcaaagcacggacatccaaaccgaactgcccccgttcaaacatccggtaaagagttcgccggttacaactaattgggcgctcagcgcgcccaataatggtgtcaggcgtccacccctgggcaattttgtcgttgatataagtaagttcagccagtgacaactgagtacgttttcggccacaacgttgcttattgcgcatatagtgatcttgataatcagcaattgaggcaccggtttccaggtaacgataaacgcgataaacggtttcggcgctacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgcatttaaaaatgcagtttccttaggatcagaaggaattgtttttgaatctggatttgaccttgtttcagttttaacatacttcaaaaaacgtggtaataacccctcatacttttcctcactcatgattagcatctccttatctaaaacctatttagtaataaaagtaaacggctctgtattaactctactctctagcacctcaaactgccaattattttcattcttccactgggtgattaagttagcaagctggtgggcagctaccacttcaatatgatgtccaggatcaataacaacaaggtgattagcaatcatatcgtgcgcaaagtggtaacttacatctccagtgacataagcatcagctccagtttcaagagcttgttgataaaaatcttgaccagcaccaccaagtactgcaacacgtttaatctctctctcttggtcaagcgggttgacaattaaccgtaatccgcggatgccaaaaacatccatacaataatttgcaaatttttgcgatgttaatggttcattcagctcaccaacacgccccattccaactggttcaccgcttattggatcatttcctgctggcactaaaggcacagtattagttaggtgaagttgatctgctaaccagtcatttattccgccattagcagtatccaaattcgtatgagctgcataaacagtaatattattcgccaaaagtttagcgtacattgcattttgcggatcccgcgtatctagattctttgctgggtgaaacataatgggatgatgagcaaaaataaagtcaatattttgttcaattgcttcatcaaccacttctgggcgaacatcaagggtggtcattagtcgagtaatcgggagatctggattgccaatttgtagaccgacatgatcccatttttctgctagttgcggattagcaaatttttcaaaacgcgcaattaattggttaccggttgtcatcggcgatcgcttcctttacttgtgataaaaactcgtttatctcattaatcttttttactggtggctgttgagccttttgcatctgatcaataacatgggcttcacgttgaagatattcttgccattttttcctaaaaacaggccctttgttttccaataaaaatggtccaaaatcaagctcatacttactgtatctaaatgggacaactgatggctcagcaacgataatctcataaatatgattgtcttcttcaattattttttcgttcattatttggtaataattattcattaaccattcacgcaactgactttcccctacattcggttgaaggacaagtcgcttaattcctgttaacttattcttgtctttctctaaaatcgaagcaatcaaactcccgcccattccggcaatcgtaattgtatcgactttatctgctggttcaatcgctgctaaaccgtctgccaaacgtgggataacctggccttctaattggtggtcttttatttcacgaacggcattttcataaggaccctttactacttctccagcaattgcaaaatcaattttaccatctaacaccaatgcggctggtaaatacgcatggtcagaaccaatatcagccacccgcgcacctgctggaacaagggaagcaacacatgctagacgtgctgataagtgcttttcatccacaaaaatcattcctttatctatttaataaattaattataacaaaaagaggaagcaagatagcacccacttaggagtcctattcctacttccttctaatttacgcaagatggtctaaaaattcaccaattcgtttaatagcttctgttaggttttcatcagaggaggcatatgacagacgaacataaccatcgccacccttaccaaatgcactacctggtgttactccaacctttgcttctttagcaagctgctttgcaaaggcaacatcgtcagttccaaattgagctggaatcttagcaaaaaggtaaaatgccccttcaggagttaacatttcaaagcctaatttcttaagaccggcaacaagtaaatcgcgacgatgctggtaaatctttcgaaattctaatggatcatttaaaccatttgtcagtgcttcagccgctgcaacttgaacgttattagttacggttgtgactaagaaggcatgcatctttgaaatattagccatgatcttagccggagctgcaacatatcctaaacggtaaccagtcattgcgtgagattttgagagtccagagataaaaattgtccgctctggaatcatagtagcaattgaatagtgctctaccccatagactagttcgctatagatttcatcagcaatcgcatataaatgatgcttcttaattacttcagctaatcctgctagaacttcttgaggatattcacgaccagttgggttacttgggtagttaaggataacggctttgacgccttttccctcttcttcaagaacttcttcaagcttttctggagttagaacaaaattatctgctgaagtatcaacctgaacaactgttgctcctgtcatttcaattaatgggaaatatagagagaaaatcggggtcggaaccacaactttgtctccagtattaaggattgcaaataaagttgcatcgagggcttcggttgctcccacagtcgcaattatttccgtttgcgggtcatagtgcacatcacgagtattctgaatataatcactgattgcttcaagtaattctggctttcccatttgaggagcatagtgagaatcatcttcctcaatacttctaatggctgcttgcttaacgtgttcaggagttgccatgtctggttctcctaatgttaatttaataattcctgggatctttgaaacttctttattgaattcacggatacctgatggctgtaatgcatctaacttgtgactaacagttccatataaatcagcagataattctggcattgttcgatctctcctcaatttttatttataatagatttaaaaaacgctttataaaaattttacccgaacaatcaaatgttttcaatataaaaataagatttctctcatttattttaaataaaattaaaaagtagcttaagataattaattaacttaaactactttttttagtgtaaatccgtcttttttacgtatatatattaaatggagaatatttttattctaagaaatcttttaattgcttagaacgtgatgggtgacgtaatttccgaagcgccttagcttcaatctgacgaatccgttcccgcgttaccccgaagacttttccgacttcttcaagggtccgtgtccgaccatcatctaaaccaaaacgaagccgcagaacattttcttcacgatcggttaacgtatccagcacattttcaagttgcttcttcatcatttcataagcagcatggtcagctggacttgttgcatcttgatcttcaataaagtcccctaaatgagaatcatcctcttcaccaataggcgtttcaagtgaaactggttcttgggcaattttaagaatattccgtactttttcagttggcatatccatttctgcaccaatttcttcgggtaacggctcacgtcctaaatcttgaagtaattgccgttgaatccggatcaatttattaatagtttcaaccatatgaaccggaatccgaattgtccgtgcttggtcagcaattgcccgtgtaatagcctgacgaatccaccaggtagcataagtagagaacttaaatcctcgccggtaatcgaatttttcaacggctttcataagtcccatgttaccttcctggattaagtcaagaaactgcattccacggccaacataacgctttgcaattgaaacaactaaccgtaagttagcctcagctaattcttgtttagctacttcatcacctttttcaatccgtaaagcaagctgaacttcttcatcagccgtcaaaagatttacacgaccaatttccttcaaatacatccgcacaggatcattaattttaactccagttggagctgatgtatccttcatagcagattgtgagaatttttcagtagcctttaaagcacgaggatctggatccccattttcatcgacaacactaattccggcatcttcaatatttgaagtaaattgtcaatcccatcagcgttcaattcaaatggtttagcaattttagtagttaattcatcgtactcaatctgcttttgcttcttgtaattacgaattaacttaccaactgcggtgtcatattcttgttggtcaaaattggcgctgttagaaataacaatgtctttttttttgctttttgccatattaattagtctcctccgtttttaagcgttgctgctgctttaataattttaccagttcaatcgttaattgcgtagctaattctgtattatgcaatgaattagcttcttttaactgggcttgcttatctgcaatttgcgcagctaacggtgtttgttctacgatcatatggatacaatcatcaattgctcgcatatcaacttcttggtcaacatttaaattctcaatttgcccaagagtaccttgtaaactactttcatctaaataatcaagaaagtcagcagttgaatacgagccattttcagaaaaataacttgctgctaataaatacaaagtttgatatttctcatgtgcaaaatgaaaattgtgatctgctgtcacatgcatccatacttcacgatcatatagcatgtaccttaataagatctgttccgctaattcagtcctactaagtttaattttttgctgttcttcttcactagtttgttgaaactgttgatgacgagctagtgaaggctgttgcttaatccatggctgattatgaattcctagttgttgtcgcaattgatctaactgcgtttttaaggtttgtcgatctaacttgaactcacctgccaaccgttgcaagtacatatcttcttctaagggagcttgaacctgagcaattaccttcagcgctttggttaagatattgcattagttcattctgattatctaaatttttcccatttcttaaaaagtgcaggtaaaattctgttgttgtttcttccttattcgtaagataggcattgaattgctgtggtccatacttttgaacatattcatctggatcgatcccagccggcaattggacaacctttacctgcaactgattaggtcgatgatcattaacgaggctaattgcacggtcaattgcattttgtcccggttgatctccatcgtagcaaatgtctaattgcctagttgctcgaccaataatcgctacttgctcttcggtaaaactagttcccattgaagcgattccattttcgatccctgcagcaaaggccgagattacatccataaatccctcaaataagtataatcgaccatctttacgtgccgcttttcgtgcaacatcaaaattaaataatgttcgccgtttattgaaaatcggtgtctcaggactatttaaatatttgggtaaatttgttttactggtatcaattaatcgcccagaaaaagcaattacctgcccttgaccattttttattggatacattatccgttcaataaaccggtctcgcaactctccttgttgatcttcactaaaaagtccactttttcttagcaattggtaatcaactttttgctgttggaagaaaggcttcaagattcgctgatcaggagcatagcctaaaccaaattgttcaatcagctcctcactcattccccgtttttttaaataattaagtgcaacttgcccagccgtgtatttaccaatatatggtgataaagtttagccgctttatcatgaagatcaaacagctgtcgattctcgtttttaatggtttagccggaacgctaacatattgttcaggaattgatattactatcgttagcgatctccttaactgcatcgacaaaatcgatatgctttaactccatcaaaaattgaaatacatttccgctccggtgacatccaaaacaatagaaaaattgtttttcctcattcaccgaaaaagagggggtcttttcatcatgaaagggacataacccaattagattttttccagcctgatgcagttggacatagcgcccaattacatcaccaatatcaactgaatttcgtatttcatcaattacattacgcggtatctttgccattgatccacctcacttagtaagcgaacagcaacgaaatgaaaggtcgcaacctaacggaatgcgacctccacctatttttacatttaactagtatctataataccacaagttagcagcaatacaattaaaacgtcttattttacaatcaagttatccaagttaccaattaatgatgcttgattagccaaaatacttaattgggccaaacgattattacgaatatcttcattcttatccataatcatattttcatcaaaattcactaattattggtgttaaagtccgtaaggctgcaaagttttcacttactgtctgttgattttccttaatcaattctgaaacagcagtatgcatcttagcctcagatgggttctcaaataaattaggatctactacaagctcactaactggacgtttatccttctttgcaatccgtaatacccgggtaagagcttcaatatcttctttaaagttatcatcatccttatgatcatcaatagtttgaatagcttcaaggatattagcaatatcattttgacgagtatcggtagctgcatcaatgatatcgtgacgaaccttttgaccatggaataattgcttaatccggtccaagaagaacgaacggacttcatcactatttttattcaaatcaaaagaaacattgatttcagcgttttcaaaggcaggggcaatttctgattgaatacttaataatggaaggttccaaccacgatcggcgatgatccggacaattccaaatgcctgccgacgtaaagcataagggtcatttgaaccgcttggaatcatatcaactgcaaagaagctcatgatactgtcaagtttatcggcaattgctaagaccgcgccaatcttagtttgtggcaattctccttctgcagagattggcatgtagtgttcacgaatagctgtggcaacatcatctttttcaccgaatagcttagcataaatttcacccataattccttgcaactctgcgaattcacccaccatttgcgtagtaaggtcaaatttataaatatgtgctgctcgatcaaggtctactagttcttcatctgaaagatttagttgcttaccaagaacattcgcaatcactgcgacccgctgcattttgtcatacattgaactaatcttatcatggaagctaactttcttaagtcgttccacatattcatcaattgtcaacttctgatcttcttgatagaagaattgagcatcttcaagacgaggaacaagaacccgttcatttcctttaataacattatcaaggtagtctgtgttaccgttgcgaacagaaataaagtgcgataagaggttaccatctttatcccgtacacagaagaatcgttggttatccttcatggaggtaattaggaccgggtcaggtaatgctaagtacttctcatcaaaagatccagcaaaggcagttggccattcaactaggttattaacttcttctagtaagtcctcatcccaatcaacttgccagttgttctcattaataatcttagtaatttgatccttaattaaattctttcgctttgtttgatcagcaataacgaaatcattatttaaggtttcctcataatcatcagccttagcaattttaactggatggcctaagaaccggtgaccttgtgtttctcgaccagcttcaacgtccaaaatattaaatggaacgacttcatcatttaataatgaaactagccaccgaatcggacgaataaattgcaagttattgtagccccacttcatcaaggttgggaatgtcatcgaagtaataactgctggtaatccttgaagaacttcagcaacagtttttccagcaatatgcttttcaacaaaaacatattcaacgccttttacttctttgaattcaatatcttcaacagaggcaccttgtccccgggtaaaaccaattgcagctttggtccaattaccatcagcatcttgcgcaatcttttttgcagggcccttaactgattcatcaatatcaggttgcttatcacttaagccatggattagtaatgccatccgtcgtggagtagcgaattcttgaatatcatcaaaagtaatccgttgttctttaaggtacttttctactcgttcgtgtaactgtttaatacttggtgttacaacgtgagcaggcatttcttcaacaccgacttctaataagtatgtatttgccatcttacttttcccccttttgtgctttcttagctgcttgctttgcggcccgttcctttgctttttccgctttttttgtatattcttcaactgtcttttggcgaactgcttcgtcatgaatcagtgggaagccacgtttacgccgctcttcaacaaaggcttttgcaattgattttgccataattcgaatacggtgaaggtaaccagcacgttcggtaaccgaaacagcaccacgcgcatctaacaagttaaaggtatgactacactttaaaacataatcataagctgggtgaactaatccaagcttaattaaacgtttagcttctttttcgtaatcattaaagtcttgtagaagcatatcttggttactttcttcaaacgcatacttagaatgttcatattcaggttcttggaagatatcaccatacagaacatcatccgcccactctaagtcataaaccgagtcaacattttgaatatattcagccaaccgttcaagtccataagtaacttcggcggccactgggctcattggcaactctccaacgacttggaagtaagtaaattgagtaacttccattccatcaagccaaacttcccaaccaacaccggcacagcccattgaagggttttcccagttatcttcaacaaaccggatatcatgctctaaaggatcaatccctaactttttcaaacttcctaagtataattcttgaatattatcaggagaaggcttcattaatacctggaattggtggtgttggtaaagccggtttgggttttcaccataacgaccatcagctggccgccgtgaaggttcaacataagccacattccatggttcaggaccaattgcccgcaagaaagtgtaaggactcattgtccccgcacccttttcgttatcataagcctgcatcaacatacagccttgatctgcccaatattgttccaatgtaaagataatatcttgcacggttaattttttcgtcatactttacttctcctttcaatgaaaaagtccctacagtatcaaataattgatactgtagggacgaagttaatcgcggttccaccctacttttttacatctctgtaaaacagcttagtttaagcggctgttagagtgccaaggataaataaactacaaggcttgcactatcccctgatcgctgatttggtttatccataatctctgtcattgccaatattcaattaaacacgctcttataatagaaaaatattttacaaatgtcaatcgttcattgataactttccgatattttgttcccacttaatcatttgtctaatgaaccgttttgccttcaagtttagtccaacctcgttatcataaagagtatccaagacttgttggagacgtcgtttagtagctggattaatccgaatagaattcaatttctgcaagttaattgtggcaaactgttggagataataaacagttttacggtcaaggtgaagacgatgttcatcaagtgaccagtgattctgacaaagcatccctccatattgttcagagaagtctaaagccagatcattgcggccacaaacaacacaccgatcccaaattggtgctacaccaaaagcaactaacagctgtgtttcaataatatttgtaattatttgctcatctaatcctttttcgattaagtctaaggctgcagcaacttgattaaaccagccaccaatacttcgaccgtcattaaaagcactgtcaactaatgccaaaatatacgtaacatatgcatttttgctaatgtcacttgcaatattcttgtattggctagtatcacttgctgtattaataaaacttaagccattttcatcaagcgagccaatgtatgtaccatgggtgaatggcaggatatcagcagtcatccgaaagccacgttttttagcattttttacaaaaaacattgccggcccaatcttatcagtgagcatttttactaataggtcgcgttcacgataatcctgtcggtacataatgatcccagtaaattgtgtggttacgcgtgccatgtaaccatcatccttttaatagtctttattccgataaccatagtcttttagcattgcagacttatcacgccagtcaggaacaacttttacccatagttgaagaaatactttgtcaccaagtaatttttcaatatcttgccgggccattgtcccaatctttttcagcatttttccacctttaccaataataattcccttttggccaggacgttcaacaataatattggccgagatatgaatatgattttcatcctcacgctttatcgatgttacatcaacagctactgaatgcggcacttcttgtctcgtcagcaaaaagaccttttcacggatcatttctgcaatcacaaaacgttcagggtggtcacttacttgatcggctgggtagtattgcggaccattgggaagaatcttaataatatcattgattaagttattcacattatttccctgcaaagccgaaattggtacaatccccttaaatggaagggtatctttatactgatcaacaatttcaggcagatcattgggattgatttgatcgatcttattaacaactaaaaagattggctgattaactttctttaagcgttcaataataaagtcatcaccagggccgcgcttctcagtcgcactaacaacaaataagacagcatccacttcatctaatgctgacattgctgatttttccatgaaatcacctaatttagtagatggtttatgaattcctggcgtatcaataaaagtaatctgtgcttctgggcttgtataaattccttgaatcttattacgcgttgtctgtgcaacattactcataattgctaccttttgcccgacaacataattcaataaagttgattttccaacgtttgggcgcccaataattgccacaaagccagacttataattgggattatccatattaaaacttcctatctaataattgctaatatacggggaataaaaataattagacccaccaaaaccgaaaatatcgctgaaatcagtacgccaccagcagcaacatctttagctttttttacatttaattcataatggtgatcaacaatcaaatctgtaacagcttcggtaaccgtattaagaaattcagatgtaaaaacaacaaagattgctaataaaatccataaccattccattgctgaaatctgcaataaggccgacataataatggccaagcaggcagctaaaagatgataccgcatattacgctcttcacgtaatacttggataattccatcgattgcgtgacacattgcttgaattaagtgatgatttttctcagtttgatgtttatcgcgtgagtccataaccgtctagtatctcccgttgtaatttaaacattttttcttcatctgccggctcttcatgatcatatccatttaagtgaagaaaaccatgaacagctaaaaatcctaactctcgatcaactgaatggcccaaaaactttgcttgttctgctaccttatcgatggaaataaataagtcaccaagattaacagggatttcagcggccatttggggatccataataattggtgtttcatctcccgcttcttctgcggcaaaacttaaaacatcagttgcccggtcaacattacgatactgggcatttaatttttttatctctggattatttacaaacgttaaagacatttctgtattttctgataaggaaagttctttagcagcatactgtaataagtcccttaccatctccaattgttcatttggaagctgtgctgttgtttgatcgaaaatttccaagtccatcatttttcctcttttgtctctttatctttatctttttctgctaatcgctttgatgtttggtcctcataagcagtaataatccgtgctacaaccgggtgacgaacaacatcttctgcactaaatttaacaaacttaattgacttaatattattcaaaattcgttgcgcgtttacaagaccactgcgagtcccatgtggaaggtcaatttgtgaaacatcaccattaataaccatttttgagccaaatcctaaacgggtaaggaacatcttcatctgggcattagtcgtattttgggcttcatctaaaattacaaaagctccatcaagagttcgtccacgcatataagcaaggggtgcaatttcgataattcctcgatcgattaaccgctgtgtatgatcagccccaaaaatatcatttaaggcatcataaattggtcgtaaataaggatctactttttcacgaaggtcaccgggtaagaatcctagactttcaccagcttcaactgctggtcgcgtcaagataatccgttccacttcgccacgctttaaggatgccacggccattgcgactgctaggtaagttttccctgttccggcagggccaatcccaaacgtaatatcattatgcttcattgcgttaacatactgccgctgaccaaaattttttacccgaatggctcttccccggcgatctttaataatcgtttcactgtagaggtcagcaaaatattccagtgttccacgatgcgccatcttcatcgcactaacaatatctgtactgtggatgcggatcccttggtttagcaacgaaataagggcacgaaatacatcgatcgtaagtttaacgtcttcttcttgtccacttactttaagattttcaccgaatggtcggatttcaacatccattccttgttcaatcaggctcacaaacttatcctgtgttcctagtaagccaacttctatttctggactttcaatttgaaaagtttgttcaatcgttttttgttctcccacctatacaatctcctttaatttagcagattttatttaatgataattatatcatagatcacctttaacctcatcactgcaagcttttctaagggatctaagttatttttcaaaattaactttaactacttccccactattaaaagttttcgtttttccgtctgccaggcgaattgttaacgcaccatcattttcgatttttttagcagttccagcaataacctcaccatttactaccaagtccaccttctgtcctaaaatcattgagtcttggcgatattgctcaagatactgtggattatcatagtctaaataattattagcaatcgtctcaataagacggctgactaaaagattacgatctgctggtgctattcctgtcgctttatttttaaggcccagcggaaattcttttgtagttatattcaaaccaattcctaccactaaggatgccgttgttcttaattcaaggtctactactgcctcggtcaaaattccaccgacttttttatggtttaaataaatatcgttgacccatttgtaccgaaagtcttgagcagggaaaaattgtttaagaacttccacaattaaaactgcaaaagtcgttgtcattaacccagcttgtagtggtctgtcggttgggctaggcagaatcatactaaagtacaagccagttgctgccggagagtaaaaggaccgtccctgtcttccatagccagcagtttgatgatcagcgataaataccgttggcgcactaacttggtggtgactcaaaaaagctttcgcgatgctttgagttgaactaacctgattttcaacgtaaagacgattcttaaagtgattatgagtataaaaatcaataatatcagcactcaaccttgaatttccggtaaaacggtatccaaggtttctacgactttcaatattatttccgttttttcgtaaaccgttgatggccttccaaacagattcacgactaatattaaatcgctttgctaaatcatttccagaaatccatgaatctggtgctgaaagtaattgccataaaattttctgtgccgtcgaatgaaccattctaaccatcttcttaacaaaaaaccttaatgtgtcgtaaacggcgagtaattgagacggcaataagcgctttgattgtatcgccaaaaacaaataaaacattggaagccaaggcagaaataagcgtggtatgtaattgattagctaaccagattgcgccgactccttccacaaagattacaccccatagccaaacaattagaaattcagttatcccctgtgtcatcccataatgccaacttaattttagactaaaaccaatcaacaatgggacaaataaccaagcaaaaatatatccgccagttggacctaatattgtcaccattccaccgcgtccaccagaaagcagtggcaatccaagcacaactaaaaacaagaagagccatacagcaaatgttcctaatcttggtccaagtaattctccagcaattattattcccatattttgtaaaacaattggcaccggaataacccccaccggaattcccgggactgctcctaaaataacaataattgcaatcatcatggcaacgacagtcatttcataaattgataaacttatcttttccctaatcatcagcgtaaatcctttctttttgcattaattatattcaatagtaaacctcgattcaatataagggttactattgagtaaaaaaattgaggctaatcactttcgatagcctctttttacgaatattgttacgatatcgtggaaattaattaccttctaaaattttcttagcatctctaatttgttgacaaacttgatcaaaaccagttccaccataagaattccgccgttcaactgctactttaggttgtaagcaggtataaacatcttcttcaattttgggcgaaatctttttatattcgtctaatggaatatcaacaagatttgtccctgtcttaagtcccttcagtactagctcaccgacaatctcatgcgcttccctaaacggaattcctttagtagcgagataatctgctaattcagtggcattagaaaagtcatgatgagttgcatgctccatggcttctttctttacttgaagggtggcaatcatcccggtcatgatcttgatgcttgggagaatcgtctttaccgcgtcgaataatccttccttatcttcttgcatatccttgttataagcaagcggaagtcccttcattgtcgttaataagccgaaaagatcaccataaactcgcccaactttaccacgaatcaattctgccatatcagggttcttcttttggggcataatcgaactaccagtagaatatgaatctgccaattctaaatagccaaattcataactacaccaataaatcagttcttcacataatcgtgacaagtgcatcatcaaaatacttgcgttacttaaaaattcaagggcaaaatcccgatcagaaacggcgtccagtgaattatggtatggttcagcaaaacctaaatactttgcacttaattgtcgatcaattgggaaagtggtcccagctaaagcagccgctcctaggggtgataaatccgtgtgctgctggttaaattcaaaacgttcaacatctcgctgaaacatttggaaataagccatgagatagtgcccatacgaaattggctgagcatgttgcatatgagtgtaccctggcataatcgtttcaacattttttgctgctttatctactaattctgcctgtaagtttttcaattcattaatgataatgggcaaccgcttctttacatataaatgaaggtcagttgcaacttgatcatttctgctccgcccagtatgaagcttaccagcaacggggccaatttcttctgtcagcaatgcctcaatattcatatgaatgtcttcattgtcaatcgaaaatgggaggccttcactagttaatcgctcacgtaacttcttaagtccagcaataatcttatcagcatcatctgctgataaaatttgtgtttctttcagcatttttacatgggctaatgagccttcaatatcttcttgagccatttcttgatcaaaactgattgacgcattaaattggttaactagttggtcaccggcttcttcaaaccgtccaccccacattctcttaataggcatcgcttgtattctcctttactttctttttatttttgttttgtacttgagcatagaccttatctggtaattcccaaagtttaataaagccagtggcagcttcttggtcaaattcatcagcggaagtgtaagttgccaagttcttatcataaagtgaatttggtgatttccgaccttcacagattacatttcccttaaataatttaacccttaccactccattaacaactgcttgtgattcatcaataaaagcaactaaagatttcattaatggtgaataccaaagcccattataaataatttcactcattttttgttcaattaggggtttaaagtgcgctacttcccgttcttgggtcaggtcttccaagtctttatgggctgccaataaaacagttgcagctgggcattcataaatttcccgtgacttaataccaacaagtcggttttcaacgtgatcaatccgaccaatcccatgactaccagctaatttgtccagtttcataattaactggtcaagcggcatttcttcaccatcaattgctgtaggaaccccttcactaaaggcaatttcaattgtggttggggtatcaggggcttcttcaattgaaactgtccgatcatatgcatcagcaggtgccgcagcccatggatcttcaagaattccacattcatttgcccggccccataagttctcatcaatggaataaggactagcctttgtgattggaacaggaatgccattatccttagcgtattgaatttcttcttcccgtgaccagtgccaatcccgaattggatcttcaatcttcatatctggtgctaaagcatgaatacctgcttcaaaccgaacctgatcatttccctttccagtacaaccatgggcaatagcagtcgcaccgtattgattagcaactgcaactagtttttgaacgattaatggacgagaaagtgctgaaactaatgggtacttttgctcatacattgcatgggcttgaagggctggtaatacaaattgttcagcaaagtcccgcttggcatcaatcactactgacttccacgcaccaacttgaagacccttttccttaatcgcttcaaggtcttttccttcacccacatcaatacaacatgcaattacgtcataccccttatttttgagccatgcaattgcaactgaagtatctaaaccaccagaataagctaaaacaattttttcttttgacataatctcgtcctccatctcatttgaaattcgttgtttataaatatacgagtattatgaataaaaatcaatagttttagcatattttttcaaaaaatatctttttatgcataaaatataagttgttcatgcataaaaagagtttagagatagaataattatttaattttgttggttaataatttgtttattttgaactggataggtaattaattctgatgcttcaaggtcttccttatgcatatcaactgcattaatttgactgttttcgtaagtcttgtagtaaaaaatacccttctttaggtttgaaccatcagagtaaatcgtatattcaaaagtatccggtgctacttcatccaatcccttttgttgttcgacagattgaagaatgtggaaatagttggtaatgttctcaacttcagaattaccaactggggcatgcatcttagtgaatgtagccttaacaaaacgactttcagaatccattcctcccgggagaaaatgggtccctaagccccggctataaactggtaggtcgacattaggtgcaaatacgttagccggattagcaggtgcaacactacgatagttactaagatttaataattgacgaggaaactccggattatttgtcaaaacaccaactgggttatcataaacattcaatccttttgcggtggattcaacagtcacagaagcccccgttttatcagcaataatccagtgcagcggtgcagcttggagtttatcagaaaaattgatattagcaatgtttgcatttgaaagtaacttcttcgcttcagcaaccgaggaagcagccgcaagaatataaggaactaattcaaatgatgcaatattatcttttccttcttgaactgggaaataatgagctggaccatcaaaattaaggcctgccattccaacacccttttcatttaccccatcaaaatataatggataatcatcacgaacaatcgacattccaataattgcataatggtgttcaaggtttggcatttcccgaaattctaaagtcttattacgtggagtaatcactacttcttgaccaagattaacttccaaatcaaggttacggccaaagtaataatcacctgctgtataaattactgatgtgcacatataaatgccccttttcttttgaatatgccttaattctagtttaaaaagtaaaaatgtacagtaaaaagggactgtgacataagttaagttactttcataaaaagcaaatacgcagtacaacaatggcctctaacgtccggcaaaaccgatcgttagaggcctattgttgcttgcgggggctcccagaggctagcttcgcatcgaaaaacgaagtcacaagtgacttctgtctcgctccctttcctacgattagtcaagaaaaatatttagaaaagaagagtatactaaaccaacccggttcttcttcaaaaatcgagaattagtggtatattaaaattgtgaggtggttatgccttcacagggactattgagtccgtataccgatagtggtattttttatggtgcttaatcatggataagagacatttcagagttttattcatacaagctaccatggcgaccttgttcagttttggacgaggtcgtttttcttttaaacgatagtaatagtcaacaatatgattagaattagcgtgttgttggcggatcatattacctacagtaaaatataagagcttacgggcaatcgggtttccacgcttattaatatgatcttgacctaaataggttccagattggtaacgacgaatatcaattccaacaaaggcattaagctgattagcattgtcaaagcgactaatgtcgcccaattctcccattaactgagccgcagtttgtttcccaattcccggaaaagagcagtataggatatactctggtaagcgctgggcaatagattccatccgcttgatgacctcttcctttttacgggttaaggcaattaattggcgagcgtagtagcgaacttcatcaacctgaatggtatcaccagaaacagccggatatgatttttgggcgagatcgattaatcgatcggcatacttataagctttcatcttagatattcgtttatctgtagaggccattagaatattctttaatttaactctcgaataaggcctaactagtgctggatgaggaaaaagctccacgatattcaacgctaatttagatgttctatttacaaataattgcttaagttctggaaaaacttgttcaagtgcagtatgaagatgatttagacgatagttccaatcagcattgagctgattataaaaccgactaagctcatgtaactgaagatagtcttttttccaaggaactgttaatcgaaaagcattttcctggacagtgagcgcaatccgatgagcgtctttctgatcggtcttaactcgtcgtagactctcggactttaaatgaagttctagtggattaagacggcaaaagcggagaccattagtctcacagaaatgtccaattactcgcgaataaattccagtcgcttcaaagtagataattggcttctgagcttttttaatcatatctcgtagagcattaaaccccgctttcgtgtgtactaaagaaaactcctttaaacagtgtttccctcgataccagacacagtagcttttcctcattgaaacatccaaggcaaatatatcagacataaaaagacttcctttttataaatagagctagatataaccgctatcctagatttgtacttcatttcctaaatactcgaactcgtagttccacaacctaaaagcaaaatatcaaatcaaagatagcggagatcattttataatacggactcgaagtccctgggagcatgatcgatcttagctctatcttcagaataacaaaaaagtccaggacaataattatttttgtcctgaactaatcttaggttgttttacagctaatattacttactcaattgttcttttacaacctggttaactaattttccatctgcttgaccttgaactttgggcataactgaccccattacttgtccgaagttcttcatactagaagcattaagctcatcaattacttccttaacaatcttagtaacttcatcttttgataactgctttggcatatacttttcaacaattgctaattcatttttagcttggttgatcagatcttctcgtccagctttttcaaattcttcaagcgattctttacgctgtttatattcacgtgctattaccgcaatttcttcattagcgctcaaatcgtggccaagttcaatttgttcattttgaactgctgctttaagcatccggacaacgtttaatgtttccttatcacgattcttcattgctgataccatgtctgacgttaattgttgtagtaagctcattatttatccttctttcatataaaaaagctctcaccaggcaacaggtgagagcacacatttttagtaacgacgaccgcgcttattcttacgcttccgtgccgcttcagatttcaacttgcgttttacacttggcttttcgtaaaattcacgtttacgatattcttgcaatgttccgttacgtgaaactgaacgtttaaagcgtcgaagagcgtcgtctaaagattcattcttacgaacgactgtttttgacatgttgatccctccctccgagcttaaagttacgtatcgaggtagcaggcatactgcttccttttcactacaaaaattattttacccaacatggcctaccctgtcaacattacttttaaataaaaatttaaatttcttatccacctattctttgactactccataaactaagtaaccgcttttaattattatacaaatatatgaatatttattcttttcatagattttctattgcataaataaacatttaagtgtatatttagtaacaatttaatcttactattctcaaaggagttattaactatgaaaggttttaaacatttattactgctaatggtaattgcgtttccgatattatgtacacctattactgcattagctgctaacgagagcagttcaactagctcttcatcaaccaataatccatcgcaagtcgctagcaatgattcagtgcaaaagattaaacaaaaaggaacattggttgtgggaatgagtgctgattatccaccctacgaattcacaaccaaagaaaatggaaaaactaaatatgtcggttttgaagtttcccttgctaaacaatttgctaaagacttaggagtaaaactagttattaaaaacatggactttgactcacttctagttgcgctagaaacaggtaaaattgatgctattatttcgggaatgaacgttacggctgaacgaaaaaagagcgttgacttctcaaatacatattattccggtgatagttactttttaattaataaaggagataaagataagctagttaatgtcaaaagttttaatgggaaaaatgtgggagcacaaaacggtacgctccaatcaaccctaatttcaaaggaaatgcctaaagcaaacggcaaagggcttgctaaactttcttccttagtcattgggcttcaatctcataaatacgatgggattttaatggatgctgcaactgctaaagcctacgctgccaataattcaaatctttatgcctttaattcgaaattgccaaatactgctggcggaattgccatggcctttcctaaaggtgatacctcgttagtcaatgccgccaaccagacaattaaaaaagttaataaagaacaactaattaataaaaaatggattcctgaagcctcacagtatatgaagagctataaaaaacaaaatactgttcttagctattggcgttactttgctaaagggattaaatatacattaatcattacagttgtctctgttatttttggtttcctattaggaactctctttgcactaatgcggctttcaaagaacaaattcttacattcaattgctgtttgctacattgaatttcttcggggtacgccaatgatggttcaaataatgtttgtttactttgggattggcgcaattattcaatcacttccggctctcctcgctgggattattgccgtttcactaaattccggtgcctacgttgctgaaattattcgttctgggatccaatccattccacttggacaaacagaagctgctcgaagcttggggatgagtaaaagcgaaacattcagatatgtgattatgccccaagcacttaaaaatatttggccagcattaggaaatgagcttattactttattaaaagatagttcattagtttctgtgattggtgtttccgaattgatgtatcaaacacaattagttcaatcagcaacttataaaggagttttacctttattcatcacaatgatcatctactttatcctcacatttacactatccaggattttgctttactttgaagggagaatgaaacatgcccactaaaatgattgaaattaaaaatttacagaaaaaattcaaaaataatattgtcttaaaagatatttccgaacatgttgataagggccaagtaatttgtgtgattggcccttcaggagcaggtaaaagtacttttctccgctgcttaaatgcactcgaacaaccaacaagcggacaagttctttttgaaggacagaatctgattggcttaagtgataaaaaactcgaccaattgcgagaaaagatgggaatggtttttcaaagcttcaatctttttcctaatatgacagtccttaaaaatatcacaattgcaccagttaaagttaaaaatatcaatgaaaaagaagcaactaaaactgcaatggaactactagaaaaagttggtttaagcgataaggctcaacaatatccggatcaactatcaggagggcaaaaacaacgggttgcaattgcccgggcccttgcgatgagtccagcagtaatgctctttgacgaaccaacgagtgcccttgatcctgaaatggttgatgaggtactaaaagtaatgcgcgatttagctgaatcgggaatgacaatggtggttgttactcatgagatggggtttgctcgtgaagtagcagaccaaatctggttcatggcagatgggtatattcaggaaactggagatccagaggaattttttgcccaccctactagcccccgggcacaagactttttgaagaagattttgaaataaaataatcctcgtgaacagtacacttcaagtaccttttcacgaggattatttttgttttatttattgctcatctggatcttgatcgagcttgtaatcaattttttcatcaaattcaattttaagatcatcaagttgttgttcactaactttgcctggagctgccgttaatggttcaactgccttcgagttcttagggaatggaataacatcccgaatactatcagcttgagctagtaacataacccatcggtccaaaccaaaggcaagtcctccctcaggtggcattcccattgttaaggccttaagtaagaatccaaagcgagcctctgcacgttcctttgtatatccaagagctttgagaactttttcttgaatctttggatcgtggatacgaattgatcccccaccgatctcgttaccattcaagataatatcgtaactttgagcatgagctttatgaggatcttccccatcttcaagataatgtaagtcttcttcatttagcattgtaaatgggtggtgagcggcaatccactttccaaagccttcatcatattcaaacattggccaattaacaacccataagtagttccattggtcaggcttaatcatatctagctcttcagcgattgtacgacgaaggtagccaagtgaatctgatacaacgtggaaactaccagcaacaaagaggattaagtccccttctttggcatccatttcttcattgatttgggcaacttgatcatttaagaacttagcaactggaccattgtaaccatcagcagttaccttaacccatgcaagtccctttgcaccaaaacgcttaatgtattcttcatacttagaaatatctttccgggaatacttatctgctccaccaggaacgcgaattgcacgaacatagttaccatcagcaacagtattagcaaaaaccttaaatgaactgtcttttacaatatcagaaagatcatgaatcaacatcccaaaacgagtatccggcttatcggaaccgtacttgtccatggcttcttgccattccatccgtgggaatggagtcttaacatctaccccacgatttccttcattacccgcttaattaaaccttctgtaactgtttggatgtcttcaggagttgcaaaactcatttcagtatcgatttgcgtaaattctggttgacggtcaccacgaaggtcttcatcccggaaacaacgtgctaattgatagtacttatcaactccggctgccattaacaattgcttaaataattgtggtgattgtggtaaagcatagaaatgaccggggtaaacacgtgatggaacaatgtagtcacgtgctccttctggtgttgaccgtgttaaatcaggggtttcaacatccataaagccttcattatcatagtaattgtgcacaatcgaagcaaccttactccgcaacttcaaattacgcatcatttctgggcgccgtaaatcaaggtaacggtacttcatccgtaagtcttcagaagcatcaacaccatcagtaatatcaaatggcgttgtttctgattttgctaataccttaaccttatcaacggctacttcaacttttccagtcttcatatctggattaatttctttttctgcccgtaattgaacttttccttgaacctcaagaacatattggttacgaaccgcatttgcgatttcaaatgcttctggattttctttttcgttgaatactagttgaacaattccttcccgatcccataaatcaataaagataagtccacctaggttacgacgcttagctacccaaccctttaagacaacttcttgtccaacttgctgttcatttgtatccccagcataatttgttctcttcattctccgcttacctctttcagtttttaataacagtttaaataaaaagcacccttgaaattacaagggtgcaaatgcacggtaccaccttggtatcactcaaaaataacgtctaaacgacggagcatattgcccagcttcaaaagtgtcaatcgaggccaaaatatttggagctctcacctttctccaatcgctgataatttcaagtacccgagcattctttatcaacagctattaatatctttaatttacatttttaccttactcgatcccctcataaatgtcaatactaaggttaattaggtatctgtcaagttttcataggtagcctttaaatatacagttttagtgggttagtgccttaaaaagttgtcccattggtctacttgtggccgtgttaatcggaattattccttgtactgctccaattgacggctttgtcggtgcttttcttagaaactctccagttcgaatatgcatttcctgtaataggctggtttgagccactcgaggatgaactgttaattgttctaggattgtatttaaactagcttgcagttcaccattcattcgggcttcaattaaaccaatcatggctttagccccctgctcagtccatgacttgccctgtttcttcatccggtaagtaaaagcccggtgagaactttcgactgaaccaattaaatgaatatccttaaatccacgcatttgtggtgagaggatataccgccaatttcgctgtagatactttcttaaacgcattaggtcgtctgcttgtttttccgttaggttttgtgattcataagtatctaaaattattgttagctctgcttgatcatgatgacgaacggctttaattgctcgcatggctaattcgttgtgccggcctaaagtatgttcaattttctgtaaacaatgatagcggtcgagaaagtattcaccatgtgcaccttgaggaactagacttaatagcttagctggttcgtaacctgggccagcgtcactgaccaaaaagatcgtttgaccggcaagcttataatggcggtctaaataatcacttagtcgtgcttcaagccgtccttggtgcccaacactgagaaagtcatgccgattaatgatttgattagctactcgctcataaaccctataatggtgcacaagagtcagctgacctgcttcttttttgcctttaatcataaaagcatcaccctcaatagttaaatttttaggcatatggcgaggagtagcttggtgttcttttgcttgagtttgtttagctacctgatttcctaactcatgcacggcgtgcattaccgaatcggtagtaattccgctgtcaaatacaaggttcaaaatgtcggcagtattgcgcattgtagttgtttgggcaatcttagccatcatcattaagtagtgtggcgataaacgacgacgtggtttaatttttaattgttggtctaagtaaaattcacgtttctttgtcccagcctgataataccgtcgttgaaaagtcaccgggccaaagataaagttaagcgtccgtggctgtttattgattacttgatagttcgctggagcttgggactttaagcttcgatctaagctttccaaaaagttttgcatgattacttgtcctaactccaataccccttttaaaataatctgttcagcttcaaataaactacctgatttcaccaaattctgctcgatttctgttaaaatatccatgaggaaagacctgcctttgcttagtattcgacacactaaaggctactggtcttttctttttttgtaaataagtaaattggtctacaaaaaagatttccacgaccagatgaattattcatccaacctatgaaaatcttacactaacgttaattagtgccttataaatcaactttatttaacaatacttgcctaaaaatggtataaataaagtaatttagtaaaggagggacatcaattggaaagtccaaatacagcatggtttaagcgccttccattaaaaaatctcacttctgttaaaccagtcagtggtggtgatattaatttagcatatcaaaccacaactactgatggaaataggtactttataaaggtccaacctaaccattcacaagattatttcagtcatgaaattaatggtctcaaagctatcggtaaggtcattaataccccaaccccactttaccatggtgaaatcgatgggaatgcctatttaattttaaactggcttgatgaaacttggggtaatcaggccgacctgggattagcagttgccaaaatgcaccaacagcataatgaagaattcggctttatggataatcatcaaaccaaggccctcgtaaaagataattcttggaattcaagctggcttgatttttatattaatcagcgcctagaaccagaagtacaagtggcaagccaacgtggccgatggaataaatggcgacaagaacattaccaacaaatggttaataaatttactgattactaccaacaccatgaagtcatccctagtcttcttcatggtgatttatgggccggtaacttcttatttgctggcgatcataaaccatacttaatcgatccagatgcattatttggggatcgtgaatttgatttagctatgacaactgtttttggcggtttcgataatagtttttatcaggcatatagcagcgtctttccctttgatgatcatttagaggaacgcctttcatggtatcgtttctattacctatgcatgcatttaatcttattcggcgagagctatggtggcgcagtcgatcaaattttaagtcaatactaaactgtgacataagttaagttactttcataaaaagcaaatacgcagtacaacaatggcctctaatgtccggcaaaccgaacattagaggcctattgttgcttgcgggggctcccagaggctagcttcgtttttcgagccccctctttgcttttttagcgttcataaataattgtcgtggggccatcattttccagatcaattttcatcatggctccaaaatgtccggtttcaacaggaataccagtagcagctagtttttgattaaaaagatcatataacggttcagcaatctcaggacgagcagcctgtgaaaatccaggacgatttccatgcttagtgtcagcataaagggtaaattgggagactgataaaattgcaccattaacatcccgtagccccttattcatcttaccgttttcatcctcaaaaacacgaagattagtaatcttatgtactaagtagtctaatttttcttcggtatcatctggagcaaaaccgactaagagaaaatagccaaggccaattttaccaacaacttcatcatcaattgaaactgctgcatgatttactttttgtaaaacgactcgcacaagcatcctcctatcgaataattcttttgacaacgtaaacatctggaatgttttttaaaccatccatgattaattgcaactgtcgtaaattacgcactccgataatcaaactaattgttaccatcttgttatggtcaacttttccgttaactgaatttaagaagcgagtactgttatttactgaacgtaaaacatcatttaacaagccatttcgattgtatccctgaacttccaagtcagcattgtagtttgttttgtcgccattaggatttgcccaatatacactaacaattcgttcgccattcttacgggcagctttaatattcggacaatcatcccggtgaaccgatactccccgtccctttgtaatgtagccagtaatagcatctcctgggattggactacagcaatgacttaaacgaacaagaagattgtcaactccttcaacaattacgccctcgctcgatgccttagcctgtttttgcttttcacgttcatttggcttctcaagagtctggtgatcttctagtacagctttttctgctgcttgttggcggtcgctttcaacttgctgacggatatcagcagtaaaacgatttctaataccaacgggagccaagtcaccaaatcctagggccgcaaacatatcatcactactattgtaatgagtctcttgagcaacttcctcacatttttcatcagtcattaattctgctggcgaatatcctgcttcacggagttcgttttcaagaagttgttttccttcttcaatgttcttttctcgatcgtgtgcacggaagaattggcgaatcttattacgagctcgccgcgttgaaaccaaatcaaaccaatcacgactcggaccagctgatgatgatgaagtcaaaatatcaacaatatcaccatttttgatctcataatcaaggggtacaatccgtccatttactttagctccagttgtatgattaccaacttcagtatgaatttggtaagccatatcaagtggtccagatcccttaggcatttcaattacgtcacctttaggggtgaatgcatagaccttatcagtaaatatatcgctctgaatcccctgcataaattcatctgtgccttgactttcacttcgtaattcaaggatttctttgacgacatttagcttttggctatcctgagtttgttggattccattagtctttccttctttatatgcccagtgagcagcaaccccatattcagcaatttcatgcatcttgtgagttcgaatctgtacttctaatggccgtccttccggtccaataattgttgtatgcaaggattggtacccgttagtcttaggcattgcaatataatccttaaaccgtccaggcattggtttccaattagtatggatcgctccaagagcagcatagcagtcccggattgagtcaacgacaattcgaactgcaagaagatcatagatttggctaaattgcttatgctgagtaaccattttacggtagacagaataaatatgtttaggccggccataaatttcaacattcggtcctaagtccaaatctgcaatcgccttttttatcaacttaattgactcatcaatatagtcaacccgctgatcgcgccgtgaattcattaaatggacaatccggtaatattgttgcggatttaagtaccgtaatgatagatcttctagttcccacttaatagtactgatacccaagcgatccgcaattggagcataaatttcaagggtttcatttgagatgcggcgctgcttatcaggacgcaaatgcttaagagtgcgcatattatgaagacggtccgcaagcttgacaatcattacccgaatatcctttgacattgcaagtaataatttacgatgagtagcagccatttgttctttatttgatttgtaacgaatcttaccaagctttgtatcaccatcaacgatcattgcaatggttgatccaaagagttctttaatatcatctaaggttgcgccagtatcttctacaatatcatgtaaatatcctgcacaaactgtttcgggatccatatgaagattagcaaggatccccgcaacttggataggatgaataatatacggttccccagatttacgtcgttgatcatggtgagctacctcggcaaaatgatatgccttttcaactaaagcaacgtgttcttcattcatataagaactaactattttttgaacatcttcatgtgtcaattccttttcttttgacatcgaacgacctcctttcaattacttttgttgacgcattgcccaggataagtacgcaagcgctaagtaagcaagggcaaaataataagtatatcggggcataaagaaatacgcagttatcaagtaaaggattggaaaaatgaataactcgccccattttcgctggtgcttataaatccaataaccggaccaaatactaaaaataccattaataaggattaagacaatctctaccattaccactcgcgtaacaaatggaagcttatcaacaacgagcgtcaatacaatcccaattaaaatgctagctagccataatggtttatctaaacgttcccatgcttttttcataaaattcattctctttcaacacctatattcagttttaaatcaccgattaaagctgttctttattttaccataagtaagccagctacattatgacaattccattgcatatgagatagccgccatgaaatataaaggcgctgtttcagttcgtagaattcgtggtcctaaacctgctgctaccacgccagcttcattcattttagcaatttcattttccgttaatccaccttctggaccaaaaatggcaaggagcgagtctcccgggttaagggcattaaattgttgcgctaaagcacttgtttcaccctgtttagctgattcttcccaagcaactatccgtttggtagcgggataatcggctaacaattgatcaagatttgcactgtattcaacctgcggaattttatttcgatgggattgttctgctgctgattcagctattttttgcagacgttcgatctttcgtttctgcttatttccctgccaatgactaatggagcgagcagcatcgaagaaaacaattttgtctgcccccaattcagttgccttttgaacaattaattctggtttctctttagtctttggaattccgcaggcaagcgttaccgaaactggcaattcactatcagcatctaacttctgattgatttttaatgtcgccgttggttctgtagtactaagagtcgcaaggtaaacacagtggtcggctaatacaagctcaacacttgttccaacctctgcgcgcattacctttaacaagtggtgggctgcttcagatggcaatgttacttcattagctggagttacattaacaaaatagcgttgcatttatttcacctcgattggcttgtgggtaatcattccgtgccagtccttcatctgctgttcatcgtcaattataaatccttgctcttgcaacttttgacgaatcaacggagccttatcatcgataattccagaaacaaggaatttgccatctggcttaagattttcatatgcttgaggaataagaggtacgatgatttccgcaagcatattagcaacaatcaaatctgcctgggtatggatcccatctaataggctatttacgccaaccttaacatctttagcgaccgggtttagtgcaagattcttttttgctgagttgactgctacttcatcaatatcataagcatcaacttttcctgcccctaagtgcttggcagcaatacttaaaacaccagaacctgtcccgacatcgattacatattcattaccaacaactgttttttcaagggcctccagcattaaacgagtagttggatgagtcccggtaccaaaggccattcctggatcaagaaagattaatttttctttaggatctgctggctcatattcttcccattgcggaacaatcgttaactgatccgttactcttaatgggtgataatatttttgccaaaccgttgcccattgttgattatcgacgatcgctgctgagacatcattttctcctggattcaggccgtaatcccttaattttgctactcgttgatggatagttggcaatagttcaggaacaaatacgttttgggggaaatatccagatactgctgcgccattttttcggtgcggaattgatgatggatcaataaattcaccgtggtccccatactttccctcatgtaagtttgcaaaatcagcagcatcttcaatttgaacgccttgtgctcccatatctgtcaaaatatagctaactgcttcaacagcctcactagaagttattacctttattgctgtccaatccatttaatgacctccttaaataataaaatcgtgaccacaataaaagtaaatggtcacgataaataccaacttaataaagtctaatcattttcattatcaactttactaatatgtggtcgttcttgttcacgtttcttttctttttctaaatgatgacttaagtaatcgattaagtcggactcagtcaagaaaatacggggatgatgttggtgatgcaaccgaacatcaatctcgttaatttttaatcgtccggtccaagtatgggaataacgaacaattacccgattatttagtctgtgtttaccaaagcggaacacatatacgtgttggggtgtcatcattggccgaatgtactcttttttatacattaaatcattgtcgcgcataaactgcttagttcgattcagaatggtaaccacctcctctattattattcctgatcaattttaaattaatctccctagataggtatattttagcacaggtcaccaacgttccaaagtttaatctatgtttaaactttaattttcaaaaaaatgctatactatgttcacgatactttaaggaaaggtgattacaatagtgagtctcttaattgctattcttatctgctggttgctatggaagattgggggtttaacggttaagttcattggtctaatccttcttattctattaatcgggacattaattcatgttttactttggccagcgatccttttagcagttattatcttaggagcaggtttattcactaactaatttatctataaaatcttatagtaatttttctgcggaatgttataatcattactgtgagagaaatctcaaataatgtatacataagatgaaagggagactgtttattatgtctaagaatcatcaaaaagttgttcttgttggtgacggtgctgtcggttcaagttacgccttcgcaatggcacaacaaggaattgctgaagaatttgctatcgttgatattattaaggaacggactgaaggggacgcaatggaccttgaagacgctactgccttcaccgctcctaagaacatctactcagcagattacgacacttgcaaagacgctgatttagttgttattactgctggtgctccacaaaagcctggtgaaactcgtcttcaattagttgataagaacttgaagatcattaagtccgttgtagaaccaatcgttaagtctggttttgacggaatcttcttagttgcagctaacccagttgacatccttacctatgctgttcaaaagctttctggcttccctaagaacaaggttgttggttcaggtacttcacttgattccgcacgtcttcgggttgctcttggtaagaagcttgatgttgaccctcgtgatgttattgctaacattatgggtgaacatggtgattccgaatttgctgcttactcaagtgctactgttggtggcaagccattacttgacatcgctaaggatgaaggtatttcagaagatgaattacttaagattgaagatgatgttcgtaacaaggcatacgaaatcattaaccgcaaaggtgctaccttctatggtgttgccactgctttaatgcggatttcaaaggctattcttcgtgatgaaaattctgttctccctatcggtgccccaatgaacggtgaatacggacttaacgacctttacatcggtactccagctgttgttaatgcttctggtgttgcaaaggttattgaagttccacttaacgaccgtgaaaagaaggctatggccgactctgctaagcaattggaagaagttgctaagaacggtatggcaaagttacaaggtaacaactaagccgtattcataaataaaacgatagattatcgtgctactaaaaaactctcagcgtttagtaaaacgttgggagtttttttgcctatttttgatcattttttaagtcacgtgcaaaatcatcaagaaagtcttctattaatttatccttataacccttttttctaagttcactcgctaaaattgccgaagtaagcccctttcgaattgctaacttatgatcacctgcgagccaaaacattactaattctcgatcttccatttaaaatgctcctttttcctcatatattcagtgtaccactttcacttatcaggatttgaaggagtttatcaattattaaggaacatcaataccaagttcagttcctatttctttcatttcttgataggtcttttcatcaatcgtgacacctttttctttattttctgctaataaacggtactcacgatcaccgggtacccaaatttctttaccaggaatatgttcaagctggcgaattcgatctagcattgatgtggcatctttctttcaatacctctggatcaccaaagaatgctggattaagaaccattacaaattgactaaaatcatgtttaccactaacagtatcggcagagatagagccttgagctaaaatacccgtcaataattcaattacgatagaatttcccatccccttataattagaattttcctcatcatttccgccaagagtgagaactcctccacctttttgttccccttcagtaaaggccgcggtggcaagaatatcttctgcctcttgcgcatcagttactacctgccgatctttatcaactgcccattcgcctggcaacggttcgccttttttagcatgaacttgaatttttccacctgaaacaacacaagtggcaccatcaaacataaatggatgtggagaagcaggaaagccaaacgcaaaagcattagacccaagaaaagcctgagtagcattagttgggactaccaggggacgagtgttagtaagggcaactcctaccaatccagcttctaacgctaatcttgtatagtaaccagcggtgccgaagtgattcgaattgcgaataacagcaattgccacccctgttttcttagccttttcaattattttttgagtcgctaaaaccgttgcgagctgtcccatattttgattagcgtcaacaaggacggatcctggtaactcacgaataattttgaccttattttggggaataatcgttccctctttaatcatccgacgataccatgctaatcgttgaatcccatgagatgagatcccgcgtaaatccgcatcaactagagtgtctgctaataattgactgtcatcttggttaaatcccaattttgtaaaaacttctactagataatgccgttcatcggttgcttgaattctcctttttatccttctctcattttacattaattatattttaataataaagtgagaaatgtcaatattcaaaatatcttaaaggttaggatccatcttaaatgacatctttgaaagctcacagccttcagttaataattcaaagaagagggcctttgtccgttcattataatgggtagctatttcatgattttgcccagttagataatcagttaatgcctgcctttcaagactagctgcttctttatcaacctgcgcaattttacggcgtgcccattcatttagctccttttggtagtcttcatctttttccataaattcttgataatgactttcaacaacctctgctaaggcttcatttaaccagaatgcagactctaagttcattttttccggtacgtttcgatacgattcatcagtatcgtcagcattagcaaaaaatggaacataagggttaaaggctgggacccctaattcaatccaatgaatacttgttttatatttattcagattgcgcacttgtaaaatatgtgattgggccgtccgtgataaagagatagctcggtaagtcttacgttcaggagcatcccccattggatcgtaaggtgtctcattaaaatgcgattttagaacatattggatgtcttcattagcaatcttaaattcagccttacgaataaatggcatttcagaatcttcgggacgttggcctaatgaagcattaggactaaggtaacgttgagcaaaccaggtccgcggtgtgttgtaatgacggtctttttgtgtactggtaccaaaaatatgacggaaatcccaccggtcatggtcagggtttaattggtgttcttcaacaaattcttgaattccatcagcccacatataattatcaggatcgtcaaaatcgatatcttcaattgctacctggttaggagtaacagcataacaatcatcaggaatacgaactgcaacccattggtgaccagttactacttccatataccaaatatcatctgcatctgcaaattgcattccatttccctcagcagagcccaattcagcaattaattttccagtatattcaactccttcacgggcagaatgaatatacggtaatactaaagtacaaagtgagtcttctgccaggccattttttacgtatggatcatatgctaacacccgatcatttgcataaacactctcagtaaaggaagctgccacatttgcttcattaattccatcttcttcattaggtccggctgtttgatcaagggtaggcgtagaagtataacgcattctctcttccggcaaagctacagttactttattgtaaggtgatacgtaggtttcgtggcgtccttttactgccggttttactaaaaatcgcttgggttcaattgcttttacgcgatcttcattacgagcaatataattagcaccgtcgagagaagcctttttaccgaccataattgatgtacaagcatctttattttgcatatttatttcctcctcaaataatagcgattacattatctatgatacgctaatttggtgaggactgcagtattgagcgagtataaaaacccaccatgtttaatcgaatgatgaaaaaattaaatgagaatctgttaaatcgaggagagtccttgtattattatttatggggttaccttcttttctatgtgatttggcgatttcattgtatcagagggcgagcctcttttttagtttaaaaacaaaaaatctgatattggtatagaatgtaatatttctatatcaacaccagatattgtagaaccataacaaaaaaggatcagtacctctatttcttagggaatactgatccttaatttttaccacattttaagctcacgtggtaaaaattactagttttgtatattttttgttttatacaaagccaataaatacctttacatcaacgtttacttctcatccaattgctcatcggtcttcaaaacggccataaaggcggcctgaggaatatcaacttttccgacagccttcatccgtttcttcccacgtttctgcttatctaataatttagcacgccggtctggatcccctgtatgaatacgggcagtaacgtcttttcggtaggctttaatattggtccgggcaataatttttgagcctattgctgcttgaattgggatttcaaagttttgccgtggaataatcttctttaacttagcagtaatttcccgaccacgttctgccgcaaagtcacggtgagcaataaagctcaatgcatccaccttatcgccattgagcaagatgtcaatcttaaccaaattacttgaccggtaaccatcaatttcataatctaaggaagcgtatccccgtgtagaactctttaacttgtcaaagaagtcaaaaataatttctgacagcggaatatgataaataacgtttacccgggtatcacttagatattccatcgtatcaaagtctccccgtttacgttggcaaagctccattactgggccaacataatcattgggtaccatgattgaagcgcggacatatggttccttaatcgctttaatggaagaagcgtctggcatttcagctggattttccacttcttttgttgtcccatccgctaattcaacatggtaagtaacagatggtgcagttgtgattaaatcaagattaaattcacgttcaagtcgttcttgaataacgtccatgtgaagtaatcctaagaaaccacaacggaatccaaatcccaatgcttgcgatgattccggttcaaaggttaatgctgcatcattaagttgaagcttttccaacgcatcacgtaaatcattaaatttagcattatcagttggataaagtccagcatataccattggcgtcatttgccgatatccttctaacggcttatctgtaggattatctgcacttgtaaccgtatcaccgacccgagtatctttaatgtctttaattgccgcggtaatataacctacatccccagccatcaatacatcacgtgccaatggtttaggagagttaattcctacttcagcaacttcatattcggtaccaccgttcattaacttaattcggtcaccttttttaaccgttccttcaacaacccggacactaagaaccacgccccgataatcatcatactttgaatcaaagataagggcttttaacggcgcagttaaatctcctgttggtgctgggacatccttaacgattttttcaaggacttcatcaacgcccattccagtcttagcactaatatcaactgcctcatcagtatctaaaccaatctcgtcttcaatctgtttcttagtaccctcaggatcagcagaaggtaaatcgatcttattgataacaggtaagatctcaaggtcattgtcaagcgctaaaaagacgttagcaagggtctgtgcttctaccccttgcgttgcatcgaccactaagacggcaccttcacaggcagcaagagaccgtgatacttcataagaaaaatcgacgtggcctggtgtatcgattaaatggaaaatgtaatcttcaccgtctttagcatgatatgtcaaggcgacggcatttaatttgattgtaatgccccgttcacgttctagaggcatatcatcaagaatctggtttttcatttcacgtttgctgattgaatcagtcatttctaaaatacgatcagcaagcgttgattttccatggtcaatgtgggcaacaattgagaaattccgaatgtgtttttgccgctctttcatttcttctaggttcatttaaaaagactcactttcaacgaatattctttatctagtataccaaatcctcgtttagaatgggaaaccttctactagatatacaaaaagcaggaaaaatattaagcttttcctgcttcataaaaattatttacttatcctcaaaggcatcacgtaacttatcaagaactgtcttcttcacacccttaacatcttcaccactagcagccgcaaaagctaacattgcttcacgctgacgcttgttaaggctcttaggtgtcttaacatggacagtaacatgttcatctccgttaccattaccgttaaggtgtggaacccctttgccacgcaagcggaaattagtttctgattgggttcccgcaggaatcttaaggttaacatcaccatgaaccgttttaacttttacttcatctcccaaggctgcttgagcaaacgaaatatcacgatcaacgtaaattgttgaaccgtcacgacggaattcacgacttggtgttacccggaagacaatatacaaatctccggctgggccaccattctcaccagcgtctccttggtgttggagccgcatttgttgaccatcatcaacaccggcaggcaccttcacttctagctcatgacgttcgtgaatatgtcctgcaccatggcaagtatcacaacgatcttctggcttaataatctttccagttccattacattctggacaagtggtttgagtttgcatattgcctagtggtgtttgacgaacactcgtaatcacgccggcaccatgacaccgtggacaagttattggcgatttaccaggctttgctccggttccatgacaagtcttacattctgcatcacggttatacttgatagtagttgttttaccaaaaaccgcatccataaaatcaagagtcattgcatattgtaaatcacgtccttgacgcggggctgttgggtcccgacgagtacgaccaccgccaccaaagaattgactaaagatgtcgtcaaagccgccgccaaagttagaataagcttgaccaccaccaaagccgccaaagccttgaccgccagcaccttgtgggccagctgaaccaaattgatcatattgagcacgtttttggctatcacttaatgtctcatatgcttcattaatcttcttaaacttttcttctgcaccaggctcgtggttaacatctgggtggtattttgccgcaagccgacgatatgcacgcttgatgtctttttcggatgcatccttagagacacctaaaatgtcataataatcttgttctgccatataataaatacctcattactttattgcttgtttagttataccacagccagcaaacgaaagtaaaagccaaagtccttttttctggcctttggcttttacactaacattttaagactgtttaccgcaggctatttcttgtcgtctggtgtaacgtccttaaaatcaccatcaacagtattgtcatcattaccgttgttattaccattttgttggttatcaccaggctgaccattagcagcgccaccttgtgcaccttgagcttgttggtaaagctttacgctaaggtcttgaataactttgtttaaagcatccttcttagctttcatttcatcaaggttgccgctttctttagccttctttaattcgtcacgagcactttcagccttcttgatatcatcttcaggaactttacccttaacttccttcaaagtcttatcaacttggaagagttcttggtcaacttcattctttaagtcaacttcttccttcttcttcttgtcggcttcagcatgctcttcagcatccttcttcatccgttcaatttcttcatcacttaagcctgagttagacttgatagtgatattttgcttcttgtgagttccttgatcttcagcagaaacattaacaataccgttcttatcgatatcaaatgtaactttgatttgaggaacaccacgaggagcagcaggaatatcagttagttggaagttacctaaagtcttgttatctgctgccattggacgttcaccttgaagaacgtgaatatcaacagctggttggttatcagcagcagtagagaagatttgactctttgaagtaggaatagttgtgttacggtcaatcaacttagtgaagacaccacccatggtttcaataccaagtgaaagtggagtaacatcaagtaatacgacatccttaacatcaccagtaagaaccccaccttgaatagctgcaccaagagcaacggcttcgtcaggattaattgagtggttaggttccttaccagttaattccttaaccatttcttgaacagcaggaatacgagtagatccaccgtttaagataacttcatcaatgtcatcaaaagtaagatcagcatctttcaaagcattcaatactggttgctttgtccgttcaactaagtcattagttaattggttaaattgtgcccggcttaatgtcttttccaagtgtaatggaccgttttcaccagctgaaataaatggtaagctgatttgtgcctcttgaacacctgacaagtccttcttagccttttcagcagcatccttcaaacgttgaagagccatcttatcttgagaaagatcaacaccatgttcttccttaaagccatcaattaaccaatccatgatcttttggtcaaagtcatccccacctaaatgagtatcaccattagtagaaagaacttggaagacaccgtcacctaattcaaggatggaaacatcgaatgtaccaccaccaaggtcataaacaaggatcttttcatctttgtccttcttgtcaagaccgtatgctagggatgaagcagtaggttcgttaataatccgctttacatcaaggcccgcaattttaccggcatccttagtagcttgacgttgagcatcattgaagtatgcaggaacagtaataactgcttgagtaacagtatcaccaatgtagtcttcagcatatttcttaaggtattgcaaaatcattgctgaaatttcttgtggagtatatttcttaccatcaacttcaacagtgtatcctgcttcacccatgtgactcttgattgatgaaatagtgttaggattagtaatcgcttgacgctttgctacttctccaacttgagtttcaccattcttaaatgaaacaacagatggtgttgtccgacttccttctgggttggtgataatcttaggttcattaccttccataacagcaaccgcagagttagtagtacctaaatcaataccaataatcttattacttgccataatttatttccttctctcacaaatttattgagctacaacaaccattgctgggcgtaatacccggtctttgagttgatatcctgcttgaagaacattaacaacagtttcaggcttctgaccttcttcgaccgaaacagtttgaactgcctggtgaagagtaggatcaaatgtttcaccatcagctttgatttcagtgatgccatgatcatttaatgcctttacaagatgatcatggaccatttgaatgccctttttaagttgcttgccattatcgtctacaacttcaattgctaaagcccgtttaaggttatcaagcactggtaaaattgactttgctaaatcctgaccatcatatttaaggatttgagcccgttctttattaaaacgattagtcatattttgaatttctgcttctgctcgtaaatatttgtcatctttatcagcgagctgcttctttaagtcagcgatctcttcttttaatttaacagtttgatcatccttcttatctgaagcctctttttttatatcttttttaggtgccttttcattttcaggcgcagtttgtttttgttgttcttcttgtttttccttggccaattaactcgcctcctatgaatcataatagtgacggtagaaatctaatagccgttttgctaattcttggcgaaaggcatttacaattccaatcgtccgtgaataaggcatccttgttggaccaagaactgcaataattcctcgtccatattgttcaacattataacttgcagtaatcaagctataatcatcaagaagcttattcttagagatttcttgaccgattttaacattaactccattatctgaggtaagtgttgaatccaagatattcgataagttgtcgttcttatctaacaagccatacagtgattggattgcatggggatcatgagtacttgcaaaatccagtaagttcaatcgaccaccaacgaaaaaccgctcacgtgctgcttgagataagacattatcaaaaatatcaaggaaaccatcgggactatgcatataatgcagaacctgaagtggaatatcatcttttagtcgttttaccacttctgatagcggcaaaccaactaattgatcattaatcattctaattactgtctgcaatgcatctgtgtcaatgtctgccggcaaagtgaatgactgattttcaacctcaccgctatcggtaaccaagatcgcaataaccttatgatttcctagcggcacaactcgaaagccactcaaacgaacactttcttgctcaggctttaatgtaaaagcagtatatgaagttaagtttgataagatatctgctgaatgtgaaataatctcgtcaatcttttgaaaaccggttccaagtgagttttgaattactaccaggtcattatcagtaactgcttgtggatcaagcaaattatcaacataataacggtaacctcgtttagatggaatccggcctgatgaagagtgctcttttaagatcaaatcattgtcctctaaaaccgccatctcattacggacagttgctgaactgaccttaaaaggcaacttttctgctaaatgttttgatccaaccggttgaccagttgatgtgtattgacgtacaatcgcttgcagaatctttttctgtcgttgtgttagcatcgtatatcacttccccttttagcactcattagggtcaagtgctaaacacactgtataatataccaattactcccctaaaagtcaagaaacgtcaaataatttttaaaaggagctttatccatgaaacataaagaacatcgctatattcaacctcagaatactcaagaagcaatgttattaattcagaagttatttaataaataccgcaatgcgtccctaacgaatgaactattagaataccataacaacctaatctatcgtttgcagtcagatattaaagacgaagcaattaaggagaacaatcctaatcaacttaaggcacttgcttccatgaccgaaattatgcgtaactggacaacagtacgcttaaacggccagccttttaacgggaaaatgcggcatttcaaattagtgactgatggcggattcaaatttgaacgaaatattcataaaattaaccagactaccagtcatcggggaagtcggcattaaaaaagaggtttgatgaatcttggtggcgaaattgccacgaaagatcaatctaaacctcttttatttatatttttctaaaatacgacgggcgttttgttcatcttgcttcatctgtgctactaatgcatccgctcccgtgaacttttcttcgccacgaaggtactgataccagcgcacaactacttcttcaccatacaccatttgttgaaaatcaaatagattaatctcaaccgttaattgattagcatcgccaaatgttatgttatggccaacacttgccatgccgtcataccacttcttaccgagcttaactttgacagcatagaccccaatcccaggaattcgctcctcttctggatgctcaacattgattgtaggaaaaccaagtgttcgtccacgagctaagccatgaactactaagccagttgtttgataaggataccctagtgcttggttggctgcttctacattaccagcatcaattaatttccgaatttctcgcgaaccgaccttttcttgacttccatcctcagtaaatttgggcacagttacaacttcaaaccgtcccgctgcatacttaggaagcaacttcattgatgcaatatcttcttttccataagtatgatcaaaacctgctacgaccgtttgagcatgaaagcctaccaaatactcatcaacaaattgctgaggagaaagacttgcaaaagacgaggtaaagcttattaaataaacccgatcgacatcaaggtcatttaataactcaagcttcctatcgaccgttgatagatatttaaagccgcccttatattgacgataaacaattcctggagcatgatcatacgtcaaaactactaatggcaatcctttttcacgggcaatttcacgggcacgtttgattactgcctgatgtccccgatgaacaccatcaaagaaacccattgcaagtacaattggccccgcaggaattagtcttttttccaaaggatggtgaattttaataacttgcaactcctacactcctcaattaactgcaaacattttagttggcttatacattttatttttcggatcaaaatgatatagtgcttttacttgtccatcaaatgataacacaatttccttctcactagtattaagttcacttggagaaagccatcctccattttgaacctttttccattgagcctcttgaatcgttaattgcggatagtccttcaaagcataatctaaaggatacaaatattgctggagagtttgggtcgcaacagcatcgcgaacgtcgtctaaacttagagtctgatcaagagtaaagcctccactcttcaaccgcgttaacaaactcattactcctggataccctagtttacgtgcaaggtcaacaacaagcgtccgaatataagtacccttactacattcaacattaaaacggattcgttgttgtttattttcctcatcatactttgagcttagtaattcaaatttgctaatagtcacttgtcgtttgggccgttcaacagtttcaccagttcttgcatattcataaagtttttttccatttacttttacagccgaatacatcggtgggatttgtattattgtccccgttaatgaattcatggctgataggatttcactagtcggaatttcatttgtaacttctttgtcctcaattttttctccatcaaggtcttgagtagtagtcgcaaaaccaattaaaagctcgccttgatattgttttcctgattgcatcaaataatcaacaactttggtagcatttccaacacaaattggtaaaacacccgctacacctggatcaagtgttcctgaatgaccaatctttttagtttttaaaatttgtcgtagtcgactaacacatgcaaaactagtcatcccacgttctttatataagggtattattccatccatcattattcctccaaggggctgctgtgatataagtcaagttactttcacaaaagacaaatagtgcagtacaacaatggcccccatcgctcggtaaaaaaacgaacgttggaggcctgttgcttgcgaggggctcccagaggcttgcttcgcgtcgaaaaacgaagtcacaagtaacttctgtctcgctcccttttcctgctaattatttttcttttttgtgtaagtcgttaatgagttgatcaattcgactaccgtaagcaactgatgggtctcttacaaatttgatttctggagtcttaaaaatattaagacgtgcgcctaattcactgcgaattaacccagttgccttatctaatccagcctgtgccttctccgcatcagaagcaagatctgacaagatactgtaatagatggttgcttgctggagatcaccagtaacatccacacctgtaattgtaacgttttgtacacgtggatcacgaacacgttttaacaagatttcatcaacatctttttgaatttcttgagctaaacggtctactcgatattgtttacttggcatctttatctctcctcagcttttacttaactggaacttctttcatcttgtaggcttcaataacatccatttctttaatgtcattgtagttttcaattgtcaacccacattcgtaaccttgcttaacttctttgacatcatctttgaagcgcttaagactacctaattcaccttcgtaaataacaacgccatcacgaactaaacgaacctttgcatcacgggtaatcttaccagaagtaaccattccccggcaattgtaccaacttttgatgccttatagatttgacgaacttctacctgaccaattgtttcttccttgtataccggttcaagcattcccttcatcgcatcttcaacttcttcaattgcatcgtaaatgacacggtgaagacggatatcaatactattagagtcagccaatgtcttagctacggcagttgggcgaacattaaaaccaatgataaccgcattagacgcttcagctaaggtaacatcactttgattaatggcaccaacggcttggtgaataatatcaacacgaacaccgtcaactttaatcttttgaaggctttgacttagagcctcaacagatccctgaacatcggctttaatgataatcggtaaggtcttcatttgacccttcttcatagttgcaaagaggttatctaatgtaacatgagaagtcttttgacgttccttatccattgctcgttttgcccgttcttcacctgctgcacgggcagtcttttcatcatcaaagacaacaaaccgatccccggcttctggtacttcatttaacccagtaatctcaacaggagtagatggggtagcttctttaatacgacgaccattttcatttgtcattgtccgcacacgaccaaatgtgttaccaacaacaattgggtccccaacatgaagagtaccttgttgaattaaaacagtggcaactgatccccgaccttgatcaaggcgggcttcaacaactgatccagccgcattttgatccggattagcctttaattccagcatttcagcttggagtagaatcatatcaagtaattcatcaagattcttaccaaatttggcagaaatcttaacaaaaatcgtatctccaccccagtcttcaggaatcaagttatactttgctaattcttcagttacacgatctggatttgcacctggcttatcaatcttgttaactgcaacaataattggtgtttgggcagcttgcgcgtggtgaatagcttcaactgtctgtggcataactccatcatcagctgcaacaacaaggaccgtgatatcagtaatattagctcctcgtgcacgcatttcagtaaaggccgcgtgtcctggcgtatcaaggaacgtaattaattgatcattatagtgaacttggtaagcaccaatttcctgggtgattccccctgcttcatgttcagtaacatgagagtgacgtaacttatcaagcaaggttgtcttaccatggtcaacgtgtcccataacagtaacaacagctggccgcgttacttgatgttcagtattattttgttcatcttcaaacatcttatcaatgtctgaaacgtcaacttgaaccttttccttagcctcaataccgtaatcagttgctaataattcaattgtatccttatcaagtgactgattttggttgatcattacaccaagcataaataactttttaacgatttctgctggtgaacggtgtaagatctttcctaagtcttgggcattcatcccatcagtatattctaatacttctggaagcggcttatcttttcgttgtgttggttgcttatgagctacttcacgtaaccgcttgttcttattgtgtttcttattcttcttatttttcttattaaagcgtttgccattacggccttgatcgttatttaagctgccgccaaatcgaccaccattgttttggtgttgattattatcttttgttccattgtttggtcggctattgtttttcttttgtggacgctcattttgtgccttatcatgatcgtggtgttgattgtgattttgtgcttgatggttattttgcttattgtgaccatcatttttctttactggttggcgttgattattagttgttttttgtccaccctttgcaagttgacgtaattgttgcgcttgatctggggtaacagaagacatgtgacttttaactcccattccttgccgattggccatattaactaagtctttgctaggcatttttaattccttagctaattcataaattcgttctttggccatatgctcacactccttatctcatagttagtagttcctcaaactttcttgcaaaacctgattgcattacacaaaaaactgttcgtgcttgccctgttgcccggctaagttgttctctagtgaaatctgttgaaaaaggaatgccataaaatttacatttatcagtaatcttttttgcactagcttttccagcatctgaagctaggaatacaaactttgcctttttagtttgaatattttttaagacaatctcttccccactctgaagttgccgggcacgccgagcgattccaaggaggtttaagacctgttctttatttttgatcattaccaaataactcttgtcgtgcctgtaggtggtctgcatacttgattaattcatcataaaatgattcatcaagttgaacatgaaaagctttttcaaaagttttttctttcttggcgcgctttgcaatatccacatctactgcaacatatgctccacgaccaggctttttaccagttgggtctaaggagacttcattttccttattcttaactacccgaatcaattgccttttaggcatcatttcaccggtaacaatgtctttacgcatcggtatttttctctttttcattattttcaccccgctgcttaatttctagttattcttcgttattgtcaacattttcttctaaatcagctacttcttcagattcttggtcattttcagccatttcagattcagacttgatatcaatcttgtacttagtcaaccgagcagcaagacgagcattttgtcctcgcttaccgatggctaaggataattggctatctgggacaacgacagtgcatgaacgttctgtttgtccttcagtcgtttcttcaccttcgctatcctcagtttcgcttgctgccttctcttcgttaaagattacatccagtacttctgctgggttcaatgcattagcgataaacttagcgggctccttaacatactccacaatatccatattctcgccatcaagttcattaacgattgcttgtacacgagaacctcgtggaccaacgcaagttccaactggatcaacattaggatcatttgagtatactgcaaccttagcacgatcacctgcttcacgagcaatattttcgattaagacagtcccatccttgatttcaggcacttctcgttcaaataatcgctttaaaagttctggagcagtccggctaacaaaaatttgtggtccccgacgatcgtcatttactttcgttacgtatacttgaatccgatcatggacgtggtagtgctcattaggcatcttatctctaaagcccatggcaccttctacaccatctcctaaatcaacatatgtgaaacgcttatcttctcgtgaaacttcaccagtgataatctcattttcataagtcttatacttgtcgtaaatgattttccgttcttcttcacggagacgctgcattactacttgtttagcagtttgggcagcaatccgaccaaaatcacgaggggtaacttcttcgcgaatttcatcaccaatatcataaccttggccatgaggaagcttccgtgcatcagctaaactcataaattcgttgctgtctgcttcgactgcttcttcatcatcagtaattgtttttacagcgtagactttaatattaccagtcaatgaattgaattctacttcaacattcttatcaccgtaattttgcttgtatgctgattcaagtgcttgttctaacgcttcaataacaatctctttcttgatccccttttctttttcaagataatcaagggcgccaatcatctcagtgttaatttttggcttactcacctttcgacactcctttaatactagaatttaatcgctaatcgggcctgggcaattttctgacgatcaatcgtaatttgccgatgacgagtcttgtctaaataatccaacgtaatttctttattagacaattgcgttaacgtaccctcataaaccttttgaccattaatctgttggtaaagagaaatgtgaatgtaatggtcaattgctcgttgataatcttcctctttcttcagtgggcgttcagcacctggtgaggaaacttctaaaaagtaagcctgtggaattggatcaggttcaacattatctaatgcttcacttaattcatcactgacaagtgcgcaatcttctagcgtaatcccaccgtctttatcaatataaacgcggaggtaccagcttttaccttcttttacaaactctaaatcatataagtaaaaatcatggtcctgtaaaatcggcgttacaagatctgttacagtttctacaacactgctcaaacgtgtcacctccattatttgcaataaaaagagcgagcatctctgctcactcccacgagttatttaccataatctattgtagcatgtaacacagccactggcaagcaatgaagcatgttttcattactattccttaaaacaagctaagttgattttcgtcaggcagcttatctaatacatgattatctgtcaaaaagtcaataagtgtctgcgaaacctttccacgctctgccaaatcttctttagaaaggaatggacgttcttcacgtgcggcaacaatttgcttagcaacgtttagccctaatccaggaactgctcggaatggtgcaattaatgaatcaccatcaatcaaccaatcggaggcatctgatttttcaatatcaaccatcttaaacttaaagccccgttccagcatctcattagctagttcaagaattgttaagagattcttctcttttgcactggcatcatttcccttatcattgatttctttcatccgttgcttaaccgcatctttaccatgagacatcgctactacatcaaagtcatctgctcgcacagagaagaatgcacaataataaactaacgggaaataaaccttaaagtaagcaattcgtagagccatcaagacataagcagccgcgtgcgcccgcgggaacatatacttaatcttcaaacatgagtccatataccattgtggaacattagcttcatgcatcttttcttgccactcgtctggaatcccgcgccccttccgtacgtgttccataatttggaaagaaatttctgagtccattccatagtggattaagtcggtcatgatgttatcacgacaaccaataacattagcgatagtggcaattccctgtttgattagttcctgggcattatctagccacacaccagtcccatgtgaaagaccagaaatttgtaataattgcgagtaatttttcggatgagtatcctccagcatcccccggacaaatcgcgtcccgaattccggcaatcctagtgtaccagttttactttgaatttgttcttcagttacccctaataccttaggactagagaataaggccatcacccctggatcatccattggaatcgattgaggatcaattcctgataaatcttgcaaggcacgaatcatcgttggatcatcatgtcccaaaatatccattttaagaatattatcgtgaatcgagtggaaatcaaagtgagttgtttcccaggcagctgtttgatcatcagcaggatactgtacaggtgtaaagtcataaatatccatatcatcaggaacaataataattcccgctgggtgctgaccagtagttcgcttaacaccagtagctccttttgctaagcgatcctcctctgcctttctaaattccttttctgtatctcgttcgtaagccttcacatatccatatgccgtcttatcagcaaccgtaccaattgtcccggcacggaatacatttttttcaccgaataagactttcatatagttatgggcaattggctggtagtcaccagagaagtttaaatcaatatctggtaccttattacccttaaacccaaggaaagtttggaatggaatatcatgaccgtcttttaccattagagtgccacactttggacattttttatctggcaaatcgaaacctgaactatattccccttgcgtatagaagtgggtaaattgacaatttggacaacggtaatgcggtggcaacgggttaacttctgtaattcccgaaagcgttgcaaccacacttgaaccaacagatccccgcgaacctactaagtatccgtctttattagacttagctactagtcgttgggcaattaaatagtgaacagagaatccgttcttaacaatactgttcaactctaattcaatccggtcctgaactagttgtggcaaaggatcaccataccattttcgcgcagtattccatgtccgatcttggatttcctgttcggcccccttcatatgcggtggataaagtttatcttttactggccgaatattgtcatcaatctcagctgcaatcttattactattctctacaactaattcgtgggctttttcttcaccgagaaaagcaaattcatttaacatttcatcagtggtcctaaagtgcacttctggacgctcagttcgatttaacgggtttgcgccaccttgcgaattaatcaggatcttacggtaaattgcatcatgtggatcaaggtaatggacatctccagtggcaaccactgttttttccaactcatcccctagtttgaccatatttttgaggatatcttcgaggtggtcttcatctgcaatcacatgttgttcaagtaacggtgcatagtttggcttgggctgaacttcaataaaatcatagtagcgcgccttttctagtgcttgatcgtaacctttctccatcatcgcggtaaatacttctcccgatgaacaagcagttcccaaaagcagtccttcacgatatttcgtcagcactgttcgcgggattcgcggtactcggtaaaaatattcaacgtttgatagcgatactaacttaaataagtttttcaaaccagcctgggtctgcgcaaaaatcgttacatgaaaaggccgcgcatgacggtaagcattattttcttccatgtgcttatttaaatcatccacatacttcacatcataacgggcttcagcatctttcaagaacttataaagcaagtgtcctgtagcttccgaatcatagttagcacggtggtgatgttccaatgctaccttaaactttttactaagcgtgtttaatcggtatcctcgcatatcaggatataagaatcgcgccagtggtaatgtatcgattactggttccgcgatttttcccatttgatgacgttcatagccagtattcataaaacccatatcaaatgcaacgttatgaccagcaatgatacagcccttacaaaagtccttaaacatctgaaaaacttcttcttcagtttttgaaccctgaaccatttcagtggtgatactagttaaattagttgtttgttctgataacgggaaaccaggatcgatgaattcatcaaaacgttctaagacatttccatcttgcattttaactgcagacaattcaattaccttatcgtaaattgccgataaccctgtcgtttccacgtcaaaaatgacataggtctgatgagcgagttcttcatgattctcgttgtataccaatggaattccatcatcaacaacattagcttccattccatatagcattttaatgcccgttttttgggccacgctaaatgcttctggaaaagcctggacattcccatgatcggttaccgcaattgctggatgtccccacttatgagcacgagttgcaagctcagtaatcgaattagtggcatccatctgactcattgttgtatgcgtatgaagttcaactcgtttatcatcttgaggagctttatcttgacgcgccgtatgagttacttcattaacatcataagccgtgattaccaagtctcgcatccaagtatcttcttgtacaggcccgcgaactttcaaccacattcctgctttgatattggcaaattgtgcttcttcatcactgttgcgtgagaatttcttgacagcaaaagaagaagtgtagtcagtaatttcaaaggttaataattgacgacctgagcgtagttcgcgaatttctgcattaaatacatatccttcaacaaccacggaccgctcttcaccctcaatgtctttcatttgaataacattctgcttactatcaatcatccggccaagttgaactgggccatcagcaggagcaactggtgcactcttctttgctgtcttctttgcagcctcatttttcttgatccgggcagccgccttggcagcaagcgcagcatcggctttctcgtgtttagcctttaattcttcaatttttgcttgcgaggctgactggtcaacaaatgggtgaatcctaaatttaggaaagcccagctcttggtatgatttttcaatcttatctaatgctttctgtgctagtaagtctttaattacctcattttcaacaactagcgttacacgaccctccttaacctcgggagccgtttgtaagcaagcttgttggagcattggtgtatcactaattgccttattaatgatgaactgccaataattagctatctgtgattcatcaagttttgtcatgggagtactaatcttcaaactaactttagcaatatctttgaaccctagctgtaagctctggttgaactgcgtaaataggtcatacggtaaagctttattaaagattaagtgaaattcccagtgccgagactttttatgaacaacaactgattgaactgcggcatttctgaatgcagaattgtctttttccggaaagtgaatttgttctaatagttttccaaataattcttggcgacttaatcccacgttctaatcctcctacttaaaaatgtggtgcgagtaacgttatttatcttaacatcgcagccacattagtttaaattatttgtttttttcttcgttcaattgctttagtaaaattcccaccgtatttactagctcttcctgtttaacttcaacagtttcaccagttttacggatcttaatttcaacaataccatcttgagctttcttaccaacagtaacccgaattggaataccaatcaagtctgaatcagcaaatttaacccctgctcgttcttttcggtcatctactaatacctcataaccagcttcagttaattgttgatcgatcttatcagccattgccatttgatcttctttcttcgcattaactggaattacatgaacatcaaatggagcaatactattaggccagacaagaccattttcatcagcattttgttctgcaacagctgacaatagacgggttacaccaataccgtaacttcccatgattacgtctgtcaaacgaccattgctatcaagaacttgggcaccaagtttgcttgagtaatgagtacctaacttaaagatatgaccaatttcaattccgggagtaaatttaagtggtttaccatcaggagcaatctcgccttctttaacattccggaagtcaccaaattgatcaacgcggaagtcacggtcaatattagcattaatataatggtaaccatcttcattagcaccacatgccatgttaactaaaaccttaacataattatcagcaagaatttttacttcttcgcctactcctacaggtcctaatgatccaggatgagcattaaggtacttttcggcatcttcttctgtagctaattcaagttcttcacaatcaagagcattcgttacctttgcttcattaacttcatcgtcgccacgcattaatactaagaccggttggtattcatcttcactcattttagcaatgtaaagcattgatttgataacttgattaggatcaagatctaaactttctgcagcttcatctaccgtatgagcacccggagtagcttttttctcaattggtgcaggagcagctgttcgttgtacaccagtaaatttactttcagctttctcaatattggcagcgtaatctccatcagtataagcgattatgtcttcccctacttcagctggtgcagagaattcttgtgagttcttaccacccattgttcccgaatcagcgagaataactttatagtttaagccaatccgatcaaaaatgttccggtaagcctttgcttgattattgtaggcttcgtctaatccttcttgatctgctgagaaggaataaccatcaagcatttcaaattcttttccacgaagaattccataacgaggacgatcttcatcacgaaacttatcttgtaattgataaactactaatggcagcttcttgtacgacttaatactatcacgcaatacttcagtaaaggtttcttcatgagttgggcccaaaataaagtcacggtcacgacgatctttaagtttaaaaagattatcaccatagctttcgtaacgaccagattccttccacaaatcagctggaagaagtcccggcataagcatttcaaccgctccggccttatccatttcatcacgaataatattttctacttttcgaataacccggtaagctaatggtaaatatgaccatacccctgcagatacttggtaaatgtagccggcacgaatcatcatcttatgacttaaggcttctgcatcacttggggcctctttttttgttggaattaatacctttgactgtttcattaaaactatactcctttgtttttaattaccgaataaaatatctttgaatatcgttccatgttactagaaccataagtgttagtaagattagaaaaccaatcattgtgataattccctcagctttttcaggaattggtcgccgaatgatcgcttcaacaatattcaataataatttcccaccatctaatgctggaattggtaataagttaacaattcctaaattaattgataagagggctaagaaatttaaaactccattgattcccaatgaggtggcttgtgatgtcccagcataaattgctaccggtccaccaaggtcatttaagctaaatccatgggtaaccatatgaccaagaacactaaagattaatgttcccgcttggataaattgttgccaaccaaactttaatcgagcagctaaacttctctcttgcttttcaacaattccaatttggccaactttctgatgccctcgctcaactgcttttggtgttagcttagtatgatatgtcttattaccacgctcatacgttactgatactgtcttgttaggcttatttgaaatattagttgaaaggtcagtccaattatttattttttggttgttaaccttaacaatccgatcatttgcttttaagcccgctttggcagctacggaaccggcattcacttgccctaactgattgctattagttggtacgcccgttaaggtaaaaccaagaatgataaatactactaaggacaaaataaaattattcattggaccagcaaaattagtcatcatccgtgcaggcagacttgctgaacgaaattgcacatcacgtggagcaatctgtacctcggttccgtctcgttcaataatcattgcatcatggtcaacactatataccttcagctgatcttcgtccccattgacatatccttttatccataagccatcttctaaatcacaagcaactaattgaaggggatcccctgaaataaggttgttttatcactagcattaatactaataactttatcttgatcatttagttgaatcgttagaggggtacctggctttaactcatcttggtcctcatcatcagcaccagctaaacgaacataaccaccgaggggcaaaattcgaatagtataggtagtaccattttttcgtttccaccaaatttttggacccattcctattgaaaattcacgaaccagaattcctgctcgtttagcaaaataataatgaccatattcatgaacaaggacaaggattccaaaaacaataataaatgtaataattgttattatcaaaaaatctcttccttacgtttgattaaatgatccctaataaatgaagcattggcataacaattagcatactatcaaaccgatctaaaattccgccatggcctggaagaatttttcccgaatcctttacaccatagtagcgttttaatgatgattcgattaagtcaccaaattgaccgaagattgaaagaatcaaagtaacgaatatcattgttacccaacctgcaccaacagggataaagtagcaataaatagccaaaataataacagcagctaatgtaccaccaattgaaccttcccaagttttattaggactaatcttaggagcgagtttatttttaccaatttttcggccaattaaatatgctccactatctgtaatccaaacgattaacattccatataatagcgtttgaaaattgattgcacgagcagcaataaaatagcgaaatcccattccaatatagagcattgctaatgttaaaaccccagcatcatcgaaagtaaagcgttgttttcgaataaccgtatgtaatagaagtaaaacaactaaaatatagaatccgaaccatcgagttgcaacactaggcaagaagtcaagccaactatccggcagtattaataatgcaacccccagataactgatcaaagcttcaaacgaaattacaaacatttttttcattaccaatacttctgacattgcaaccattcctaaggcaacggctgcaattgttaatggccaatgaccatatataataagcggtataaagattgcaagtgcaattaccgcggtcgttattcttgttttcaaaacaaaatccccttattatttattgattttttagtccaccgaaccgccgatgacgtccttgataggcaattattgctgaccgtaatgaatcttcatcaaagtctggccagtgttctggaacaaactccaattcactataagcaatttgccacagcataaagttactaatccgctcttcgccacttgttctgattagcaggtcaggatctgcaaattgacccagttgtgctgacatcaagtacttaccaaacgaagcttcatcaatatccgcaagtgccaagttcccattttgaacgtcttctgcaatctctttagcagcttgagtgatctcatctcgactcccataattcaaagcaaaattgagaatcatccccgtacaatgggctgtatcagccattgcatctttaacagctttttgcgtagcttcaggcagttgcgtaatatctcccatcactgtcaccttaacattatgtttgacaagatctggaacaaatgttgagaagaagcggacaggcaactgcattaaataacttacctctgaagaaggacgtttccagttttcggttgaaaaagcatataatgataagacttttacccctaattcactggcagcaattgtaatcttttttactgtttgcattccttgcttatgaccagcaacccgtggaaggtgtcgtttctgcgcccacctaccattaccgtccataataattgcaatatggttaggaatacgttccatatcaagttgctgatttatttcatcatgtttacttttggaaaacactaattgttcctccattttttatcatgtacttaagattaattacagacacttcttaaaaattcacgtctgccaattaattatagcctttattataccagaggcaaatttcgatttgtcaatccacagtaaattgttacatagttttatcataacaattcaattttagccaaaataaaaaggttgtggacttacgcaaagttcacaacctttttatttctgaaaactagccttccattaattccttttcttttgtattcgcaatatcttcaaggttcttaattccagcatctgtttcgttttgaactttcttttcaagatcatggaattcatcatcattaaagtcgccattcttgttacccttctttaagtcatccatcgcttcacgacgaacatttcgaactgcaacttttgccttttctaattcagctttaacgtcctttactaattctttccgccgatcttcagttaattgtgggatgattaagcgaattgaacttccgtcgttttgaggagttaatcctaaattagatgcatagattgctttttcaatttcttcaagcacgctttcgtcataaggggtgattaataattgccgtgcttctggaattgtgattgatgcaacttgatttaatggagttggtgctccgtaatattcaactttaacagaatttaataaacttgcattggcttgacccgcacgaatatcagcaagtgtccgctgaagtgcatcacctgattttgccattttttgtttggcatcatttaaaatttcttttcctgtagccatattattagtctccttcaattgttgtaccaacttcttgaccagttactactttcataatattgcctgatgtgttcaagttgaagactaccaatggaatatgattgtccatcgatagtgaactagcagtagtatccattacatgtaaattcttttcaatgatatccatatgggttaaatgatcaaacttagtagcatccttaactttatttggatcagctgagtaaacgccgtcaaccccatttttacccattaaaatggcatcagcgttaatttctgctgctcgtaatgcagcagtagtatcagttgagaagtaaggacttcctgttccaccagcaaaaataacgattcgatctttctctaaatgacgaatagctttccgccgaatatatggttcagcaatttggcgcatttcaattgaagtttgtacccgggtaggaacaccaattgattcaagcgcatcttgaagtgataaggcattcataatagttgctaacattccaatgtaatcagcttgcgcacgttccatccctaattcagcaccagtaacaccacgccacatgttaccaccaccaacaacgatggcaatttgaacgcccaaattatgaacttcttttaattctttagctacatcctttaaaacgggtgggttaatcccaaaacccttgtcgccagctaatgcttctccactgagctttaaaattactcgcttatatttaatatctgccatatgatatcctccttgaattggtaagttaatctttaaaaaaggacgcactacattgagtacgtcctccttttgaccgaacgcttagttcatttggtccttaacttcttgagcaaagtcatcttgctttttttcgattccttcaccgacttcgtaacgaatgaaggacttcaacttaccattcttgcttgaaacgtattgttcaacagtttggtcagaatccttaacaaagtcttgatctgctaaacaaatttgtgaaaggaacttgtttaaacgaccttcaacaatcttgtcaacgatcttttcaggctttccttcgtttaaagtttcttccttgaagatagcacgttcatggtcaagacgttcttgagaaacatcatcacgagtcatgaattcagggttgatagctgcaacgtgcattgcaacgtctttagcagtggcatcgtcagcaccttctaagacaaccaatgcagcaatttgaccaccttggtgtaagtatgcaccaaagctatcgccgtcatccttttctacaacagtaaaccgacgaaggctaaccttttcaccagttttttgtgtagtactgataatatcatcatttaatgtgccattttcagtcttgatttctaatgcttcttcaacattagcaggcttgttttcactaattaacttagtaaccttcttcaataagtccttaaatggttcactagcagcaacgaaatcagtttctgaattcaattcaacgattgcagctgtattgccattaacagcaatatcagctaagccttcagctgcaacacgatcactcttcttggctgccttagcaatacccttttcacgaaggtagtccattgctttgtccatgtcaccattactagcaactaatgccttcttagcatccatgataccggcaccggattttttacgtaattgcataacttgagcagctttaatttcagccatgacgaaatctctccttttataatcttttttgaaaaaagggctgtttagtacttaggccagaatggtccgtacaaaacagcccaagaatttaatatttttagtcttctttaccttcaacgctgttcttcaagttctttaatgaatcttcgctaacagtttcgttagcagcgttatcatcagcagtttcttgttgagcatcgtcttgaccttgcttaccttcaacaaaagcatcagccatctttgaagtgattaagcgaacggcacggatagcatcatcgtttgatgggataacgtaatcaatgtcgtctgggtcagtgttagtatcaaccatagctacgattggaatgtgtaacttttgagcttccttaacagcgatttgttccttgtgaggatcaacaatgaacataacatctgggatccgtggcatatcttcaataccaccaaggaaacgttcaagcttttcacgttgcttagttaagacagcaacttccttcttaggaagaacatcaaatgtaccgtcttcgctcatcttcttaagttccttcaaacgagcaatccgtgattggatagtcttccagttggtcaaagtaccacctaaccaacggtggttaacgtagtattgacctgcacgaatagcttcttcttcaatagcatcttgagcttgcttctttgtaccaacaaataaagcaacaccatcgttagcagcaacatctttcatgtagttgtaagcagtatcaattaacttaacagtcttttgtaagtcaatgatgtaaataccgttacgttcagtaaagatgtattcttccatctttgggttccaacgacgagtttggtgaccgaagtggacaccggcttcaagcaattgcttcatagatacaacagacataaataatacctccaaattgtttctcctccccagtcttcttctggcaatgggactatttaagcaccctcaccaccatcattctgggtgtgaaattggcgtgtaacaccgaaatatagtatacaaaaaaccttgcaaactgacaaggtttttcacttaacttattttaaaatttaactagtttatctgaggtgccagttttaatcaaatctagattggcggacaaactcatcttaaccatatttttaattgcttgatcagtatagaaagcaatatgtggcgtgattaaaacatttggccgatcaactaaatccttaaattcgttataatcaacttcttggaaatcaatttgctggttaaaaatcttggtttcaccagtcattacgtctaaagcagctcctccgactttaccgctattcaacgcttcaatcaatgccttttcatcgactaatggtccacgtgcagtgttaaccagtaagaccccgtcctgcatcattgcaaatgttttttcattaagcattttatctgtcgctggaacatgaggtaaataaagcgaaataattgttgcccgtttatataattcatcaaggctaacgtattcaacaattccttctagttccttattttggtgacggctatatgcaatcacttttgcaccaaaaccagcaaagattttagctgctgtggatccaatgtttcctgttccaactatccgacaacctgcttattcatttccttagcaatatgcggtgcccagttataatctccttttgctaattttaaataaaattcttttgttcgacgtaaaaggttgagtgcttgagtaactgaaaattcagcaattgcagctggggaataaactggtacgttagtaatttggaaaccaagttctcgtactaattcatgattaagattatcaaccccaacattccgcaatgacatctttgtaataccattaaacgctaattgacgtaaggcctcgtctgaataaggcttttgctggaatactactactccatcgcttcctttagacaagttgactgtgctttcgtctaaaagtttagttgttgagtctacagttacttcaggatgttcctcttgccattcctcaatgtaagggacttcatcctgataaacaccatacatataaatcttcatcttaattcctccgtagtttcaataaattaacaccatggtctagtaaaaatttttctttttggcggcgggtttgatgtttaaaataatattccgcacttaaggcatcatgctttgattcaaattcctctgaataaataagctttagtggatgacgctttttcacacgagtatattttgccccttgataagtttgatgagtatgaaagcgccgtttaacattgttggtaaagccacaataaaagctattatctgcacaatacaatacataaatatagtatttctcacttgccatataataactcctgaaccgctggagtatactggttatctgctccatgaacaatcaatggtggtactacttttactcctccaggccggccatccttaatcacttcaagcaacaaaatattcgcatcacgatcaggtttaggatgaataaattgaattcttttaggtgctaatctattttcctgacacacttgtaaaatctcacctaaacgatctggacgatgcacaagatacccatgaccattcatttttaataagccattcatctttttaacaactgtcactaaatcagtcgctatttcgtgacgagcaatcgctaaagctttatttggattcttctggctttgggctgtaactgggaaataaggaggattacaaaggacaatatcaatcgagtccttagaaatataatcattaacgtttgcgatatcatcattaatgacggtataacgatcttgtaaatcatttagcaaaattgtccgttcagccatatcagcaatctgtggttgtaattcaacttcggtaaatgttccgccaagcttatcgtggagaaaaatgccgattgccccatttccagcgcacaagtcaacaatttttaatttctgtcgatgattgggacgcacaaagtttgctaataagacagcatctaacgaaaaagcaaaataatggggattttggattatccgtacatcctgactatataactgatcaattctttcatccttttttaaaatatttctgttttccattatgtcctccattatttttgtacttgcaagatccactttttttcgtcatactgaggaacgaaaacttaattttgttatagattggaagattgacatgttgtacactttcctcgttaaaatcgttaatccatttttaaatttgattaacggacgacctaaaatatacaatcgggaaaacatccctgaaggcaattatattattattgcacctcatcgtacttggatggatcctgtcttactagcgcttgccgtatggcccaaaaaatttagcttcatggctaaaaaagaactttttaagaatccaattgctagcaaattcttaaaagcactaaatgcctatccggttgatcggaaaaatccaggtccgtctgctattaaaaagccggttacaattttaaagaagactgacttatcgaccattattttccctagcggatcacgctactcatctaaattaaaaggcggggccaccgtgatcgctaaaatggcaaacgtccccttagttcctgctgtttaccagggacccctaaaatttggccagctatttacccgtaagccgcgccaaattgcatttgggaagcctatttatattgaccgaaagcaacggctcactcccgaagtacaggctgacttagaaaagcaaatgcaagactcctttgaccaattagatagacaaattgatcccaattataaatatattgttcctccaaagccgaagaatgatgaattttaatttccaatataaaaggatgtgataaaaatcacatccttttatattatttacgatttgactttttagcttgtgctttcatcgcttgcatcatttgatgtaatttacgacttgatggtttttgtcccatttgaagcatcatcgtccgcagcatctcttccgaaatcggtggattattgcggaggtagttttccatgtatttacgtgcaccaaagaagccgataaccaaaccgactaataatgcaagaatcattagcatgatcgtcatacccacaattacttcctcctttgctcgttacctatccatcttacacgaaagagcaatttttgaaaagagcaaatcgctgttaatcgtcacgaagtccttttttacgttgaatttcacgaaccttttcaggagtaacctctttaccttctttatcaaaaatccgcatcatttcaatattactacgcattgcttctctaaagttctttaggtattccttacgtaaacgatctcgttctttagtttcttcctcagttaaaccttcttctttattcttatgagcaagttcattaattcgcttcaataaagcatcttgttctttcgattcagccattataatcatctccttaataaagtcgattttacttattttataaaattaatgcaaatcacgaacgtacgtttgaaatatgcatctatctatgataagcttaacacaattaatgataatgaggtgtcaatatggcaaaggtagcaaaaaataaacaaatggccgtcctaaattatattcataaacaagttgaagatcatggctatccaccgactgttcgtgaaatttgtagtgctgttggcctgtcttcaacttcaacagtccatggacacatctctcgcttaattgaacaaggattcttacaaaaagacccttctaaacctcgagcacttgagatcacacccaagggacttgatattttaggtgtaaaaccgattcaaaaagaaattccaatgcttggtgttgttacggctgggcaaccaattttagcagttgaaaatgctactgagtttttcccgatacctccttctattcaagataataatgatttgtttatgcttaccattcgtggaactagtatgattaaagcagggatttttaatggcgaccaagtaattgtgcgtaaacaatccaccgctaaaaatggtgatatcgttattgcaatgaatgatgataatgaagctacttgtaaacgattctataaagaaaaaacacgttttcgtttacagccagaaaatgatacgatggagccaatcttcttagacaatgtaaaaatccttggtaaagtagtgggactatttcgtgatcatattttctaaataaaaaaggagtccattttggggctcctttttatttaggttatttggcttcataaatccgttgatgatccttttgccctttaagaacgaaaggtaatggatcattagtaacatcaaactcgatatcctggtcattcattcctaattgactactgaatagtttttcgtattctgctaccgaaacctggtgacgatgttctagttcttcttgaatattattcatataatgctcgtagccatcttctaggattcctgtgtagaactctccttctgcaccagaaccatagctaaataacccaattcggcttccagcttttaagtcactattttgtaacaatgacattaatgataaatatagggagccagtgtaaaggttaccaacttgacgtgaaaatagttgacttgcggttaattgtgttcgtaatcgttgagctacctcatcattacgatctttgagcagcccttctaaccctttctttcccattttagtaaatggcatatggaatgtaagggcagcaaaatctgctaattctcgcccagttaattgctggtaacgggtaaaagtttgaaggaaaaattcaatataaacattagtagagtattttccatctactaaagcttctgttgcatataacggccgccaaaagtccattatatccttactataagcaaccgttgtatcttcaagggttaggatgtgagggttccgcgaaatcagcattgcaactgctccagctccttgagtcacctctcctggcgtatttaatccataacgagcaatatcagcagcgatcaccaatacagtttcttgaggattaagcgccactactccctttgcaaattggatagcagctgttgcagaataacaagcctctttcatttctaccgttcgggtgaagtcgctaagccctaataagcgtttaatgtagattgcactcgcttttgaattgtcaattcctgactcagttgccacaattactgtcgaaatatttttttctaattccggagtaagcaattttttcgctgccgtagctcctaaagtcacaatatcttgcgtaggtggcacaactgcctgtagatcctgtccaattccaatggtaaatttattaggatctacgctgcgttcttttgctaattcaacaaggtctaaatagtcatttgttgttgcaaaagccattttgtcaataccaattctcatttcttatcatcctcttgtcaaataattataactgatccatcgtcttatttagtaattcatcgaccttattatttccagcattcgttgcatgacccttagtccaatcaaaatgtaaattagggaactgaggtaaaagggtaactatttcttcccatagcttctgatttgctaccggcttgccactagcagttaaccatccccgtcgctgccaattagttaaccagcctttcataattggatcaagtacgtaatgtgaatccaaaatcgctgtaattggttgatcttggaggccaagttctaatagtttagttagtgcttgaattaaagctgtaatctccattttattattagtagccccaaattcgccagcagttcctgtataagcttgatctttagtttgaataaaataagcccaggccgctttatcatctgccttaacatgctgtcccaatttattgccatgattacgggagcctccatcagtataaacaagaatgttatcagaataatcaaccgttttagtcgatggtacgatatttcccgtagcctgaagccactcattagcacctttaaacgttaaaaagcttttgaacttagcattcggatatccattaacttccttctgacattcagcccaagttttatatattcctggatgacgaccttttttgactgcataatatttttttaccataaaaatcccctaattaaatttcaaattacatcatatattagaatatcatatcagcaagaaatcatttctgcaaaattattaaatagctatttccttgattgagttagtgtaagattttcataggttggatgaataattcatctggtcgtggaaatcttttttgtagaccaatttacttatttacaaaaaaagaaaagaccagtagcctttagtgtgtcgaatactaagcaaaggcaggtctttcctcatggatattttaacagaaatcgagcagaatttggtgaaatcaggcagtttatttgaagctgaacagattattttaaaaggggtattggagttaggacaagtaatcatgcaaaactttttggaaagcttagatcgaagcttaaagtcccaagctccagcgaactatcaagtaattaataaacagccacggacgcttaattttatctttggcccggtgacttttcaacgacggtattatcaggctgggacaaagaaacgtgaattttacttagaccaacaattaaaaattaaaccacgtcgtcgtttatcgccacactacttaatgatgatggctaagattgcccaaacaactacaatgcgcaatactgccgacattttgaaccttgtatttgacagcggaattactgccgattcggtaatgcacgccgtgcatgagttaggaaatcaggtagctaaacaaactcaagcaaaagaacaccaagctactcctcgccatatgcctaaaaatttaactattgagggtgatgcctttatgattaaaggtaaaaaagaagcaggtcagctgactcttgtgcaccattatcgggtttatgagcgagtagctaatcaaatcattaatcggcatgactttctcagtgttgggcaccaaggacggcttgaagcacgactaagtgattatttagaccgccattataagcttgccggtcaaacgatctttttggccagtgacgctggcccaggttacgaaccagctaagctattaagtctagttcctcaaagtgcacatggtgaatactttctcgaccgctatcattgtttgcagaaaattgaacatactttaggccggcacaacgaattagccatgcgagcaattaaagccgttcgtcatcatgatcaagcagagctaacaataattttagatacttatgaatcacaaaacctaacggaaaaacaagcagatgacctaatgcgtttaagaaagtatctacagcgaaattggcggtatatcctctcaccacaaatgcgtggatttaaggatattcatttaattggttcagtcgaaagttctcaccgggcttttacttaccggatgaagaaacagggcaagtcatggactaagcagggggctaaagccatgattggtttaattgaagcccgaatgaatggtgaactgcaagctagtttaaatataatcctagaacaattaacagttcttcctcgagtggctcaaaccagcctattacaggaaatgcatattcgaactggagagtttctaagaaaggcaccgacaaagccgtcaattggagcagtacaaggaataattccgattaacacggccacaagtagaccaatgggacaactttttaaggcactaacccactaaaactgtatatttaaaggctacctatgaaaacttgacagataccttgattgatattctctttacgctttacaatttttttgttacaataatatagttgaaatggagacatactcaagtggctgaagaggacggtttcgaaaaccgttaggcgtgtaaaagcgtgcaggggttcaaatccccttgtctccttagataattaatcagaatgttaaagggttgttcaaattgctttatatagcggtttaacagccctttaatttatcacaacatttcaacatatatcactttttgttctcaaaatgttctcaatatcttctggctggcaagatacatatctacttatttaaatacatattccaatcgtcacaatttacgtggcgttttttatttatcatcacaaaaaaagttttctcgatttctggaaacactacccttggtttaattccttctctaacaaaataagatgatcaattacccgtctagtgatttttcatttcgtttgagagcaaaaaaagccggactaattaaagcccgactaaggaaaatatggatatttattctaccaaattaaaaataagaaagccattaaagactttaacccacactctacaaggtatgccatgttgtggacattgagtgccaaccaaacaataacattagtcagtccacacatcaaagaagccgttgtattcttgtccgtcacgactttatacttcctatcgcttaactaagcgacaagaaaacggttatactttatttccatataaccatcccctttccaattgaataaagctttctactatggtgactttgatagctatattctggaaggagtttacaaggcttgaaagaaaataaatactgtaatgctggctgtattgctccaaacacttaatgttcacgggaagttttactcacttcccgctattaattataccatacattttaggtatataacgcatcaatctatactagttatctatacaagcgcccgcaattgttgaatcatgcttaacacttggtaaggggtatttgacatgtcaatacctctattttgataccaaaattgcgccaacatctgaacagcgaacgtatattgttcatactgggttaagtctgctgtggggtttacagcgttttgtacataagccttagcgttctttagataatccttgattaattggtcttcttcttcaccgtcaagatataaggcttgcttaaagttgtctacttcccactgctctacatcaaatttcattaatttcaccttcttttagaacacatctaggtctaactttttagcaacatctactataaattgatcacgtaacttgtacgcttttgtagtgctacaccatatatcgccagttgctactaggttctttatcgtcttatgattagggttaaaatagcattctttaattatcttctgggtacagtccccagcgtcttgtaatgctaagtcaatagcttctttctcacgttttaagcggtgcatatatctatcttggtcaatggttattaacatatcatcgtaataagtccatggtcgattgatagcacgtccaccacctacattttcatctcttttgcggatagggtgcattagttcaaacttacggctttttagtttcttattaattgaaggataatctttcagtattactattactagactttttacttcttttcgcattaatacacctcataaaaaaagagtgggcgatattgcccaccctgtgctagtagctattatttactttcggtcgccttagttgtggttaaagagagattaaaagcagcgtcattactaattggttggtagtcattacggacgataacagataaaccttgactgtaactgtcgaacttgtcccattgggctgtaacttgattacgccggaatactgctaccgcttctgaaatatcacctaaaatcattggatgtgaaccgtctgtgttatctggtaagaacttattactaatcttaacaacgggttggccaagtaaagaaaatccactaggagcggttacatctggttgtaataagtaacgtccttcattgtctttcaaagtatctaatacttggaaagctgattgatttactaaccatgtagaagtactttgtaaggctgggtcaaggtcaacgttgaatacttgcttcaagtcgtcaacattagctacggttttcttagtaaagttatcgccttgtaataccttgataatttcagcgttatcagtgttatcaactaacttttgaagttggttctttacttcagatacaatatcaacttctgaatcgtcaacaacttcatttgatagtgcaatcttaccggcacgggtctttacatcaaacttcacatcttcaaacatattagcgtctacatcagcaatttctgcttgttcttccttagtagtaagtaccgctgtgttgtaacgggtagcgattggataatgaccggaaccagtccctacagtctttacagtagcgtactttgctaagttataagcactgttctttaagtctaggactggagtaacaacttcttctggaataacggcttctgcccccttagttgttaatccgtcacgggtttcaccacgtgaacgaatgaagctttcaaaggcgttagctggttgttctgtattgtttttggggtctaagattgtgtgttgcattttattatgttcctcactttcgataaattggttgtaactacgaatgcttgttttatctacatcaacatttgtctgatcatatgaaggcactgtaacggttgaaacctcaaataaatctttaatctgattaacggtgcgtgtaatttgtccgttgtcgtcacgtgtccaactgtcagaaccatcatcaacatcaaaacggaaagacatagaattaatgttcccattcttaacattattaagagtgtcacttgcgtaacttacacttgggtcaatagttgccttgaagtgaagccccttatcgtccacatcaagttgtaatgaaccagccttaacgcttgctagtggcttagtgtagtcgtgttgatcaagcataactacattggataggtctacgttatcaagggcgctagggtcaatcacttcaacaaaaccgcctaagtccttgctgggttgattaaagagtaacgcatagccttcaactgtattaggctgtgaggcttgcgtttcatcttggttatcttgctggtcttttgttgggtcttctttagggcttaccgtttgtaaacctgcgttagttgttagtcgtttctccattggctgtaactcctccttctttttcaataaaattatctccattagttaccggcactaaattaagtaaggctcgggcttcattgcgtgtgtagataccgttaacataaccatcaactgccatctgctgttgagcggacgggtcaaggcttaatagcttgctattatcaaagctaaaatcttgccctagcttgtagttcaattcagaagtaaagcaatcttcatagtgctgtaaagtaccttgtaaatactgaacgttactttgttgttggttgctatgctcgttttctacacctaaacgctcgggtggtagtccgaacgctttcgcaatttgacgggtattccagtcattagaatttactagctttaacacgtctgtattaagtggtaggcttttaacgtccataccatcatcagtaacaattgtgttaagtgaattattgccggtagttgcctcatcaaattgttttctaatgttctctttaccatccgaactaagatcagcttggtggacttggacaactgttgtgccatgaattccattattaaagaatccagtcattaacctgtttccagccgcctgtatcttcatttcatcttttagcgcatacagtggcgatagtccgactaaaccatcacgggtaaaatacttaaaatgtaagatgttagaagaggcaattactcgcttaatacgtccatctgggctgtatgtgtaagtcagcttttgcgttacatcatcttgctggacagttaatttattgttaggaataaaatttagcgtgtgtgaacttaaatcaatttcggcaaacgcattaccatttaatagcatttcaaccgctagggcgtacttgaaacttctgccgtccattaactcgttaggatgatcattaatcatcttgttatataggctagaactagacttaatcggattactggcaagatcaccagcgatagaactaattgcagcaaatatatcactattacgtaaagccgaagcactaacgtaactattagggtcattactagaaagacttactagagcgtctagaaaggggtcttgtgcgcttgtagtcgttgttctcttactaaataggcccattatctaccctcctttacttgtgattatcagaatagttaatcatgaaagctagaacaatcatttcaataccaagaaagccaatcccaaacaaccaaccggttaatcctatagcactgatctccattagaacgcctccggtgatcaacaaaaccggtttaatatagctagaaaagatttttagcagtttcatagtattcatttgtacgttcttgctcctttctcttagtgaagtaatcataaccagccgcccaagcatccataagagcagcaaggcaatctattttattttgctttctagtcttgtctaataacgcttgaccattaaagttatatttcaatattgcatttcctacgttgtaagctaacatctgattgttagtgtgaagaatgttaccagcaattaattcttccttaaaagtcccaattggtaccgataaattcttataggattgtgttaattgaagttgtggtagtcctgcccgttcaaaacgattaacaagatcagcccatttataagggtcaaatactaagaatttaacatttagattatacttaccgattaggtccatcacgaaatcatatacggaatcataatcaatcaagccactttctaatgaactgattgaacattctccacgtttagcagccatttcataatcaattccatcacgttttgatttagtaacaattccaccataacgagatacaaaggcgtgggaatcagcgtaaaactttccatcttctaacggaactaaccaactaatcgccgttaaatctcggctttttgatagatcagcaccaatataaacatctctattactaatatctggagctttttcaatcaatccatgttcccaatcttgcgtactaatatatgaattttcattctgctgtacaaacatattcatattctttacaagtacgttattaatattattttgttttgtggctacatctaaatcattttgaatgtgttccctcattgtcttagcaatcttaggattactcatcaaaggattagctttaatccacattgtggggtcgaatatttcttcttttttatcaagacaatacataaccgcaaagtaacgatcattcttaattttgccgttgagtatatcggctgcatagtcccattcatttttgaagggtgaattaagattaaaaccagcagtagaaataatcgctagaataccattgtcttgttgagccatacctgaattcaaggcgtttagaatagtgttatctttagcttggtgatattcatcgactacgcccagtgtcgggttataaccgtccgtactgtgggtatcagtagatagtggaattgcgaagctacctgtctttttgtcagtcacccgttgtttattgattttcactcgttgccttaaatactttgaattacgccgtaagttttctagttggtcactcataatatcaaacgcaaggtgtgcctgctgggaactgttagcagtaaatagtatttgtcgattacgggctggttgcttttccataagaagagacacaacgccaatcgctgccagtaagaagctctttccatttttacgggcttcacttaatagaatccgattgaagcgcaatgaattatcgtctacctgtcgccaaccatagatattagataagataaacacttcaaatggctctagcttcaatggttcaccgtttgtttgtggtaagctctcaacaaatttaataaccttaccagcatacgtttcagaataataataaggaaagtcatcggtcttttgctttttcatgtcgtctaagaagcgctggcaagcatgaataactaacttaccggcgattaactcacctttaacaactgaattagcatactgaatagctctatccattatgacaacatctcttcaaactcatcagtaggagcttcttcactcattgccttgtggacttctaggcgtacccgtgattgtgggctaagtgccatttgactatcaattgacttcatttctttaatagccttatcacgtgccatgtagtaaggtgactgctgtaatcctcgttttgtatcaataactaccccagtacgatcaatctctttagtacatttgataattgttgaatacaaagtacagtgagtagcgattaaactaacatctagttcgctaataggggcactcttctttaagagtgggacaattctacgccattccttttttgctacatcatcaagccatttaggggcgtgagatgttaagtttgggtattctgccaatgctttttcagcgtcttcacgttgtgctttttctgccttagtaatatgaccttctggacgggtcttcattggttgagccaactatttaacctccttctatttatttggtgacaccatgtcactatttgtttaaaaaaataaaaaaaacatcatttcatattcaattatcgtattatttaacccttattataccatatttgaatagtttgttaagttcaatgcctaaaagttataataaaaaatccttgacatttgaggctctaaattatttaataaagttgaaaagaaaaccatacaaaataaaaagaaacgtcttgaaatcttcggattttaaggcgtttttttgtaaagggagaatttttttaaaagaaacccccaccattacggctcctaccggtctataccaatagcgggggtattaaaattatttcagctattcatatttattttcctttctcgttgatgatcttttcttgtcttttctcggtgacaacgatagcaaagtgattgtagattagttgaatccaatcttttactccaatcttcacgtataggtacaatgtggtcaactaaatcagctttttttactattccctttcgtaaacacataacacaaactgggcttttctggagcgtttgacggcttaatttaacccacttactcgttttgtagaatctattatagtcatgaggagctttggcgcttctttccattcgctttttgtatacttttctattgtattcatgtttctgttctttggtcatctttttatagttatctcgttgccaatgtttacgcttgtcttcatattctttttgtagatattgatgttttttacaaaaatattgacctactggaatcacctctcgacaaccagcagcactacaaaaccttactacactcatttgataacctcctatgaaaaaagggcatcgcataacacgacacccttagcacttacttattaattaattccattgccttactatatgcttcaagcctgcttatgtgccagcttttaacatcgttaaccgttctcttaatgcaagcttcaagctccattgtatcggcgctgtaagggtcacactcgcttagtctataccttgccatcatcacccagtcttggcgactttcctctgcgtccttgcatactgccacttgtgcaatacactttactagctcttggttgtctggtagtcctagatcaatcgctaatggtaatggactgccatttactgagactaattttaaactataaagcgtagtatacatatgataattagaaggatcatcaccgcttgcctcaatcattacattaataaagttgttatactctgggtgcgtgttgactgttaatttactcatccccatttcacctcttatttatgactatcaagcttgcgtaaggttacaatatcatacgccaataactcatcatcaattgaccaaccagcaactttatagatactgccattgtattgtgcttctggatatttcttcatgtccgttaaatctttcttgtgacgaactaccaatataacatcatcagtaattgaactacctgcctcactaatagcttgactagcactgattgaatagttaccacaatgtactgtcacatctcctacaaaacctgtcatgatcataccagtattcgggttacgtttccccgtaccaccttcatgaccgaatgtgaccttatgctttaatcgtgtaattgcgtatttattacttcgcatttaattattcctttctgcctgtacttgcagatacaagcaatagtagaacgtttgcagccgttctagtgaaatctactgttactttatttttaactccttaataggcttttcacctatccggtggtatgtggtcactgcctcaaaataaaagtacggtaaaagcagttttaattgttaattttcatctcttcaattgaaaatagtttttacttttatcggttaccccgtttcaagtacccacaatcgcctttatatcaacatttatatggtaaccgataggatataaaggtaaccgatacattgcagttacttaatatagtaacccgaaactatcggttacctcaaaatgctttcggttacctttaaatagctttatatcaagctttataagaacttctgcaaaggtaaccgataaatataaaactataactaatttttaagagcaattcctttataacctttaacatttttaccgttaatcttaactgtagtgtgtttgtatcctcgtgctattagctctttcgcaaacttacgattactaagacaaggaacagcagtatttttacaatactctttgtaattatcatatagatatactgatttttctttatctttctcatttgtagtacagcaatcattaatccaattaccgatattgtcattagcatttacccagcttcgcttttgctgttccatgtattcagtcactggaaacttaccagaatcaagtgcttttttataagattttaagcattcataggcaaatgctggcatttctcttttaaagtcttgctctttgaattgctctttaaaatgtttaatcttatggaacgttacaataattggtcgtcttttaaatccgtctgtaaaatcattgaaggctggtaaatcattagcgctaaaaatcaatttagcttcattttcaagtttaaatggatctttatatttaaattgagctgttgtagtgtcgtcaccagttaatgttttaataatattagtctgttccataaatttggggcttatatcagcaaaaacattagcagctttatgatacagctgagaagtagcaaatttagcttctttttggtcggataatgcttctaaagaaacgtttgaaacgttaggcttccctattaactccattagtttatttagaaatgtagatttaccatccccacccaacccgtatagaatcatataaatttgaaagtccttaaaactacctgctaaagcaaaaccaataaaggcttttactgtttcaattgctgttaggtcatattcatcttgtagttttccagtatcatcacggatttctttagttgagggtactaatgattgttttaaccatttattccacgttgtagcttttccttttgtttctaattcatatggtctattttgtaaaagatagttctctggtgaattatcttctaaagtgtccgtcatcaagttgtaagtgtgtttaccaaacactgctttataaggtgctggttgatcaaatggattgtcttctacaatttcttgtgaatctaaggcaattaatttagaaaccgatgctaataagttcgttctccatattccatgaggtacaatttcatttttgattgatttttcaatgactgaatcagcgtaatttttccattgtctacttttaggatcgaaccaatagccgtgttctataaattggttggatgtaaagtgatactttttttctaaatatttagccaacttaatttcatcaaccagtttatttcctttatcacttacagttaaccattctggaaaactattgttatttactaagtcatcaatattagccatatttttcctctctttacatggtaatttagcgtttgtatttaagactgataatctctacttcgccttttgttttgatatattcaaagcttttcccgtctaaacttgtttcttcgtatatattgtcccaatcgactattgattgatcttcgttttgactagcattattccaatacttaaagagtggtgtacggtgcagtattcggttaacttgtttaacgtcatcccctgtgtagtagagaagataaaaacacattgcaccaatagcaggtttaacgctatgatatttatttaggtagtaggaaattatttcctcattatttttataaagagcaataaattttctactacttttactactaacagctcgttctataaccttgtaatcatcgttatagtattcaagtgctttctgaaactgtttctttgcgtactcattaaggggatgtgacgttgaattaataattttttccatcttgtcactatctaataaaggattaacggatagtttttcttcaaaacttaacactattaatcacgtcccacctattgcaattgatcatgaatttgatctaacttatccaacaaaatactagatagtgctaacaatgctttcttacgtgatactactgtttgagcaaccgtagacacttgttcatcactcattgctgcataattgtctactcgtacaattggagcaaaaacatcatttaactgatcatacagtgcttgggctattccggttgtttcttcaacattggaatctgcttcccacaactgattttcaaacgctagttcttggttcttatctttttccattgtttaaaccctccactcatgttagaatgaaagagaattaaatattagtaattcgtccaacatcccccgtaaagattgttggcttttttattagctaaatttaattctctaagttttatttagtcgttgttagtgtctgaattggcgttctcactatcaacggcttttttattaccatccataaagtcgttttcaaaatcagttaaagttttatattgaattgctaaatctttaatttctttagcgaccttaataatttcatctgctgaggaaatcggatcatctgcaattatttctccattttctttagtgatagtaccttcaaaacaatcttcagtaattgaatttatataactgccagctttaacaatcctgtcttctatatcaataattcttttacttaatatttcttattcaaattttttagtgtataaactcatttcttattactccttaaaataagttactaattgcaacaacaatacccagcaatggtaaaaacgttgctagataagcccaaaggcgttggtctggtgaagtccaccagtaagctaaaatcttaccatcaattttttgtaacatatgtctcacctcctcctatttatttctctacaatcacttgccagccagctgtgcgattattacttagaattttcttttacccaacggtcaacatcttcacgtttatatacatattttcctccaacctttgatgatggaaaatttcgggtcttaatccaacgatcaatagttgttcgagaaacacttagataatccgcagtttggcccttattcataaactctggttcggttttaacagtcttagcatcttgtaacttattgttctctagctttttagccacagcttcagctaactgatcaatgaactgatctaaaatagctgtactcattattatcacctctttatttcatatcgtaattacaatatataacataatgaaatattatgcaacaacaaaataaaatatattgtgttttgtattgttattttcggttatgtataatatattaactatacaaggaggaattaatgtgaaagaaatttcatctgaccagaaaataggttctaacattgcactaattcgtaaagctaaaaagatgactcaaaaagacttagcaagaaaaattggaatatcacaaccagccttggggaattatgaacgtggccagcggattatacctgcttcgatttttcacagtttacctcaaatattagatgttcctctagattttctagtctatggaattcccaacaatattacctttcatgatttagcaacgctcgattccgtatctctcaaaaagaaagctgctcatattgaaaatgatagaagtattattgaacgtgggttagggcgtgacgacataaaaagacatttattagctgctgttttgcttgataattatggttatcttgtgtacccagatgaatctagcaatgacaaagaacatgaacaacttaaaaaatttgtttggaatacattagatggattacttaccggcgtaccaattaccaatgaaataaattttaaacaaattaatgaacaatttgaattacttgcaaatacgtatttaagcctaattattgacgaagaggcaaatcgctatcctgctttccgcaaggatttaccacccttcaaagaaaaacttacacagtttttaaatgataacggatattttaaaattttaaaaaaataattttaaacctttctctacaatctcttgccagccagctgtgcgattgtaggaggaaagtaaaaatgtcagtatacaaggataaaagaaatggtacgtggtatgttaaataccgcattaatggtaaatcaaccagtaagcgaggtttcaaattaaaatcggacgctgtagcgtgggaacaagaaaaagctgtggagcttaaaaaatatggtcaaatgaataaccataacatgaccgttgaagagctatcaaaaaaatggttgccagtatatgaacagactgggatagaaaattctactattcataaaacaaaacaaatcattaaaaatcatattctaccccgcattggaaactataaagttgctgatcttagcattgagttattaactgaagttgctgctaaatggaaagaagaattagtaaagagtgacccttttaactatactaagcgaatgttagactacgcagtacaattaagagcgatcccaactaatccaatgaattctgtagtaaagcctcgtaaaaaacatgacaaaacatttactaacaataatttctttaatgaaaagcaacttcacaattttatcaagtgtataaaaaaagactacgaagaaaaaaatcctcgtgctttcatggttctatggttagccctttttactggcatgagaaaacaagaacttcaagccttgacgtggcaagatgttaaatttacaaaaagcggtggaataatccatattaacaaggctattaagaacgcaaaacatccctatcttggtggccctaaaaccgctaactcttatcgctggatttcaatagataaaaaaactgcttcctatctaaaaagatggaaacagcaacagatagatattttaactaaactaggttttaatccacaccaaaaagagcaattgattttctctacctacactaaaaataaaattgttttaggtgcagaattggacaagccgttaaataaagtaattgttagaaataatctaaagaaagttacattccatggattacgtcatacccatgctacacatttggcttctattggtacccagccaaaattaatagcagatagattaggcgatacaatggaaactgttcttgaagtttatattaatgcagatactgaaccagaacaaggaatcgccgacaagttcgccgatagtttagtataatgttctcaaaatgttctcaaatttcaattaaatatttttaaaaccctttaatatcaaggattataggagaatttttcaaattattagaagtccccttgtctcctttatctaaagttttgctgatattcaatcgttgttaaaacgttgatatatcagcttttttattacacaaaaaaggacacctattaagtgccccaatctgtcttgaactaatcttaggttatttagttttattgattagcaatatcgtatgtagttttgccatctttggccgtatacaacgcctgactagaatcacttggattcataatactaattgaatatccttcacctaatgctttttctacttgccctgaattgcttttaatcgacttagttaagttaggccagcccatttgttcagcctgacttggatcttgcgctaaagctttcaatgcttcaaccgtattatcatcagttggcgtgatctggaatgtcttactatcttcgttataatcaactgaacctaattttgaataacccttttgcatttgacgcaaaacagccattgtcttactttcttgttgcgcttcatttgcacttgaattgccaatcgctaatccatttgaaaatgatgaaaaactactggaccgcgccacttgtgaagatgaagtactttggcttgagctagcagaattattatgatgaaaataaggtaaattaatcacaccataaacaattgcgataatactcaatactacaataattgtcccgcttttccattcgcgatactgttgccatgaattagcaagataaaaaccacccaaaatcaaaaataaggctcccattattactaagaaaatcataaattaactggctcctttttatcaacgtaatgttattgtcccgcattcattttatatatacaactataatttaaaaagaaaaaaggctagtatccccagcctcctcctaattaaaattccattaatgccttcatatcgtaatctttaagcttatcgcgaccatgaagatcttttaattcgattaagaatgcacagccaacaacaataccacccatttgttcaaccatatcaattgttgcagagattgttccacctgtagctaagagatcatccacaacaagaacccgttgtcccggtttaattgcatcggcttccatttgcaaggtagctgttccgtattctaagtcataagatgcactaattgcttttcttggcaacttaccctttttacgtgctggagcaaatccaacacccagttcgcgagcaataggacacccaacaataaaacctcgcgcttctggtcctactaccatatctacctttttatccttagcataatcaactaattcgtcagtagcttgcttaaaggcagccccatcagccattaatggcaaaatatctcgaaagataatacccttttctggataatcaggaacactagctacgtatttataaaggtctaaagccatgagataaatagtctccttattctaaatttaaatatttcaataaccagttagcaaccgttgcagcatcattgaaaagcaactgttgttcaactttatattgtgctaattgtttttgataacgtttagtttgcgttaaatcagtcttattagttgactcattaaactttaacacatcatcttttattgtaacaaatcctgcttcagaaaacacttgaatcattagatttaatcgatccatattaatctttaaatgattgctaactgctttagcttgcatgggccattttaattctttttgcttataaataaatcgataaagctgtgcaaaatcattccgtgttggcagtccagctaaataggcactttttcgctgatacagtaataagcgaatagttgctggttcttcttcatcctctgcaaaaatccgttttagcatttcttcactagatgggcagtcaaccagcgttacttgttgaccagaaaaatcagtcttaattgcttcttcgatcgataaagtatagccaggagccacatggggagcaatattttctcgcaatcttggctctcttacaatgtaataatctgaagaactaaaaagctgaggagttagtttattcgttcgttcatcaataattaccgttccattaatttggagatcttctaacatcagttggacactttttttaccacgccactcattaagactaactttaacggctaaattaatttgtccggttggcgcggataatagtgttgccaaatttccttgaccaaaagcaacgactgttagattttttttatcacttacaatcgaaaattttaaatgctggtgttcctgtcccattgttttgacatcgacaactttaacgttatttaattcaaaaaccggttccatatttcctggaccaaatggagcaacccgttgaatatcgttatataactgttgggtaacatcagctggtacaagtttcattgcgattggaagaggttgctttaccgttggatcaaatttttgtttgactgcttcttcttccaaggctatttgcagaggtacaatatttttctgatcaaaagaaagaccacaagcagcagggtgcccaccaaatgttgtaaatagttcacgatgagcctccaaggcattgaacaaattaaaactgtcaacgcttctaccagatccttttattaaggtcggattattttgatcagttgatgcgacaattgttggctttccggtctcattcataatccggctggcaacaattcctaatacaccttgatgccaaccttttccaacaattaataaggtctttttctgctggttagctgaactattagcttgttcttctgcctctttcataatatcagcaactaggttctgacgttctttattcgcctgatcgacctctttagctaatttttgtgattcattctcatctaaactcgtcagcagcttaactccatcattagcatcagcaattcggccaagcgcatttagccgtggtgcaattccaaatccaatatcctgatcagttagattgttagctttaatatcagctaatttcattaaagccgctaatcctggacgcatcccctgtcgtaattgctgaatgccataggaaattaacgcatgattttcgtccataacgtttactacatcagctatttcaccaattgcaactaagtccagttcttcaacaggaaactcaccagttaaagcccaggccaccttaaatgcaacaccaacgcctgacaaatcaggaaaaggataattactaccaggatagcgagggtgaacgatcgcaacagcattaggcaagtcagcaggcaactcatggtggtcagtaattacaacatctactcctgcttccattaccttatcgataacattttttccgctaacgccattatccaccgtaataaaaagctgggtaccattgtcaataaggcgttggtaagcgtccatgttaggcccatatccatctgtaaaccgatttgggacataataattaacattggcaccgatagataataacgtttcatacattaaggatgtgctagtaattccatcggcatcataatcaccataaatagtaatttgttcttgcttttcaactgcctgctcaattcgctcaactgctttatccatatcatgcaataaggttggatcatggatctcttctatcgatggttcaaagaatttttttgcttgttcggttgaatcgattccttgctgagctaataaggttgccaatattctagaaatgcctaactctttttcaagattatcaacagttgctgaggaagcattatcggcaagttcccacttaaattttgcatcaatcatttaaaattaaccaccatttcaacgccaaaattaaacaagaggctgggataaactcagtctcttttattttgcccctttcattttttgaaaagactattaaattctgtaatctctcgaaaataagggagcatattataagttcttcttatcctgttggaaatcaaaaaattttttaattgcccagtcacctaaaccgggaataacttggtaagcccagccaagacaagccacatatcctggaacattaatttccctcgtcttatacccaacattattccaaattcgtcgagctaagtcttcaggagagataaatatccattttggtaaatgggcccgatacgtataattattatccgctttatcaaagaaaggtgtatcaattgggccaggattaattgtcaacacttggacaccataatcagcaacttccattcgtaaaacgttatcaaactggattaccccagccttcgttgctgaatatacagcgctatttggtgtaggtaatttaccagctaatgaacccatattaataatggccccatacccttgatccatcatttgtttagctacacaccgactaatatacattaaggctaagaggttcgtatgtaccattttttccattgagctgtaagattccttaactacgggaataaagtcaccaagcccagcagaattaattaatacatcgattcctcctacttcatgttgaaccttcgaaagcacatcatcaatctgatcagggtcggtgacatccaattgataagcaaatgctggccgaccagataaaattaaacatttcttggctacctcttgcaatttctcaaggttacgagaaacaacaacaacaattgcaccacgacgagctgcctcaaaagccaactctttgccgattccacttgaaccaccagtaattaatacaacttcatttcgcagaaaacgtaacgtctttactcttctcagcattttttgccatctcttttcattttttaaacggaatatcaatcacatcaaaatcattaacaactcgagtatcaggaataatattacgaacttgatatgccaattgataggctgctttaccggtgtatcgtgctgaaatatgatttaacaataattttttaacaccagctttttttgcaatttcagctgcttgtttgctggttgaatgataataattgtatgccatcttcgtctcatctttagcaaaagtactttcatgcactaatacatccgcattttgtgctaacaaaattgcattctttgtttgtctagtatcgcctaaaattgcaataattcgtccaggttgaggagtgccaataaagtcatgaccatctaatacgcgaccatcaggaagagtaaccgtttttccagcttttagttgaccgtaaattggcccagatggtactttttgttctcgtaatttttcaacttgtaattctcctggatgatccgcttcttcaatccggtatccaaaacaagcaattttgtgatccaactttcgtgcaatcactctaaaaccatgatcattaaatagttccccgtcatctgttatttcaacaaaatgcaaaggataactgaggcgtgactcacttacttgcaaagaagtctgaacataccgctttattcctattggtccatagatcgtcaatggttcggttcctccttgaaaagagcgggaacttagtaaaccaggtaaaccaaagatatgatcaccatgcaagtgagtaataaagattttttctatctttcgtggcctaattgtcgtattgagaatttgatgttgagtagcttctccaacatcaaataaccaaattgcgtttcgttcttctaacaaccgcaatgcaacacttgctacattacgttgcttacttggggaaccagcgcctgttcctaaaaattcaagttgcatttatatttttcctacctttgctacgtataattttattgaataaattcaaaaacaaatttttcaattcttacaagatcaccatcttgtacacctttagctcttaacgcgtcatcaacccccatatggcgaagttgacgagcaaagcgtaattgactttcttcatgagttaaatcagtcatcttaaataaccgaataagtttttcaccgcccaatacccaggtgccgtcttcatccttggtaatggtaaagtccgtctcatccttcttgtcaggagcagcagcacgatattcagcgaccaattctttatcatgactctcactatcaaatgcgggtgtcttatctaagagatcagccgttaattgcattaattgttggacaccttgatgagtaaccgctgaaatagggaaaatctctggctgcttttctaaagtcttatctgctgccaaatcagctttaaaagcagctaagttatcggcagaatttggcaaatccatctttgtcgcaactacaatttgtggtcgctttaataattcaggatcgtaattagcaagttccttattaatttgccggtaacgttcaattgcttgatgaggatcttcactactcatatccactaggtgaagaagaacgcgggtacgttcaatgtgccgtaagaacttcaatccaagaccgatacccttcgatgctccttcaattaaaccaggcatgtcagccatcgcaaaatcacggccatctggtagcattaccattccgagattaggagttaatgtcgtaaattcatatgcagcaattttaggcttagcaccggttactactgataataaagttgactttccaacagaagggaacccaattaatccgacatcagcaagcatctttaattctaattctaagtaatggtcttctcctggttcaccattttcagcaatttcaggagcagggtttttagcactagcaaagtgaatgttgccgcgaccaccacggccacctttagccactactaattcttggtctttttcaacaagatcaccaataatctcgccggtatcaaggtccctaacggtagtaccttggggaacagcaataattgtatcttctgcacttggaccagtcatctgtttactcattccattaccaccgtttttagctttaaaaattcgatgataacggaaatccattaaagtccgtaatccttcatcaacttttaaaatgatgctaccaccacggccaccatcaccaccagcggggccaccgttaggaacatacttttcacgacgaaatgctaccattccatcgccacccttacctgcatgtacttcaatttttatttgatcaacaaacatattcataatgattgtctccgttctttagtctattatttagtatatttaaaatttacaagcctgtcaaaactcaatcatgactactacccttagcaacctcagcatttttctgcaatgaaaccttgattaactgggcggtaggtcgattaattcctagtgaatggatttcatcaactgaggcttgagcaattttggtaattgatccatattttttaagcaattttgttcgagttcggggtcccactcccttaatttcatccaaacgcgagcttaacgaatgcttggtatgaacgcgccggtggaaagtaattgcaaaccggtgaacctcatcttgaatgcgttgaactaagtaaaagccttggctccgtggattcaaattaatatggtgatcatcatccccgaacaataagtcagcggtttggtgtttatcattctttaccatccctactaccggaatatcgagaccaagttcattctctaaaacatctttagccgcatccatctgaatttcgccaccatccataaagatcatatccggcattggcttattctcttttaagagacgcgaatacctccgtcgaataacttcacgggtactggcagcttcgtcagcatgattaatcaccgttttcaatttatacttccggtaaaaatttttagctggttctccattaacaaatacaaccattgcactaacaggatcagccccctgaatatgagaatgatcaaacgcttcaatccggtgaccttctggaagtccaagggcatccgtaatctctttcatcgcaccggtagtcttactttggtccatctcaagcagtcgaaatttttcatctaaagacaactgagcattttcatgtgccattgctaagaggtcccgtttttcaccacgaaccggtgtccgaactggtacccctaatatttcacttatttctttattgggaaggcccttaggaagaagaatttcacgaggcaaaatattattgcgacgattataaaactggagaataaagctagtcatttcttcaactgccgtatccacgattggaaatagacgtttttctcgtttcatcaaccgcgcctgccgaataaagaaaatttgaatagaaagccaccctttatccatatagaaattaaataaatcacgaggggttttatcatttgaaataatcttttgtttttcaactgtcacttcaatatagtgaagctggtctcgaatttcagcagctcgttcaaactccatgttttctgctgctagttgcatctttttggttaactgtcgcttaactgtcgctgtatttccacttaaaaatgacttaatttttttaatttgctcttcatattcgctcttaggaacgtctttaaaacaagctcctaaacattgtcccatatggtaatacaaacacggacggccttgatacccattacatcgtcttaatggataaaccttttgaataaaatgcatcgtctcctccgcagcatagacatttggataagggccaaaataatatccaccatctttttttattttactaacgatcttaatttgaggatcccgctcatttgttatttttatgtagggataaccagttcccttttttaatttgatattgaaataaggttgatgtttttgaataagcgttatttcaagtaagaacgactccttattagtcgaagttacaatggtttcaaagtccgcaacttctgaaaccattttagctactttaccggtgtggctactcttaaagtaagaccgaacccgattttttaaatttttagctttaccaacataaattatctgatcattaatgtttttcatcaggtagcaacctggcttgtcaggtaacaatgctagtttatgttctaaatgttcactggccatcgcaaaatccctccgaaaaattatctaacaatatattatatctgaaaaatcatcattaaggcaaagaaagtgtttagaaataattgtacatttagcaaaatttatgctagcattttgtcaaatataaaaaaggagctaaaaaaatgggattagttactagaagaagcgaacagcttgataaattatttgatcaatttgcggttgatcctaaaaaaccaaaagcaactaaaaaaaatgacgataaaaaagaaaaagatagcaaggataaagaaaagaaataatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactgtgtgcagttcgccagtagcccttgcgggtactagcgaagacatatgcatcacgctgggacagccccagcttctgtaagttagttaccttagttttaagcttcttccattgcttccagatatactgtcttattcgggccctcaaccacttgtcaaggcgttgaataaagtcagttagtttcccaattgagtagtactgaagccatccacgcatttttcgatgaatttcttcaaacattcttgtcagggatattccacgattacgtttagttaataacctcaatgctttctttactcgttgttgcgattgttttgctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttatccaactcatttagatagatattcgccagtattggtgacaatggccctccttgtggggttcctttttcactcttagcgaaaagcccatggtctaagactccgctagttagaaacttacgaatgagccttagtgtccatgggtcatcaatatattgttgaagatacttaatcatcaagtcatgattaacattatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaattccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcgcagtggacacccttgtcctcagctcatggttccgactactacggcccatagcggactctcaccgcctagctaatacccatgccgggcgcacatgcaaaggaggctgggagaaaacttttgttttctcccagcctccactacttttatgaacaatagtaacgtggaactaacttcgcgtcgccacaaggctcgagtctaagtacgaacgataatcagcccgtgccgtgctaatcatcgccctagcttagccaactgctttgtcgagaaggctattttccactctctatttttaatcttgctttttaaaaccagtcggatagcgctgatttaattcctcaatatttgctttggcaacctcttcaaatggaatatcggcccattctgcaatttgagataaataccataagacatcacccatttcgtggattagttccttacgatctaattttcgactacgaaaagtatagttttttactaaatcaacgacttgtcctgactcaccagctaatcctaatgcacaatttgttaaaacttgttcattcccatataaggttcgttttgctgcattttggtattcattaaaatccaacttagttcttccccattcgctcttcaatccactgccaaacatcatctttaccccttttctctgtagctgaaaatagaataatcggtgttgaactctcaacatcaagggtctttttgataaggcttagttggcgattccatgcacttcgttttaccttatcaatctttgtccctacgattaatgttggaatattataatattgtaaccaattatacatatttacatcatcaggagtgggttcatgccgtgcatcaactaattgaataactccgcgtaattgttcacgttgggttaagtattgttcgatcatttttccaaatcgttctcgctcttttttcgagactttggcatacccatatcctggaacatcgacaaaatataccttatcctcaacgtcatagaaatttaatgtctgggttttacctggctgactagacgtatgagcaaaattgcgccggttgattaagacatttgtcaacgatgacttcccaacatttgaacgaccaactaaagcaatttctggaatatttgttttaggatattgttcatcacttacggcactgattgttaaatctacattgtgaacttccatttgcttacctcatttcattaagaagctttttcatcctttaaaacgtaacgaggttctgtatgttgcgttacacatcgtttatcaataattaccttttctacatctttacgacttggcaagtcaaacattacatcccgcattacatcttcaataatcgaacggagaccacgagcacctgtatttcgcttgattgctagttgtgccattgctcgtaatgcaccatcagtaaaggtcaacttacttccatcaaggcgaattaactcttgatattgcttaactaatgcattctttggctcagtaaggattcgaacaaggtcatcttcatcaagtttttcaagagcagtcatcacaggtaatcgtccaataaattctggaatcaagccaaacttaagaaggtcttctgggataacatgttgcaaaatatttttatccgtaacctcttcagcttctcgtgagtctgttccaaatccaattgtcttatcaccgagtcgttccttaacaattgtttcgattccatcaaaggctcccccaacaataaagaggatattcttcgtatcaacttggataaattcttgctgtggatgcttacgtcctccctgaggtggtacattagcaattgttccttcaagaatctttaaaagagcttgttgaaccccttctccagaaacatcacgcgtaattgatacattttcactcttctttgcgattttatcaatttcatcaatgtaaatgattcctttttcagcacgttctacatcaaagtcagcagcctgaagtaatttaaggataatattttcaacgtcttcaccaacgtatccagcttcagttaaagttgtagcatctgcaattgcaaacggaacatttagaattcgcgcaagtgattgggcaagataggttttcccagaaccagttggaccaattacggcaatgttgctcttttgaagttctgtatcattattatcgccactcatcattgcattaacccgcttatagtggttataaacagcaactgctaatgtttttttagcatcaccttgaccgattacatagtcatccagttcgttaacaatctctcctggagttggcacacggaaagcttttttagcttcatcttctgctagttcctgatcaataatttgtttacaaaggtcaacacattcgttacaaatatagacgccaggaccagcaacaatttttttcacttcatcttgggactttccacaaaatgaacagtgaactgaatccataccagtggtatcttcaaacataaatgaacctcctctaagacttattaaaacataataacaaaattactgtttaatttcgacaaattactcagtaaattattttctactttatcttactaatatttgattaaaatagcgaggctggaagaaaactactgttttcttccagcctcattgattagtaattatttaacaaattacttgtcagacttttcgtcatccttaacttgctttgctgaatcagcaactaagtcaacagccttacggatcttaatatcatgcattaacatgtctttagataatgccttcttaacagcatcttcttccataccgtattgctttgcaaggtcagaaatttctttagcaatttcttcatcagtagcatctaagttagcatcgtcaacaattgcttctaagacaaggttagtctttacacgttgagcagcatcattagcaaattgcttcttcaaatcttcttcctttgtaccagtaatttggaagtacatttgaggactgataccttgttgttgcattcctgctaagtattgttgcatttgacggttagtgtcatcatccaacattgcttgtggaatatcttggatttctgcattagcaacagccttattgatagcagcatcttcaatagcagccttagcttggttatccttttcttcttgaagttgcttcttagtcttttcctttaattcagctaaagtatcaacatcttcgtcaacatccttagcgaaatcatcgtcaagttctggtaattgcttttccttgatttcgtgaatcttaaccttgaaaagtgcatccttgccagcaagattcttagcgtggtaatcttctgggaaggtaacatttacatcaacatcttcatcagcgttgtgaccgattaattgatcttcaaaacctggaataaatgagcctgaacctaattctagtgagtagttttcagctgaaccgccatcaaattcttcaccgtcaacgctacccttgtaatcaataacgacagtgtcgcccttttcggctggcttatcttcttttaatacaagttcagcttgttgttgacgcttagtttcaagtgcatcatcaacatcagcatcagtaacagtggtgtcttgagcaggaacttccatacccttgtattcacctaatttaacttctggcataacgtcaacttcagcagttaatacccatggttgacccttttccatgctcttaatatcaatcttaggttgatctacaggttgaatgttagtttcctttactgcttcgttatatgcatcaggtaataccttgtttaaggcatcttgatacaatgattcttcaccgtacatttggttaaagatttgacgagggacacgacccttccggaagcccggaacagtgatctttttacgagtctcaacgaaagcttcgtcaattcccttgttaatagtgtcgacatcaatttcaaatgtcaatgtacctttgctggcatcgctatcgcgttcccattttgctgacattttatttcctccaataacaaatcaatttgactaattaatatttataactagtctttacatactatattagtttaccgtaggagaccagtaattgcaacttattgacggctgatccccaagttattttcaaatatttttgttaaagaaaaagacttgggtttccccaagcctttcagcacatctgtactcaaaaattagtctaagatgtcggatacaacaccggcaccaacagtgtgtccaccttcacgaatagtgaacttaagacccttttcaagagcaactggcttttgtaagttaacagtgaacgtaacgttatcaccaggcataaccatttctacaccatctggtaattcgatagtaccagtaacatcagttgtgtggaagtagaattgtggacggtagtttgagaagaatggagtgtgacgtcccccttcttccttagtcataacgtaaacttcacccttgaagttcttgtgagtttggattgaacctggttcagccaaaacttgaccacgttggatttggtcgtgtgaaataccacgaagaagtacaccaacgttatccccggcttcaccaagatcaagagtcttgtggaacatttccaaaccagtaacagttgacttaagaacgtcttcagttaaaccaacgatttcaacttcgtcaccgaccttaacagtaccacggtcaatacgaccagaagcaacagtaccacgaccagtgatagtaaatacgtcttcgacaggcatcatgaatggcttgtcagtaggacgctttggagttgggatgtagtcatcaataacatccatcaagtgaaggataactttttcttgttctgggtcaccttcaagtgccttaagagcagatccacgaacaactggaacatcgtcaccagggaaatcgtattcgctaagtaagtcacgaacttccatttcaactaagtcaactaattcatcatcgtcaactaagtcagtcttgttcaagaatacaacgatatattgaacaccaacctgacgagcaagaagaatgtgttcacgagtttgtggcataggaccatcagtagcagcaacaacaaggatagcaccatccatttgtgcagcaccagtgatcatgttcttaacgtagtcagcgtgtccaggggcatcgatgtgtgcatagtgacgcttttcagtttcgtattcaacgtgggcagtgttgatagtgataccacgttccttttcttctggagcagcatcaatatcagcgtaatcttctgcctttgctaaacctttggctgccaatacctttgtaatagcagcagttaaagtagtcttcccgtggtcaacgtggccaatagtaccaatgttaacgtggggttttgtacgttcataatgttctttttcagccattaatgaaaacctcctgataatttacaagtataatgccagatcatctgattcggtgactgacatacctttatacatattgtacaacttcttttcgccaattgaaagctttaatcttaggctctgaagaagaattcttaaatataatatcaactatctgttcatttgtaaatgtatttgactaatgtttttctattaattcgtcaatctgcttacctagtcgttcctgccacgtactagaaaccgtatttgttgcgactttctttccttctattctagcgattaaaacatctgtccattcatcaatatctttaataatttgattaattcgcggatataagaacattacctgtaattgaaattcttgaattgccatcttttctgtctgcgggttttgatttccacacttttctgtaattaatctcttaccttcactaacgactggcaataaatttaaaggctgaatatcagctggcacaactgtatattctctcttatctagccaataaacagtaaccggatctgcaacttgtaacttactaagcagctcaaccaaactagactttaccagtggatgagtgtagggatcacgaagcaggaatttagcgcctgtaataaattcatttaaaggaagtttaaaagccgcctgcagcctactttgctgctcttcaagggagtaatctcctaaatgataaaagtctcgcaaacgtgtttgtaatgtctcctggtactcttgacgagatttttcctcccccattgtaacaattgtcagcaaatcttcctgccattgcgaaagactactaatcatctgtcttgctaaaacaaataattcattttgacacaaaattttaatggcaatttgagcatctgccaagctatcaaacattacttctaaatactcaaacaagtaagtacaagccctggtatattgttgagaatgatacagagcgattatcgtcaatcgaccgatttctgaatcatcaacctcgtttataagatcttccagaatattactagcttcttgccatttttcttcagcaattaatttttgagcctggagatattgatcttgttggggttcgttcatttttatcacccttttttatttcattactttatacaattgttcataaaagcagttgaggctgggagaaaaacgaaagttttctcccagcctcccttcacattacttatattaaacagctacttcttttcttttgccattcgttttttaccacgaccacgatgatgctctttcgttgaacgtgacttcgcagatttctcttctttcttctcaacattgtttttaatcttcttttgatgttgattaatctccataataactggcaaaataactggatgccgtttagtttgatcaaacaagaatcggtttaatttatcgcgaacatcttgtttcaagtgactccaatcaaattccttttgatctagattttcttgaacaatcttttcaactaagtcagcactctgttgcattagttgacggttagtctttacaaacacgaatcctcgtgacgtaatttgtggtcgagcaacgatctttttctttttccgatcaatagttgccaccacaacaaaaatcccatcctctgacaggacgcgccgatctcgtaaaacaatattaccgatatcaccgacacctgttccgtcaatcatagtattacttacatcaatatgttctccaacatggaatttaccatttttgtaagtcagaacatcacccttattaacgaggaagatattttcttttggaactcctacttcttctgctaattccgcatgacgatctaacagacggtattcaccttgaattggaatgaagaacttgggtttcatgaaattcaacattaattgttcatcattttggttagcatgtccagaaggattcaaatcatcagaaataaatttaacctctgctcccgtacgataaatcatatcttttgtcttttgtacctcagtctcctgcgcataagaaggagtagtagtaacaaagacaagatctgtactcgttaattgtaaattaggattatcgccgtttgcaatttgctgtaatgacttaatcggttcacccattttaccagtttctaaaataacaacttggtttggttcgagtttttctgcttccttgcgactaataaataagtcatctggtaagtgtaactttcccaaagacattgctgtatcaataatttgttcaatgtcttttccagataaaacaatcttccggccaacggctacagcagcattgataatctgctgtacacgcataatatttgaagctacactagcaacaataatccgaccgttttgatatttaaaagtttctttaatatagtctccaatatcttgttcacgagcagacgcacccgtaattccggccccagcagaatcacttaaaagtgctaatacaccttgtgatccaatttccgctaaacgagcaaggtctgtttgataaccctttttagctgtctgatcgaatttaaaatcaccagtgtaaacaatatttcctgctttagtttctaaaacaacccctaaagtttcaggaatagtatgggtcgtctggaagaatgaaactgtaacatcattaaaatcaattgctgttgacgcatcaacaacatgaaaatcattaaacttcttaacttccttatggtttttaactgccagctttgctaaggcaatcgtcatctcgcttccaaataccggaacattaaagtccatcaagaaatacgggagtgctccaattgaatctgcatgtccgtgtgttaagaataccccgactatcttgttcttatgttcacgaagatattcccagtcaggaatgacaacatcaattcccattaattcattctcaggatactttaaccccgtatccaaaattaaaatttggtcttcaatctcaacggcgtacatatttttaccattttcgcgtacaccaccaaaaggaataattttaatattattatccattgatttggctcctttaatatttagttttgaaccccttatcgattacaatatgtagcgataagaattttatatcgttcattatagttataaatatcttaccacaatcagtgaaaataatggagtaaaaacaaaaaacaccttgcctccaagtagaaggcaaagtgctttgataataaaatattaccgacgtaaacctaacttttggataagttcacggtaagcaggtaaatcagtccgacgtaagtaagctaataagttacgacggtgaccaatcttcttcattaaaccacgttgtgaatgataatcgtgcttgtgtgtacgaaggtgatcgttcaattcgttgatgtcagcagttaaaacagcaacttgaacttgagtagaaccagtatctccttcgtgagttgcgaattccttaataatttgatctttacgttcttttgaaatagccatgctattttcccacctttcaatattaatgcgcctaagatctaagtataacgtcggtgaggatcgttaaactgagaagaggcaattaattacttgtttgaagtaacctatacaaatatacataaaatttactaatgttgcaactatttctatgaaattttgacttgatcgtcgttagctattgcattgctcgctagtcttttgtataatgacaaatgttgaaaattctggtcaactgaaaatcgggtaacggaggtgaaactcatgccaattatcaaatcagcaattgaacgtgttcgtactagtgaaaaagctgaagcacgtaacgcttcacaattaagccaaatgcggactgctattaagaagttcgataaggcaaagcttgctggcgcagataaccttgacgacttatacaaggctgctatctcagcaattgaccgtgcccactctaagggccttatcaaggctaacaaggctgcacgtgacaagtcacgtctctcagcacgttacgctaagtaataaaaaagcaactattaagttagttgcttttttatttttaacttttcgcaaaaagaggataagaaaacaaattttcttatcctctttttgtatctcatgctcctttgctctgctgagaatactgtaacataaataactgaaacaaaagtgaaggatcgcgttgtgtcgtttttaacgattgttcaatacgaattaatcccaaataggcgttttctaacgcctgcattgagaaatcacgcgcagtttttaatcccaatttaatccgataaggatggacattaagctgactcgctagactcccttgcgtaaggccgcgtttacttaatacttttatttgaatcaacagccgaaactgccctactagcactgcattaatccttaacggcggttgctggcccgctaatagctgttgatagagatctaaggcctttatttgattatgcttaagaaccgcagtgactaaatcaaatacattttcatctaatgattgcggaactagagcggctaccatgttttgatcaatctttttttcatggtaagccaaaatctttaatttagttaagcttgcatccatcatcccataatccgcattagtccgttgaaccaactcatccaaagcagcttctgatatttcaaaaccagcagttgataattgagttctcactctttgacgagctgctcgttcatcaagtggactagcatcaactaaaactgctgtcttctttaattgctttacaatcccttttcgtccatcaagcttttcataaggggccgcaaaaactaaaattgtagacggttcagggtgttcaagatacttttttaagctatccaaatcatgttcaactttcgaatgtcttttctcaccagttaagaagaacggtttattgataataactaatcgtcgttcaccaaaaaatggagtcgccatcgcatcatccaaagcaactgccaatggtgtggcttccatatcatatcgaccaacattcataacctgttcattctctggaataaggcttataaaggcatcaattgcctgctgttgaaggacctgttgtttccctaaaattaaatataccattgctggggttttagtttttaattgtgtagataattgggcaatgtccaacttgtctcatctcccctcaatgttgtttttatttttccatttcgaccatggtatacatattgtatcattccaaattgctgcgttgataagtaattaatatttaatctttgaaaattttttattgttatttcatcaggatggcgatacctattaaatcgtccagctgaaattatcgcatacttaggagcaactgtctgcaaaaataaataactactagcagttttactgccatgatgaccagcttttaagatatctgactttagttgcggatacttttgaataactttttcttcattttcctggtccaaatccccagtaaaaaggaatcttttcccaccaaatttcccagctaacactaaagaatcttcatttttcccttcacccggaacaaaaggatgtagaatttgcaatggaaatgatgacaacttaacattatcagtcaccggaattatcattggcgatgacttttcagcagtccttactttattaagaagtgctggttgtctttccatccccgctgggacaatcagtcttttcactgctatattatccaaaatcgttgttaaatagccgatatgatctgcatcatggtgagttaaacaaatattatcaatttgcctgatgcctttacttttcaaataattaatggttattcgttgggcatcatcttgagaatgctttgaagtcgcccaatccggctttttaaaatttaatttgcctcctgtatcaatcattgttacccgtcgattaaaaggttctctaataattatcgagtccccctgtccaatatcaacaaaggtaacttcgccattaagtggaaaatgaattatccctccagtaattacatacaataaggctaatatcttccatgattttaaagatgtctcttgagaaataacaaataaagatgccgcaaataatagaagggccaaaattaacggtggcttcccaaaatgaatcattcctggaaaatcagataaccaatttaaaatatattgaaaacattttaaaccagcattaattagatacgcgagtggttcaaaaagcttaaaactaagtgccccaaccaagaccgctggaaaaacaactgtcgaaaatagcggaattattaaataactaaccccaaaactcagaagatgaacctcatatacataactcaataacgaaggcaaactaattaaattcaataataaagactgcttaaaaccacgtactgattctggaagaacttgaagaataaaagaaagcaaatagcttaattgaccgcctaatgtaagcaatagcaacggatcaataactaatccaattaataagctcagtgcccatccatcaagactgtccaaatttaaatatcgatgaagaagaccaagctcagccataatggttgctcttatcaagcttgttgctccaccaccaacgagaagataaaacggtaaaatgataattaaaaataaatcaattgattctttacgccaccataaatgaactaacagccgccgtaataaatcagtgaaaagcacgatatgcattcctgaaatgcaaaaaagatgaagcagaccaagccttttaatacttaccattaattcagccgaatcctcattactgctaccaattattaattgttggcaatacgtactaagaggaggcggtaaagtttcaaagtagaggctgattcgctttcttaatgtatgacaccagccaactattcctcttttttgcctaaccatttgctctacccggttaatttgaacttgattacagatccggcgatggtgattataagtcaaattatcaaattgattttcatttgtacggggaataatcggttttaattgcccattaataagccatatcgagggtgttgtaagcttatcaatattttttagcatctggggtgacttaaacgacatcattattgcttcacgttgtccagtttgaatgtcgattgcagttcctgtcataaaatttccattgaattttaattcatcagggtaaactaatattttttgagtaacttccatttgcttattcgccgtaatagttgtccaatttttttgtaaactgtaacataaaatcgccatcaataaacatatcagcactccaactccaagtactattggcctttttaatacggcaattcggtaaaatatagcaattaaaagaaaaattaaccaatatgaactaaagaaactaaccgctactaaacttgcaattagcgcaggaaaaaaccaaaagtgttgaataatctatttttgatctgggttgatatactggtccagatcgacctcttctaaaatatcactatctaatttaatctgatgaagcgcaacattttttagtttaagtaatttcattgcataatcatcattgtgataattacgaatataatttatctccttaattccagtctgcaataaacttttggtacattgtaaacaaggaaaatctgttacataaatacttgccccatcagcagaaataccaaacttagcacactgtaaaagagcattcatttctgcatgaatagttcgtacacaatgtccatcacgtaaatagcagccttcatcaatacaatgtgcatcgccagcaactgatccattgtacccaccggcaattattcgcttatcacgaactaaaactgcacctactgaaaggcggttgcaggtacttcgcgacgccaataaagctgcttgaatcataaaatactggtcccaatcaattctcggtttcatattatttcactcctctatatttgaaatatagtatagcaaatatcttcatcaaaaaaataaaaactagatagataggtgatcttttagtttagcaacagttttttcgccaaaaccatttatttctttaagttcgtcaatactcttaaattgaccgtgttcttgtcgatattgcaatattaaatcggcttttttatcgccaatccctgtaatttgacatagttgttctttggtagccgtgtttagatttatctttgcagaactatcgctgccattttcattattagctgctgatggttctgtactgctggaaactattggcgtttcgccttgaagaggaatatagatcatctgctggtctgttaattgtttagcaagatttacttggcgcaagtctgcattgggtagtggtccacctgccgctttcaaggcttcgttcacacgatcatctgctttcaattcataaactccgggcatttttacggcaccctttatatcaattgcaacggtccctttcatcgtagtggtagaagttaaactacttcctgtttcgctacttgttaaaacagcattagtatttgaaattaaagcatcgttattatttttattaagtatccaatatcccccaactactgcagcaatcactatcatcagcacttgtactcgatattttatccataattctgataattgctgcatgtttctcacctccctataaatataaatacgaaaaaaaataaattttgcattaaaaaaagcaagagaccttcattttgcctcttgcttttcaatttacttatgcgtttgtaaatatttcactgcttcgtcaaaggaagtgacagggacaaccttcattcctggtgcatatttcttagctgcttttttagccatttgataattagtcagatgaccttcttcatacttaagaatctctttcgttggttttatataaggggcaaagaaaatagtggctcccgcacggtgcgcagcgattactttcttgtcaattccaccaatttctccaacggtcccgtctgaatttattgttccagttccagcgattttacgtccccgttgcaaatcttttccactaatttgttgatatatttgcaaactgaacattaagccaccagatggcccgccatattgaccagcatcaacctttactggaaccttagtcttaacttgcatattgttagtaagaatgatcccaattcctggcttattagtattggtaattttaacaagcggatgggtgacagttttagttttcccatctcgagtataagtaaccactaacggagtgccaacttttttagcaccaatatatttttgaaagccttgagcggtattaaagtgatgaccatctacttttgtaattgtgtccccaacatgaatatcatgtttaaatttagaattaggctgaacttgcaatacataaattcctagatagcgtcgcgttactttttggtgagcggcattataagcaactgcaattgcctcgttaatcgagctatccatataaaatttttggacacggtcatacgttgcactattttgaccaccagttacatcttccgcactctcaattgacatatagggcatcattttggcatataaatatgttgcaggatgggcacgttgaatcgccaccgacgtcaacataaaacttcccttatatcgatcggggtgtccctttattttaacaaaagactgtaaatcagcagctgttcccggactttcaatataagaatttaggggccagaacaaaaagcagcctagtaaaaggacaagccctaaaataattcctatccgtcgcaatattacattatcttgctttttcattgtctttcttaacccgtaacatttctcgttccattaaacgcttttttagtgcttcattaatattagcgggaaggtaagctgagatatctccccagccgatgttacttctttcagcaaactactagataagtgctgatattcaggcttagcaaggaaaaagacggtctcacactgatcatctaaaaagttattcatcgccgcaatatcacgttcatattgaaaatcagtagtattacgcaaaccacgcattaagtaatctgcaccaatgcggttcattagatcaacagttaagccttccgttgtaataaccgaaacattatctagcccactaacagcctctttaatttgcgctactcgttcttcaacagtaaacagcgggtttttactttcattagtcattaccgccactgccaattgatcaaacaacgcacttcctcgcttaattaaatctaaatgtccaagtgttaatgggtcaaatgatccaggaaaaactgcaactttcattattttgattctcctttatattgataaattgttaaaaccgtaattccatattcttgacgacgaataaagttaaactcagctaaatctgtcggcagtttcgcattctgatctgtttctgccacaattattgcatctttagctagcaaattatttttaaccatctgctccatatcattaacaatttgctgtttagcatagggcggatctaaaaagaccaggttaaatttcaatttgtcttttgcaaacaaattcaacgctttgtgagcgtccattttataaactttaaattgttcaacatgttttgtaacgtcaatattcttcttaattgttttgattgcttgatattgacgatcaactaagactgcctgactgattccgcgcgatacagcttcaatacttaatccaccgcttccggcaaacaaatctagactggttccgccattaaagtaaggaccgattatattaaataatgcttctttaactttatcagttgttggacgagttgccattcccggaacagcacttagctttcgtccccgaagtctcctgcaacaattctcattttttatcatcctcatcatgtaattgatagacccctgttaattcaagatcagctaacgtcgggtctaaatctggccgagctgataattcaacctttttcactgcgcgtaatcgacttatcttctcttttattttttcgacatcactttggtctacatacattaccacataatgcattcgtcgggaaatataatcaatctgaccataatgacgaagagctcgaatcacacgattattgttaatgtaaattattagggaacgccgtggaattaatttaaacattctttacgcctcctgtttcaggaataaatggtttccccataaccaagcgatcccgattttgctgcatactaatattcattataatgcctaccgttgcagaaagaatcaacatacttgatcccccataactaataaatgggaaggtaacccccgtaatcggcaagagtcctagaactccaccaatattaaagagtgtttcaatcgtaaagaatgttgctgagccataacagatgagcgtttgatacaaactatctgcccgcaccccaacttgaataatacgacagatcaaaaagagtaaagtaactaaaattgccgttactccgactagacccaattcttcactagtaattgacataataaagtcggtattgggctctggcaaatatcccattttttgaatactatttccaagtccaaccccaaatacaccaccattgctgattgcataataggaattaactaattgatttcctgaaccactagcatttccaaagggatttagaaaggcaacaaaacgcgcaacttggtatccaccgccttgaagcaaaccactttcaactagtcgttccaatccaaggtagccaagcgctggtaagacaagaattatttccaaaccaacgccccatttataatccgccgctaaaagcatgattgcaataatcgctccgttaatcgccattcctccaatatctggttgaatcataatcaacccgagaaaaactgcaattatgagccaaggacctttagcatcagtggtaaaatgttgtccacgttgcctaattttagccattcgatcagctaaatataagataaaatatagcttacaaatttccaccggttgaatattaaagaagcccaaggatatccaacctttagctccgttaacagcccggctaaaaaccaaaacaatgacaagtaaagcaccaactaccaatgttgaatctcgtaaaaaccttggcgttcgataatgccgcaaaggataatttgccataaatgccattaccgcaactcccattacaacatagattgtttgttttactaaatatcctaatggggttccaccattttgcatttcaatggaagcactagctgaatagaccattacaattcctactaaacataaagcaaggtaaggaactaaaatataataatcaaggtagcggacgttattccatacagaacgaatcttacggaatcttaatttctttttcttcacaaagtgcacctacctaaaaacaaaatacaatcattattatacaacaaaaaaaagctcggaaagctagttagcctcccaagcttttttaaatatttacttccgtgaagcagcacgacgacgcttagcttccttttcacgggcatttgtgttaagggtcttcttccgtaaacggatattttctggagttacttcacagtattcatcttcatttaagaattcgagtgattcttcaagggagaagtgagtaggggtcttaatgtgagccatttcatcagaaccagcagcacgaacgttcgttaagttcttacccttggtgatgttaacagtaatatcattttcacgactgttttcaccaacgatcataccttcgtaaacttccgtacctggatcaattaataattgaccacgactttcgatacccatcattgcgtaagtagtagccttaccagcattcatggacacaagagtacccttttgacgaccagggttccagttcttgataactggtgcgtatttttcaaaggtatggctcatgattccgtaaccacgggtcatagtcataaattcagttgagtatccaatcaagccacgtgatggtgctaagaagataagacgagtttgaccattttcgcctggttccatgttcttcatttcacctttacgtttagaaaggctatcaataactgcaccagtatattcatctggagtatcgatttgaacttcttcaaatggttcactcattactccatcaatttcacggtaaataacttgtggacgtgatacagataactcatatccttcacgacgtaatgtttcgatcaagatagaaaggtgtaattccccacgaccagaaacagtccatgcacctggatcatcagtatcttcaacctttaaggacacatcagtttgcatttcacgcttcaaacgatcttcaagctgacgggcagtaacaaatttaccttcacgaccagcgaatggagaatcgttagtccggaaagtcatttgtaatgtaggtggatcaatccgtaatggagtaattgcttcgggatgttctgcatcagctacagtttcaccaacattgatgtcttccatcccagaaaccgcaatcaaatcaccagcttcagcttcattaatttccaaccgcttcaaaccgaagaaaccaaaaagcttagtaacccggaaattcttctttgagccatcaagtttcattaaggtaacattatcgccgaccttaatcttaccacggaagacacgaccgataccgattcgaccaacgaagtcattgtaatctaagatagcaacttggaattgaagtggttcatcagaattgtctactggagcagggattgtcttgataatagtatcaaacaatggcttcatggtgtgttcttgagtagaaacatctgaatcataacttgaagtaccgttcattgctgaagtgtaaacaactgggaagtcgagttgatcttcatctgcacctaattcgataaagaggtcaagaacttcatccacaacttcttcaggacgagcacctttacggtcaaccttgttaatcacaacaattggtgttaagtgttgttcaagggccttcttaaggacgaaccgtgtctgaggcattgtcccttcgaaagcatccacaacaagtaatacaccatcaaccatcttcataacacgttcaacttcaccaccgaagtccgcgtgtcctggtgtatccaagatgttaatttggtgattatcatatttaacagcagtattttttgaaagaatagtaataccacgttcacgctcaatagcgttagtatccatcgcacgatcttcaattgagaagtgttctggtaaagtatctgattgcttcaacatttcgttaactaaggtagtcttaccgtggtcaacgtgggcaataatcgcaatgttacgaatgtcgtcacgagttttcaaaacttgattctccctttcgtcatatcatttttaagtcgaacagcagcggcctatcaatcgccaatttcataaaaaaactgtgacatcgcggtcacagcctcgacaactaattgatgatctgtcgaatatctcgactaacctgcctcgttgctactaatacaagattagatgataacacattaatagaactaccgtcaattgatttcacaactaagtctaattcttctgctaacattcgcccagcagcaaggtcccatggcttcaaattagagatatatccacctaattgaccagtgatcacaccaatcacctcaatgcccgcacttccatacatccgtaagcctattgcgtcttgagcgattttctttaatgctgaatcaccacttaaagttaatgtccgattcatcgctaacaaactctctcgcaagcctaagtcagctggctggccaattttttggttgttaacataaacaccagcaccctttcgaccatggtaaagacgattattaattacatctaaaatatagccaagcatcggttgaccgtcaacatacaatgctaacataacagcaaaattattatgctgcttaacaaaattcattgttccatcaatcggatcaacaatccaaacatgtccttgcatattgcttatttgtttgtcgccaaatccttcttcacttaaaatttgactatcaggatcaatttttcgtagttgatcatttattaattgttcattttcccggtcaattgtcgttacaaggtcagtataattcgtctttgtatcaatctggtaatcattttccattttctggtatgcattttgacctgcttgacgaattatttgttgtgctttttgatctaactcttcaatactaatcatttttttgcctaaccatcttaattcgcttatctgttgactcttgtgctgctttgacaacacggtagagaacataacccgaattcttttcaaattcgcgacccaattgtttctcttcagcctttgagggaacgacttgcttaaaggcacgataacaatctaaaattttatctctatcaatcgcaacttcataagcatcttcaaccgccctaaacatggcaattaccgtttccatctctttagttgtccatgatagatcaaggggataactatagttatgtgaattcatttttttgtccctccaatcattttctacttgtattatacaatccaaacggaaatttaggaataaaaggcctaaaagaatccaaacagaaaaagttcttagtgatttcaaaatcgagtcatccatcactaagaacttttctaacttattaaaatttaaatatgtgttgggaagccaagcgcaatatctgcagcttcttgaacaggttcattcaatgttgggtgtgggtgaattgttaaagcaacatcttcaacattcataccacagttgacaatcaatgaaagttcaccagcaaggtcactaacaccaggaccgacaccttgagcaccaataacatttttcttatctttagtgtagattaagcgaataaatccttcggcagcatcaagagaaacagcacgggcattaccggcaaatgggaattgagcagtagatacatcaattcctttatctttagcttcttcaaccgtcataccaacttgagctaattctggatcagcaaaacaaaccattggtactccaacccaatcgttagcagtattcttaccagcaatggcaccagcggcagtcttagcttcaaagaatgccttgtgagcaagtgcaggaccaggaacaatatctccaatagcccaaataccaggtacattcgtccggccttgttcatcaacaattacttgatgacggtcgtttaacttaacatttgtcatatcaagcccaaaatcatcagtatttggtttacgaccaacagataccatgcagtagtctgctttaatgctcttttcgctaccatcaacttcataagtgacagtaacgctattttcatcttgctgagaatctttagccattgccttagttacaatgtctacgcccttcttttcaagattcttgacaacaatatcaaccatatcgtggtcaaatccaccaagaattgaatcagtaccttcaataatcgttacatgagcaccaagatcagcataggcaccagctaattctgtaccaatgtagcccccaccaattacaactaattcttctggtacttccttaaggtttaagccaccggttgaatcaataacacgaccttcaaacttaaaatgaggaatttctactggacgacttcctgttgcaagaattaaattcttccacgtgatagtacgaccattatcattatccatgaattgctttggaccaggcttgattacacgaagttggtggtcattatcaagaattgcctctccatcaatgatttcaactttatgcttcttcaaaagcatcttaactccacgaatcatacggtcgacaactttatggtccttccattcttgagtcttagtaaagtctagctttgcatcggttttagaaataccataaatagatgagtctaaagtttcttggtaacggtgaccagcagcaattaatgctttagatggtacacatccaacatttaaacaaacaccacctaaacctggttctcccttatcaattaaggtaaccttttgacctaattctgaagctcgaatagcggctacataaccaccaggacctccaccaacaattactgtatccttttgttcaacatcagccattatctagccctccatcatcaataattctggatcatgtaataacttgttcatgtagttcaatgcatgttgtgcaagtccaccatcaattaaacggtgatcgtaagtcaatgataacttcatcattcgaccaacaacaatttcaccatcttcattaacgtatggttccttgtcaattcgaccaacaccaagaatggcaacatctggttggttgataacaggggtgaaccagccaccgccaattgaaccaatattactgatactgatagtccgaccagccattgattccggacttagcttgttatcaaaggccgcttgagtattttcggtaatttcttttgcaatctcaaacatgctcttagaatctgcattcttaatatttggattatagagaccgtggtcagtgtttgtaaggatcccaacattatagtagtgcttgtaaacaatttcttgagtagaatcatcaattgaagcatttaattctgggaacttcttgcatgtggcaactaaagccttaataatgtatggcaagaaagtcaagtgaatatcttgttctgcagcaactgccttgtacttcttgcgactagccattagagcagatacttcaacttcatcaaatgatgtaacatgtggcgagatatcctttgattcacgagtagtcttagcgataatcttccgcatattagacattggttcacgttcttcaaggtcggtattccatggcttgattgtattaccagcggtcttagctgcaactggagcagtcttagctgacatagctgcactcttttcttccttagctggagcagctgacccattaaagttatcaatatcttctttaagaacttgaccgtggttaccacttggttgaacaagtgaaatatcaacacccttatcacgggcatattgacgaacagaaggcattgccattacaagcttgtttggttctgcaagtggagctactccaccctttggagaattatcttctgaaggagaatctgcagctggagccgtggatttttcactttcagtagcttcttcactgcctgtatcagtttcatcatcgtcgtcttcgctttcgacgtttgtactaataccaggcttaccatcatcaatttcagcgagcttgtcgcccttttcaacgtggtcgtcttcttttacaaataattttttgacagttccatcaactggggataccaattgagtagtcgatttatcagtttgaatttcaattaaaggatcatcagctttaattgcttctccttctttaacgagccaagaagcaacatcaccttcagttaatccttctcccatttctggtagtctaaaaatgtatgccatatcgtattaacaccctttctattccgcacttttagtaattaattacttctcgtacggcatcctcaatatcacgtgcacctggaagccaaacattttcagcttgtgggaatggatatactgagttaggagcagcaacccgggtaacaggagcatcaagatacataattgcaccttctgaaatagctgatgcaacttgggcaccaacaccagccatcttttgcgcttcttgaacaatgactactctgtgcgtcttcttaattgattcaaagatcgtgtcagtatcaagtgggtaaagagaacgtaagtcgataatctcagcagaaatattgtccttagctaatttcttagcggctttttgtgcttctgatacttcaccaccataagcgataattgtaacatcagtaccttcttgaacaacatttgctttatccaacggaacagtatacttgtcatcaggaacttcacctttgactgaacgatagagacgaaggttttcaagaaaaagaactggatcgttattttcaattgcagaaataattaatcccttagcatcataggcagaacttggtgcaacaacccgtaatcctggaataccaacgaagaagttttcaagatcatccccgtgtagttcagcagtatgagtaccaccaccataaggagtccgaatagtaattggtgcatgcttagtcccattgtattggaaacgtatccgtgacatttgagcagcgatagaatccattgcttcaaaagtaaagcccatgaattgaatttctggtactggacgccagccagttactgctaaaccaattgacattcctaaaatacctgattcggcaagaggggtactaaatactcgatcaacaccgtatttttcttgaagcccattagtcgcacggaaaacaccaccgtttttaccaacatcttcaccgaatactaaagtcttaggatcttcggctaaagcgatgtcaataccttcagtaatagctttgatataagtctttttagccatgattacttcgactccttttcttcgtacttcttaatttgttctttaatgtctggagttggtacttcaaacgtccgcttcaacatatcgctaactttttcaggttctactgagtctgcttctttcattgcttctttaaagctttgtttgcattcatcagcatatttttgttcttcttcttcagaccaaagcccctttttcgttaggtacttgcgaagacgaatcaatggatctttatcaaaccatggctttgtttcatcctcagtccggtaacgagtaggatcatcacctgctgaactgtgagcaccaaaccggtatgttaatgtttcgattagcactggtccattaccagcagcagcaaattcacgtgcctctttagcaacttcataacatgcaaggacatccattccatcaacttggacacctggaattccagcagcaacagccttttgggcaattgtttgtgtttcagtttgtagctttcgtgggaacgaaatagcccatccattattttgaataataaatacaccaggtacttggaatgcaccagcaaagttcattccttcataagtatccccttgtgagcttccaccttcaccagtgtaagcataggcaacagtgtccttttcaccattcttcttaattccaagagcaccaccagccatttcgaccatctgcgctccgataataatttgtggccggagagcacgtgcatcaaaaaggttacctttgatgtgtccctttgaccataagtacatttgagcaacagttgctccatgttgaattaattgtggcaaatcacgataagcagggaaaaggaagtcttgcttcttaaatgcagcagctgttcccatttcagaagcttcttcaccccaagttggcgcatagaaacctaatcgaccttgctttgaaaaactcattgtttgttcatgcaaggcacgtgcccaaaccatttttttcattaagtcaactaataattcatcattgaaattagccattaattcttcgttaacaacatttccgtcgttatccagaatttgtacgggttttgcataaggtaccccttcattggctttaatctcagcaaaattgacagctttggtattggccatattcaacattcctttccaaatccaattaacatcatgtaagcgattgcttacctacatttatagtataaccgattgcctaaataatacaagcgctttcataaacttaatggacagaattgttaaaatggtccaagtgaagtatacgttttttcaaaatttatagttaaatattgttatcctcatattcattagcaattttaaatagttatgatagactataatatgactgaatttttatatggaggcatagtgagtaatgtatttaatgaaagatattacccgtgatggcaatcccgttttacgtaaacgagctgctaaggtctcatttcccctatctgatgaagaccaaaaattagcaaaggatatgatgcaatacttagaagtaagccaagatcctgaattatgtgaaaagtacaagttacgagctggagttggccttgccgctcctcaagttggtgtttcaaagcaaatggctgctgtccttgttcccgcacctgctgaaggtgaaaagcccttatttaaggacgttatcattaatccagtaatcgttagtgaatcggttcaatatggtgctcttactgaaggcgaaggttgtctttcagttgataaagacgtgcctggctacgtaccacgacatgaccgcatcacattacgttatcaagacgttaacggtgaaactcataaggtacgattaaagcattatccagcaattgtttgtcagcatgaaattgaccatttgcatggggtgctattttacgatcatattaataaagatcaaccatttgaggcgcctgcagatacagtaatgattagttaatttttacaaaaaatggtcgagagaaaaatacactttctcccggccattttcactaattactattttgatttaatttttttaaatcttcaatgtactcaacagttgcttcatttatcaaataggcaatatcgatatgcaaaatcccctcatatttccaccaatcggttataataaacggttgagaggctttgggagccatctttaaatggtgtcgttttgcatattcattaagttctgctgctagtttttgacgtgtgaaatcatcaagattaatattttcttttttataatcaaaatggtattcaaaagcaagcacaccttttccccaaacatcggcaacaatttgagaatttagatttttattccaatgtaacatttctttcaaactagtatttaacgctgcatcagtaacgtcttgagcgtttttctgtaccatcatcgttgctcgcttaagaaatacgcgatggatcgttaaataaagagcaataacaattattgctgctaaaatacagattaagaatataaccatgactatcacctcgttggcctttacctttatttaataataccatgttaggaaaatttaagacacttttggttatctgtgatagaataataaagtaaattactgcataatatctttaattaaggagtttttaacagtatgacttttaaagtatactaccaagctgataagacaaaacgcccagttcgtgaaaacactcaatcattgtatattgaagctgattcagaagctgaagcacttttaatggttgaacacaacactgactacaatattgaatttgtagaacaacttgatgaaaaggcccttgcttacgaaaagcaaaaccctaactttaagttgacgacgttctaagcttttaatcattaacagaggctgagaaaaacgcttgtttttctcagcctccaactttcttatgaacattagaaaaatactgaattaattattcgaatataaatattattttgctttttggcaccattcaaaggaggaatattgatgaattattcaatcatcctcaaccgtcatgctggtaatggtaatgcagaaaaggcatggtcgtcaattaaaccggtcttagatcaacaacaaattgattatcacatggaaacaactaagtatcctaatcatggagaataccttgccagccaaatcgcccaatctcataatgcgggatcaacaattgtcattgcgattggtggtgatggtacgctacatcaagttgttaatggacttatgaagacggccaagcgattgaataaaaaaccacttgcggttggatatattcctgctgggacaggaaatgattttgcccgcggttacgggatttctatgcatccacaaagggcattaaatcaaattttaactgcagacgcaccacaaaaaattaacattggtcattatcatgaggcgattcggggtgaagaaggttattttcttaataatttagggattggttttgacgcggcaattgttagtcgtgctaatacgtttaaggctcgtcacaagaaaaatcatattgggcgtttcacctacctccaaaaggcaattggagtaatctatgatcaagagccctttaccctgatgattcaatctgggcgtgaacgctttatttttcctaaagcttacatcgcaattaccagcaaccatccatttatcggtggtggatttaaagttgccccaagtgcttcgttaaagaaaccatcattggaattagtcgtcgctgaacggaaaggatggcctatgacaatatggcaattgctgcaattagcccgaggcaatttagatcaatcaaaatttgcccaccacttccaaagcgataatctccacatcacaactacttcactagaatttagtcaaactgacggagaagaaataggtaatcgttttatcgacctcaccctagacattagtcaatatccaatttggcaaacaacagaaaaataagttaaaagcagtaagtccagaagataattttttcttctagcgcttactgctttttgttaatcttttttagtttattaatcttcagaagcttccattgcttctaaaataatccgtaactgactgcattcttcccgtaaagattgcatctcttcaccgtattttggttgaatagtaacagtctgagtgcccgtattttcctgtccctcttgtttacataaatcatccaaacgggactgtgcacggtataaatcttcttcaatttcatgtttgttactcatatttaacactccccaataaatgtgaaatatttttagagcaatactggaattgcaatataagtaagataacacgaggatagaagaatgttaaccctttttaggttacatctttgttactatctaatgaaaaagctctaataatctatcagaactatttaaccgttccggcaaaacttggattaaagtatggactgattgtgtaagtcgaaacattagtccctgggtgagcagcggccacatattgattatttcctgtgtaaatagctgtatggtaagttgaaccatggttaccccagaataagagatcgcctggcttagcttcactaactggatgttggtccacacagttttcaagtgctcctgtatagtgtggtaattgcttaccttccgcattagcataaacatacttaactaatccagaacaatccattccactaagactttcaccaccccatacgtatggaacactattagagttagcaatcttagtggcaagactaactacagaaccatgttgtaaatcttgattagtagttgctgcttgctgtgcaggttgactagcagccgcttgtgattgttgcggttgagcttgtgacgttacaacagttgtttgttgcgaagcagcattactattctgaacgttatccgtcgcttgtgatgctggtgcagtctgtgattgtgaagcttgacttgctactggtgctgcttgaacaaatgattgtccatataaagcagcagtattcacagctgttgaagtagcttgactaacagcaaaactttgtgtttgcggtgcaacactattttcagctgaggcagaagcaacctgaacattattagctgtagcaggttgagcagcaactgttgtaatggctggactattagtagttgctgaggacgttacagcagcagaagtcgaagttgtactattcgcaatagtggtactactattgttggctgcactttggttaggagcagctactgttgaagaagttgaaacttgttgcgttgcactcaaagcaggagttgcttgtgaagttcctgctggttggctactagccacatcttgttgaggcacagaagcagaggcaactgctgaagtttgaacctggatcaatgaagttgtgtccgtcgattgagcagccggttgctgagccgatacactcgcatcagcaacaggggtacttacaacgggcgcgtttacagcagttgagatcgcaggacctgttacactgagttgttgtccaatgtataatgaatcattagagcttaagttattccatgacattaattgactaacagttacattataacgatctgcaatagagctaagcgtgtcgccaggcttaacagtataactaccatcagtattcaaatccgcgttagcatcatgttgagtagtaggcaacgttaattgttgaccaactgtaattaagtcgatgctatcacttatcttcttaactgaaggatttgtttgttctaatgcactaatagaaagtccatgttgttttgcaagcccccaaatagtgtcaccagacttaacagtaagctgttcagcattaactgcttgtgttgtcactgctaataaacttaaggcactaactgctcctgcaaaaacgccacgagatcgatggttatttgaatgatgtgttctttttttactcatataaataaaacaccctcccaataagttcctaaaaactaaacaaacaataataaattagtgaaatacacaattctaactttaccattaatttttaaatgcgtatagcaattattagatagttcttaaaaaacgttactctttcttaaaagattaatcattataataatatttaatctatcatttcattttttacacgatccatacgagttactaataacaattcaataattgtaataatactcattaatagaactgagtaacgactagtcgtcatgaaaacaataattgctagtatacacaagatccaattcaaccgtttttcttgacgaactacccgaataaaatcctttgtaactttatctggtcgttgacttgccaagaatccaagttgactatgtaaacgattttcccaaatcactaatcctaaaaaggcaattgaaataataaacgttattagactattcatcattatcctcgctatcatcggcatgcaccgtcttattatttgcttgtgattcattgtatcgagcggataaaatctgctgatatttttccatgattactttattgatcggtgtatcatttagggttggatatttttcttttattttttccaaaacatcatctgaaaagtcataaacagtcttaacttccttttcaccattaagaaatgccaacgtctcatcatagtccagagttattaaatcgcgctgtgtacggtcagcatctggctggtggaggacatctggatcatcttttaaatcttcacgaaagccgttttcatcatattgatatttattatcttccatttttaaattctccttggttatcttccaattcattatacggtctttataagactaagccaagccagtaatttgctgtaaaatgtgcgtagaaaacagtcttctcgacaaggcggttggctaagctaaggcggaggtatgggctaattgtcgctcggacgcgagccttgtgacaacgcgaagctaattctacgttatcttgcaattgttcgtgaaaatagcagagggtgagaaaaaagcaaagttttttccaccctcttttaattcctaattattaacatgactcactttaattaaacgcgcaacgttttctgctgtttgcgcaatatcaataggtgcatctgctaatgctgcttttaatggtttagccccttcaggagttgcaaaaattgcatcgatggccgtggatgaatatagatcatttacacctttaccaatatttccagccaacacaattactggagcattaggagccacctctttagttgccttagcgactccatatggcgttttaccaaatttagtctggaaatcaattcctccttcaccagtaaaaacataatcagcgccaactgcctttttttgtagttgagttgcttcaatcactaattctactcctcgcttcattgtcgcaccggtaaatgctattaatccggctcctaaaccaccggctgcccctgcacctgccgtttgttcaacgtctggcccaccagctgcaactatttttcgtgcataatgatgaagatttttgtccaagatgttcaccatttcgtcatcagctcctttttgcgggccaaatactggggcggccccattttttcctgttaatgggttggtaacgtctgatgcaatctgaatatctacattttttaagcgaggatctaagtctccaaaatctatttgctctaaacttgctaactcaccaccgcctaaaccaatttcatgattatcagcatccagtaaacgtgctccaagtgcttgggccattcccgccccgccatcaacggttgcacttccaccaattccaataattattttttttatgttatggtcaagagcatccttaattaactcgccggtaccatatgtagttgtaataagcgggttcgcagtctccttattaacaaattgaaggccacttgccgctgccatttcaatcactgctgtttccccatcacctaatattccgtactcagcattaactaatttatttaatgggttgtggactttagcaatcatttttcgaccgttagtcgcatcaactaaggattgaacagttccttctcctccatcagccattggaactaaaacatactcggcattcggaaacactcttttaattccttctgccatcacatttgctgcttcttttgctgttagtccgcctttaaatgaatctggagcaattacaaatttcatcactgatcatcctttcatttatagtaaatgcaaaaagccatacaagatagttgcggttaacattgcggaacctccaactaagaattcataaaaaataccttgcgatcgttctttaatatccatatgcattgcattcgctgtaacatggaaatagtttccttgaggtaattggtcaatgacaatcgccccagtatgaaccattgcagccgctgcaagtggtgcaacaccaaatcctaaaatagacttggcaaaagaaccagtagctaaaataacacccgtagaggttgaagcagttgctccggccatgagaataccagaaagtggtgctaataagacaccaggcacatgacttgccttaataagttcgattaataactctgggaaagtagacgcagtaatagtagcaccaattgcacctgcaccaattaaaatcattactacgccagtcattcgactaacaccggtctgagcataactcttaattttttcaccttttcccattgctagagcacctattattgctgcaaatggcaaaacataggtagcatctaaatttacttttgctaataatggtaaatgacaaatagttccaattggtcctaataaaagtaaaactattgcaataacaggagcaacgatggcttgtttaaatgtcggcaaatcactttgcttgattgtttttgcactatcttcaagatcttgttctagaactgccctaccttttttgcggatcattctagctacaacaactgtaactattaaagcgatgacggcaggaataaaatcagcaatcattacttgacttagttcaagcccaaaaccctttgctgctgcaattgtatttgcatttggtgagattatgttacctgccttgcctccaccagataaggcaaccaataaagataattttgaaatatgcatattgcgaccaacttcaagggcaattggtgcaacaattaaaacagcgactgggataaagacacccacagctgtaattaccatcgttgctagagctaatgcaaaaatagctaaccgatcaccaaatttattaacgattgtccgtgcaagggtttcggcagccccagaatccatcataacaccagctaacattcctgctgctaatactcgaaggaccgttcccattacactttgttcacctttaaccaaaatattaatagttccttctaaaccagccccaccaataacggcgccgactattgcacctagtaataatgaatatactggatctaattttcgtaaaattaaaaaaatcgcaagtgctaatcctattaatgctccccaccaagaaatcattttataagcctcctctttgattgctagtaaagaaatattaaaataagataaaatatcacaagaaacagtatccctttgtcatcgtttacattaatccttaaacaagcttataacaagttatgttttgcacaaagattattatgcattttgtacacaaatcctattatcaaaatcttatcgtctaattaccaatcagtaaggagaaaataatggaactcaaaccagaacttgcacaatcaattgtcgatcatatgatgacgcaaataccgtataacattaatattatgaataagaaaggttatattattgcaagtggaaataaaagcaggataaatactttacatgttggagctgttgatgcgataaaacagcgaaaaacactaccaatggagcaacaatatggaaatcatggacagccaggcgttaatatgcccttaaaatttaaaaatgaaattattggtgttgttggaattactggtgaccctaataaagttactcccctagcatcattgctaaaaacagcagtcgagctcttgctacagcaaaaacaagaaaatgaacaagagcacgaaattgaaaaagttaaacaaagatttatttataggtggattaatgtcagcaagtatcaaaatccgcaacttgatagtgaactagttgaggaagcaaatcgtctaaatataaatctagcaaaacaacgacttgtaattgcaattgctgggagttctcagataatcaaaaaccttaaactagatcaggaaacaattattttttctcttactaatcacattgagttgattatcctcagttcaaagcaccaagaaacatatattcaacaaaaacttgaacatcaagaaattgaatacggtatcagtaattggggtaatttgcttggtagattagcggagcaagcagttacaacactgcgattaagtaatatttttggaaagccatcatttaggcattactcacaagtctcttttattaaacaggtattagatagtgatttaaatttaatagcagttaatgatcaatatgaagctttactaaaaagaaaagatgggaaagaattgatcgatacaatccgtgagttcattaagtgtaatatgagtgtaaatcaaactgcgcataatttatttgtacaccgtaatacacttaataaccgattacttcgcattaaaaaactttttgaactagatcctaaaaatactgaagacttatttcaactttttattggctacattactttttactatcgacaaactttataaccatacaaaaaatactccctatattcagagagtattttttattatgattataaaattttaaactaacccatttgcgactaaacgttctgcattttcaacggtattccaagccgcccctttaaggagattatcagcaacaacccacatattaaaggaaccaggattttcttcatctgcacggagacgaccaacaaaagtgtcacgcttgccaacagcattaattggttgaggataaacctggtgcgcaggatcatcctgcagaactaccccgggagcgtcctttaatactgcccgcaattggtcaacagttaccgttggatcatcaacagtaaagtaaatcgattctccatgagcaattgggacaggtacacgaacacaagtggcagtaaccttaatatccttagcgtccatgtcgtttaacatgatcttctttgtttcgtggatcatcttccattcttcatgggagtaaccatcatcttcaaagacatcgatctggggtaataaattaaaagctaatggataatgcttcttgtcaccctttgttggcaaaatcttggcatctgcttgcatatctttaccatcaaggtagtcttgagtttcttgtcgtaattcatttaaggctgattggcctgctcctgaagctgcttggtaagtcgaaacaataatttgatttaatccaaatgcttggcggattggttccaatgctaccaccatttgaattgtcgaacagttagggttagcaatgattccgtgatgattttttaacgcctcttcatttacttctggaactactagcggtacatcaggttccattcgaaaagcactcgtattatcaacacaaactgctccccgttttactgcttctggaaggaacttttttgatactgatccaccagcagatgaaagcacaatatcaaccccattaaaagaatcaggtgtcgtttcttcaacagtgatcggttggcctttaaatgataattgtttaccagctgacttagcagatgccagtaatttcacactctttactggaattgttgattgttccaattgctgaatcatccgtgtaccaactgcaccagtagcacccaaaattgcgacattatattctttactcatcttagttccttctttcaacctatcctaaattattcataaaattttgtaaccgttcaatcgccgtatcaataacagaatctgccgctgcatatgataagcgaatgtatccttctccaccaggaccaaatgcatttccaggaattacgccaactttagcttcgtgggctagtttacgagcaaaagcgagatcatccttcccaaattgcgcagggattttagcaaaaatataaaatgcgccatctggcaacgcaatttcaaagcccatctttctcattgcactcgcaagtttatctctccgttgacgataggcccgcttaaattcttgcggatcatcattcccgttttctaacgcttcaatcgcggccgcttgagcagtatcatttgggcacgttaccataaatgaatgcatctttgacatcgttgaaataaattctcctgggccagccacatatcctaaacgataacccgtcattgcatgtgattttgataaaccactaatcagaattgtctgctcgggcaaaagtgtcgcaagtgaatggaagggttgatcgtacatcaatgaactataaatctcatcaacaatcgcatagatatgatgatcttcaattactttagccaatgcttttaactcttcttcagtgtacgaacggccagttggattattaggataatttaggagaacagcctttactgccggaccctcttttgctaatacctcttctagtctttcagcggataacaagaagccatcttcagcagtgttaactttgatcggttcagcaccagttagagaaacactcgggaaatatagcgaaaatgctggagtgggaataattactttatctcccggatttaacattgcaaaagttgtcgcggttaccgcttctgttgccccaatcgttactacaatttcggtttcagggtcatagtaaacgtgacgactctgctcaagatatttactaatcgctttgcgtaattcaatcttacccttgctcgacgaatagtgagaatcatcattttgaatactttcaattgctgccttcttaacatgatctggcacagcaaagtccggttccccaagcgttaattttactagtccaggaacggcagaaatttcttcatcaaatgcgcgaatctgtgctggcggaacagctgccagatgactatttacggttgttgctaattcagcatggagtcttggcattttttcaccctcttataaaatattttctaagccaattaccaattttgataatccatcaactttctccagagcaaccttaaccccattcataaaggattgacggtcaaatgagtcttggcggatagttagggcctcgccatccccaccaaagagaacttgttcgtgagcaatgtaccccggaagtcgaacagcatgaatcttaattccatggtagtcgccaccccgcgcaccggttaagctctctgtctcatcaggattcgtctcatgtgcaggacggacttgatcgatcaactttgcggtactcaaagccgttcccgatggggcatcttttttatcaccatgatgcatttcaataatttcaacgtccgggaaatatttagctgcttcctgagcaaatttcataagaagaactgccgacatcccaaaattagcagcgatcaatccacccacttgtttttcttcactgaggcgcaccaggtctgcttgttgttcatcggttaagccggtcgttccaacaatcggcctcattccgtgttcaagcgcaaacttaacattctgataaacagcacttggcaaggtgaaatcaatccaaatatcagcaacgccatcttcaatttcatccaaagtttgataaggatgaacagatgatgcaaggtgaaaatcagccatattctcttttgttaaggttggtgcaagcgcagcagtaatttcaaacccagcgagtgagttcactagatcaaccgccttttgtcccattgctccagtcgcaccagcaattaaaacttttttcatgctttattcccccaaatttaaaggtaagttcttggcagtcaacgaattagtaggtaatgataaggcagtctctaattcgcgtttttcttcttcatttaatggaagaattggtaagcgacaactaccaacgttaaaaccttgcgcattcaaaacagctttaactggtgatggtgatgggaacataaacaaagcggccatccggggagttaaccaccgttgcaacttaccagcagtttgataatcgcctcggtatagtgagtcatacatttggcgcatttgatcgacataggtatgggaagcaaccgagataaccccatttgctcctaaaacccgggcagttagcgcctgtgcatcttcacccgtgaaaactgcaaaatcagggtcgcggtgttcaacaatgtattcaagttcttccaaagatgtacattgttttacagcggcgatattttgatggtgcgacaattctactacggtttcctgagccatctttacccctgtacgaccaggaatgttgtaaatgatgattgggaggtcaacattatccgcaactgctgtgaaatgagcaaccattccccgttggttaggtttgttataaggaggaacaacaacaagggcataatcgataccgttaatttgcgcaacctcattagtaaaggcaatcgtttccttagtattattgctaccagttccagcaataaccggaacccgtccgtttacaatttcaccgaaatgttggtatagctcaattttttcatcatgagtgagttctggagtttccccagtagtcccccgataacaaaaccattactcccatgttcaattaagtaatttgtcaaatattctaaacgaccatagtcaatatttccctcatcatcaaaaggggttacaattgccgtcattaagtctgcattttgtaataatgtcatattatttcctccattatttgttccctattaattttgcatccgatattcaagaaaaccagtaatcgcatctactccacgtttaattgctttttcattgggggtaagggtggccgaatgtaattgtgaatcatcttcaaccccaagccaaaacatggttcccggaaatttagccagtaagtagccaaagtcttccccagtcattgctggttctgtttcgataaagtttacagttggtgtttcttccatataatggataaaccgttttgttaattctggattattttctactggccaatagccaccctgatttaattcaagggaaacatccatgttaaaactacgcccgattccttcacatacgtccttcaagcggtcatcaatagtttcaatcatcgtctgcgttagtccccgaatcgttccttcaatccgtgtatgtccagcgataacatttcgaatcgtcccgccgtcaatctttcctaaagtaattacaccactttgaataggatcgatactccgcgaaatcacagtctgcacttgaagaattaatgaggctgccgcaacgaccgtatcattagcattttgaggatacgccgcgtgaccgcccttaccattgaggtcaatattaacttccgtggttcccgcaaacaaggtccccatccgacaaccaattgctcctgctggcaaatcaggattatcatgcaaaccgtaaaactcatctggtttccactttccgctaaacaagcccagttcatatgcccgctttccaccattttcgctttcttcggccggttggaagaaaaacaggatattatcttgcggctggtgttcactaaaataattcaatacccctaatgcaaccgtcatatgaatatcatgaccacaggcgtgcattattcccggatgagttgatgaatatggcaagcctgtttgttcctcaactggtaaagcatcaatgtctgttcgatatccaattgttcgttgtggattctgaccatgaactaacaccatgagagcagttggcaattccttaaaagtacgaacttctaaaaatgcttggttaaaactagcaaccgtctccactaagtattggtgggtgtcaaattcatggagagctagttccggaatttggtggagatgacgacgaatttgaattaattcttcttctgttaacatcttcatcctcctaaagcttccgtaaatcgtcctctaattcagtcttaccagcagtttggtcatcaacattcttaataaacttagcaggaactcccgcaaccatcgtatgaggagcaacatcatgagtaaccacggcgccagcagcaatgaccgctccttctcctacatgaaccccttcaattaccaccgcattggcgccaatcattacattgtcatcaatgcggactggttcagctgaagccggttcaaccactccagctaatacagtaccagcaccaatatgacagtggcgaccaacaattgcacggccaccaagaactgcccccatatcaatcatcgaatcggcaccaatttcagcaccaatattaattgttgcgcccatcataatgacagcattgtcaccaataagcactttatcgcgaataattgctcctggctcaatgcgggcattaatatccttcaaatcaagcaaagggactgctgaattacgcgcatcgttttccacatggtaagattcaattgctgaactgtattcctttaataacggttcaataactgtccaatcaccgaaaataacacccgtacgctgttcaagaaatgtttctacttctgtgggaaattctaaatcacccaaattccctttaagatagacctttaccggtgtcttcttgggtgcgttactaatgtagttaatgattgtttgtgcatctaattcagccataattatttacctctttcttcctttatatatgtcaaattattgttggtatggttcatccaaatgaattaaatcatcataggtttctcgtttaattacaacctgagctgtgcctttttctgcaaagacaactgctggacgaggattccgattataatttgaagccattgaataaccataagcaccagtatcaagcatcgctaagacatctcctggttttgtagccggtaatacctgattctgactgaggatatcaccagactcgcaatactttcctgctacccgaacatgttcaaccaactctgcacgaggattatttgctaagaccgtttcatattgtgcttcataaagtgctggacgaatgttatcacccatcccccatcaactgttacatatggcttcaaccctggtacatctttacgtgatccaacagtataaagattataaccagcgggccccgcgattgaacgtccgggttctatccagatcgctggcatagcaagatttgtttctttaatttcagctttaattaccttaataattgctgccacaaattcttctggagcaagtggtgtatcatcttttacataacgaattccaaaaccgcccccaacattgatcacagcagcttgatagttaaatttttcttgccagtgggcagcaacttcaaccaacttcttagctaccccttcaaatcccgcaagctcaaaaatctgtgaaccaatatgggcatgcaaccctttcatttgcatccggggattctcgaggacttttgctaacgcctcatctgcctgtcctgattgaaggtcaaacccaaacttactgtcaacctgaccagtttgaatgtacttatttgtatgagcagaaattccaggagtaattcgcaacattacatcaacatgtgcatcaagcttctccaaaacgtctgctagcaattcaatctcatggaagttatcaatcatgattgttcccacgtgatggtcaattgccatttccaattcttcccgtgatttattgtttccgtgaaaactaacatcagccattggaaagccggctttgattgccgtatataattcaccaccagaaacaacatcaacatgcgcaccttctgcagcaactacttgatacattgcgattgctgaaaaagctttactagcatagctaaccgcataatcaacattattttcttcaaaaacccgcttaaatgctcgaatctgttggcgaatctgttgaacatcataaacaactaacggggtaccaaaccgatgagctaagtcaaccgcatcacatcccccaatcgttagatgaccagcggcatttaattgttgatcagtaatctgttcgttcatttgtaattcctccatgagatttgtagtaaagaggctataaaaaatccactgtctgcgcaaacaaacagtggaattcacttatccattctgatttgtcgatagcgcaacgcaggctcttattgtcctgcgacagtccgtagcttattcaactacgacccagctacttaatgtgccaaactaagcgcttcggcaacttccctgttcaactaacctcaatgtcttggcggactaaattagtttactagtgtcggttgcgcctcttcgatttatacatagcttataagtcttttatgagaatgtcaatacaaataattaaatttaaaaagtttttttaatccattagatgtaagaaagtttattttacttaccttatacaacttaaaggtttgcatgtcttccttaatgtgttagaattcgattaaattattttagagataaattaacaaccctaattttctcaaaggagtatttaagtatgaaagttgtaaaatttggtggaagttctctggctaatggagaagcctttcaaaatgcaattaatattattacctctgacccccaacgccgggtaattgtcacttctgcgccgggtaaacgttttgccgatgatattaaagttactgacttactgattaaatatgcccaagcagtaattgcaggccaaaatccccaagaaatcgttgaacaaattttaaatcgatatcaagagattgccgcttattttggcttaccagcagataaattaattccgctagttgaacgactggaaggtcttcctaaccatacgtatccaaatgataactatctcttggccgctttcaaagctcatggtgaacgcttaaacgctcaactaatggctatccttttgcagcatttaggctatgaagcacgttttgtgacaccaagtgaagctggtattatcgttactggaacacccaataatgctaacgttattccagaaacatatgcaaacttgagtcattttacgtttaatgagaacgaattattagtattccctggtttctatggcctaactcttgctggacacattgctactttttcccgtggtggttctgatatcaccggtgcaattctcgcgcgcggtcttcacgcttcaacttatgaaaatttcaccgatgtcgatgctatttactcagccaatccacaaattgtcgaccatccgcaaccaattacaaccatgacttaccgggaaatgcgagaactatcttatgctggtttctccgtctttcacgatgaagcattgattcctgctattcaaggaaatattccaattaatgttcgtaatactaatgatcctgaaaagccgggaacaatgattgtccctgataaagattttcaaccaagcgatattataacgggggtcgtgagtggaaaacactttgcagccctctacctgcacaaatatcttcttaacaagcaagcaggttttactcttcggatccttgaaattctcgcaaagcacaacgtctcatacgaacatatgccttccggaatcgatgatataacaattatccttgatcggaatgcaattaatgaccaattaatcgataccatctgcaatgaaattcaagaggagattaatcctgaccgtttagaatggattgataattatgcaattaccatggttgttggtgaaggtatgcgtaatcgcacgggggtaattgatgatatattaatgcctctagccgaaaaacacattgcggttcccatgattaatcaaggagcttcacgaattgcaattatgatcggaacatacaacgaagacgcggatgatgccgttcgagctatttaccatcgctttttcgcaaattaggaggaactatttatggtgcaattattaaaagtacacggatcacaaaatgccttttttattcttgaccaaacacaattgactactccccttaccgataaagaactagtttcatttacccgaaaagtaactgatacacaaaatggcgttctcggtggtgctgatggcgttttagttgttaaccatccaactagaccaggatcggtagcacaaatgcgggtaattaacgcagatggcagcgaagcctcaatgtgcggtaatggtttgagaacggttgctcgttatgtagcagaacgtgataatttaaccgattttaaagttgatacaatgaatgctagtcttcgtgttcgtcagcatgaagaccttgcacctggagttcctgcttttgcggttgaaatttcaccagtaaagtttgaccgcactgctttgccatttgataatcttggccatgagcgcctgttagacaccctcgtccctgagttatatcctaacctccgtttttcagcccttgctgttcctaacccccacttaattagttttgttagtatggaagagctaaatggcccagcacttgaagaattaggtacacggttaaatagtgataatctttacttcagtgacggggtaaatgttaattttggccatattctcggtcataacaaactctttgtaaaaacgtttgaacgaggagtcggctttacaaatgcttgtgggacaggtatgtctgccactagtctcgctttagccctcactcatccagacgcagcatcatttaatgaaccaattagtgtttataatcctggtggcatggttaagacaattcttcaccgtgatgactacaactactgggtcgaactaatcggtaatgctacgtttactcatattattactgtagaggagtcaacaattcaccaagaaaatcttgatgagcttcaaagcagtagcgttgaaatggatgaaaacaaagcatatttggcttttgttaattcactaccttccttaaaatttgaaaactaaaaaaatttaaaagataaaaatcgatgaaaattcagtttcaactctgaattttcatcgatttttaatttatttacgattaaacaatgtatcaattgattggttattgtggatacgaacaattgcttcttttaataaatcgtccactgataattgaaccaacttagggaattctttctcttttggtagatggattgtatctgttacaatcattttttcaagaggagaattttgtaacgtatttaccgcatcagctgataatactgcatgcgtagcaattccgtaaactttagcggcaccaaagttctttaatgcttgtgcagataagttcatccgtactcctgtatctacaatatcatcaacaataatcgcagtctttccttttacatccccgattacatattccggtacttcttgttcagtccgttcccgaacttcattgttacggttatcaataatcgcaatggaagctttaattcgttcagcatatttccgcgctaaattaacgccagcatgatcaggggcaactactacaatatcatcacccaagttttgttcctcaatatatttagtaaaaagactggttgcttgaagatgatcaacaggaatatcaaagaaaccttgaacttgaggagcatgaaggtcaatcgttactagtcgactaatttgatccatttcaagaaggttggcgatcaatttagctgtaattggttcacggcttcgtgcttttcgatcttgacgtgcatagccatagtatggcattactacgttaatcttggccgcacttgcccgccgtagagcatcaaccataattaatagttccatcaagttagtgttaactggatcagaaactgactggatgacgtagacctcacagccacgaatactttcgtcaattgtaattttaatttccccatcagcaaaatgactaatggaagctttactcaacggaatccccacgcgttgagcaatttgttcagctagttttggatttgaatttagtgaaaataaacgcacattatcggcattttttatctgggtcatttttatactcctttaaagttcgacaataatcataactattatgacaacaaattactattcaagcaagtattatttggcttgatgcaaactttgtaagctaatattttccattccgattaatggatcaattgtctctgaattaatgagatcagctgttaggatatattgctgagcatcattatttattaactgttcattttctttttgaacaggttgcggactagaaagttctttggttaacgaatccgtttgatgatccaattttgattttagttcaccatgcttactccaaaccttatcaagacgatcgaccaaagaagttttccggttaactgcttcattttttacactagtcacaaccgcatacggctcaccgatcaagactaacttttctgcggcacgggtaatcgccgtatataaaagatttcgttgaagcatccggctaaactgctgaacaatcggcaaaagaaccatcttaaactgacttccctgtgctttatggatcgaaatacaataagctaaccgtaattgattccattccatgcggctatagctcacttcattaccatcaaaatcgacagtaattgattcatttttcttaccgactgtcctaccgctttcaattgctgtgatttttccaatatcaccattaaaaatgttcttttctggaacattaacgagttgcagaaccttatctccaacacgaaaagttagtcccctaaaatcgacttcttgctttccattagctggaggattatatgcctgttgtgcaagttcattcaaacggtcgattcccgcctgtccgcggtacattggtgccaagatttgaatatcatttgcggaataatctcgttttttagaaaggtcaataatttgttgaaccacacttggcacttggttagcatggcatgagataaatgatcgatctggcattttattcgttagatctgatggtaacttaccctctttgatagcatgagctaatgggataattgttgaatcagcagcctggcggtgaatattggttagttcaactttgggcagttctgcaaagtcaagaagatcatggaaaatttgcccgggaccaacagatggtaattggtctttatcacctaccaaaaccacatgcatagaagtagggacggcttgaataagagtcttaaacaagagggtatcgaccatcgacatttcatcaataatcaataacgagccttctaaatcgcgggcattcatatcagttggcatttcccgaccgttaagtcctagcaagcgatggattgtacttgctggcaaatctgtagcttcactcattcgtttagcagctcggcctgtaggagcagctagcaaaacaggaaaagacttttccttatattcatttacatccaatgagagattatgaattttcgcatagctagctacaattcccttaataattgttgtttttcccgttcctgggcctcccgtaagaagcatgactttgctgtttaaggctgttttaatagcctctttttgaacttggtcataggttatccccgattgatcagcaacttccgtaactgttttttcaatagtcgttgctggtaatttttcctggtcaacggtaagaagacgatgtaagtgatcagcaatttgccattccgcgttataaagggcagttggataaattttttcatccgcgtaactaatttcttgatttttctctaactcaacaatttggttggcaattaaatctgtagaaacacggccaccacttccttgggcaagcaattggatagtttgctgcagaagaggttttgttgtagtaaatgtatcaccagtttccattgtcaagtcatcaagtgtctggataattgctgcatcaatccggcgtgaatcatccgtggcaattcctaatttttgtgccacctgatcagcacgattaaaactaattccatctatttcagcggcgagttgataggggttttcattaataatatgtagagtttcttccccgtacttgtcaaaaattgcactactaaggttagcgccaaagccgagatcatttaggccgataataatctcgtccatcccctggtttgcccgtaaattatcaaccaatgaatccttaactgctttgcggagttttaatttatctaaaacatgcgggtcagcaataattttattaatcgcatctgttcctaacttgtcgacaattttttcagccgtcttttttccaattccggtaaattgttttccagacaagaaatcaactaacccatccttgcttgtaggacggttgacatgataagaagtagcttgaaattgttgtccatatcgtggatgctcaacaatttttccctcaaagcggtaagtctgatcatcactaagatcaccaaaacttccggttacagtaatttccggctcgtgccaatcaaaatttgcttcttcaaccgagacaattaaaactttaaaaaacgaatctggactagtaaaaatctcagattgtacctgaccaataaaaaaagacggctccgttggcgtcttaaataggtcgatttcttcagccatagaagtcatcctttcatgttgctaatttttcttttgcgttgcctgaagcgctttttcaatatcattaagtcgttgctcactcttatggtagtagttaggatctaactgcttagcttgcgcaaggtagtctttgtatggttcaccaagaaccatcgctacaattccgcggttaaattgcgtatcagcacggcccggatgatactttagaattgcatcataataagccttagcctgtttaaattcacctaatgctaataatgaatcaccaattacctgattaatttcaggatcgtctggacgtaattcaagggcagttaatccataagcaacggcttgcttgtattgtccctttttcatatagctttgggctaacataagataagaatcagctttgagtttgggatcatcaatcttattgtaaagcttaattgcttcattaactttgccaatctcatagtaaaggttaccaagaccatagtttaagaggttcatagcatccttgtcaccctttgcctcaaagatccccaaagccttcataaagagttcttctgcttgttgatagtcatttaaccgggttagcaaagaacctaaatcataataattgtttactttatctgggtgctcatcaattgcttcaactagtttatgaactaatttttctgtttcctttttcttaggatcacgaaaaccttttttctctgtcattaatatcacctcttaaatcgtatcagtcggatcaaccttgctcttgtgaaggtaagatgtatcattccacttttcaagttcaaaatgacgaccatcattagtaataagaatcgtcgttgatgtattgcttagtccaccacgatctttcaagtgagcaagcggtgttccaatcaatgcattaatggcagcattcaaggcagctccatgtgaaatcacgagaatattaccattaggatactggcgacaatactcttcaattgctgcacggaaacgagcgattacttctagaaaactttctccttctactaatgattcatcatatttatcaggatgatgacgaaagttttttaagacttcaggccattttgccgcaacatcttcaaaatgcattccctccattttgcctaaattaaattcttttaaccggctatcaattgttaatgggatttctggattcaaatggttcaataatgcctgagctgttacgcgcgcacgctttaaaggactagtataagcgtgttcaaacggaatcctttgtaaagaacttgctaataattcaatttcacgataactatcctttaataacggtgaatcgccattggcaccttgataacgggattctaaattccattgcgtttttccgtgccggattaaataaacttttgtcatctctgtcgttaccccttttatttactatcttaccagagtttgcggcaattgtttatcacagagttattactttatgtatatttaagaaggcaaaagcgaaattacctctgccttctttaaggtctaaaaatatgaatcaaacgtattgaagctgccggtcatgactgtaagcacgatcaataatcgcgctcccaaggcattcctctccatcgtaaaagacaaccgcttgacctggagtgatggcccgtgcaggatcatcaaattcaactgttaccatttgatcatcctctgacaaatgaacagtaacgccaacatctgtctgacggtaacggaacttggccgtacaatgaaaatcacgcccataacgacttacaacatcatcaacccagtggatatcactcgcttcaagatgagtagcataaagatagctgttttcgtatccttgaccaacataaagaacgttcttcttcatatccttaccgattacaaaccatggctcattactttccttattaccaccaaggccaagcccacgacgctgaccaatggtgtaatacattaagcccatatgctgaccaacgaccttaccatcaagggtctccatattccctggttgtgctggaatatattgactcaagaattcacgaaaatgaccatcctcaccgataaagcaaattccaacagaatccttcttatcagcagtagcaagccctgcttcttcagcaatctttctgatttctggcttagtgtagccagctaatggaaacattaccttatccaactgcttataatcaagttgacttaagaagtaagtttgatccttgtgttggtctttagcacgcatcaagtgcatccggccgttctcatcacgctttacatcagcatagtgtccagtagcaacgtaatcagcacctaattggttagcatattcaataaaagccttgaacttgatctctttattacaaataacatcaggatttggtgtacgacctttcttgtactcagcaatgaaatacttgaaaacccgatcccagtattccttctcaaagttaacagaatagtatggaatcccaatcttagaagcaacttttgctacatctttgtagtcttcagtggcagtacaaacaccattttcatcagtgtcatcccagtttttcatgaagacaccaacaacatcgtatccttgaagtttcaagagaagagccgtcactgaagagtcgactcctccactcattcctaccaccacacgtgtatgactattatcagccattaattatcaccatcatttcgtatagattctggaataatctacgattgaaggtcgcatgcatccagtgataaccattgtaccagagtatttcaatccctgcacagtttttatttagtgaatatttgccgggcaaccatttcatctaaaatatagtgatattgttgaataaattcagctgcgcgttggtgattaaaaatattaatttttcttaaaccatttcctgaaagagtctccattttaaaaccgtctaaatcactgttaattaaaatccgaagacgggcaaccggtttaaatgggttatcagtatcgagacttcctaaatattcaaagtttccccggttagtctgttcaaatcccaaatcaagtaaagcatattttttatctctgggctaattgtgtatttatccttatcaccagaaatttgtactgtttttgtaaattccattttaattgtccccattaattttctttaggttttcaacggttctaacaatcgtagcaattaactgatcaatatcttcttccgtatttaacccaccaaaactaattcgaattgattcactaattcgggggctatcagcgccaaacatcgctgttaaaacgtgagaaggttcaatactacccgctgtacatgcagaaccaccagagactgcgatgcctgcaaggtctaggtctgtctggataacataagttgaaattcccttaaaccataagttaagcacgtgggttttgttgatttgtccattaatttcaaaatcaacattattttccttaagcgcattaacgatcttttgcttaaaggcataataacgatcacggcgttcttcttttacctccggcgtgtttaattctaccgctttagcaaaaccggcaattccaggtacattttcagtccccgcacggcgtttagtttcttggtccccacccttaataaagcttggaaaactaatgccatcacgacgatataaaaatcccatcatctttggcccattaatcttatgggccgatgttgaaagcatatcaatatgatcagctttaacatcaattggcaacagtccatatgcttgaactgcatctgtatggaaccatgcttgatggtctttcaaaatttcaccaatctcatggataggcatttgactacccacttcattgttttccatcataatggttactaaaatcgtatcatcacgaagagcggccttaaaatcatcaattgagatattaccattttcatcaactggcaaataggttacctcaaagccatgttcttctaaaaaatggagaggttttaagactgcctcatgctcaatggcagttgtaataatatgcttaccaagattctgccgtttaaaagcagtttggataatagcagtattatcactttcagtcccccactggtaaagataatctcattatcatcagcattaatgctttgggcaagaacgtgacgactatcttccattacaagtttggcatgacgcccataagagtaaccagttgaggcatttccccatgattcttgcatttgtttagtcacttccgcaatcacttctggggtcattggggttgttgctgcattatccaaataaatctcactcacgagtttttcatccttccatttacttatctaaatctgcaaagagctgaagaagcatgtttgcagagcgttttccggcatcaataataaagtcgtcaaaactaacgccggcatcttcatcacctgtatcagacattgcccgaactaccacatatggaatttggtggtcagtggcaacttgtccaaccgctgccccttccatttcactagaaagtgcatcagggaaattattcaaaatctttttaattgcttctgagcttgcaataaattggtcaccagaaacaattaatcctcgttttacatttaaaccagtcttttcgccggctttttctaaggcttgtccccattgatcagaagccttaaagcgcggttctttccctgggagttgaccataacggtaattaaatgcagttgcatcgacatcatggtaggccgtttcagttgaaattacaatgtccccaacatgtaagccttcaccaatcccgccagctgatccagaattaatcacaacatctgcctcacaatcggtaattaaatgttcagtagtaatcccagcttccactttaccaattccagattctactaatacaacgtcttgattactgatcttaccgaaaaggtaggatttacccccgatttccttttcttgtttatcagataacttcgcagttaattctttaatttcttcaggcattgcacaaataattccaaatcgcatatttttctcctttttatccaacataaaatagtattaagtaaacaataataattgccacaatcaaagcaatgattgcaatatttaagcgacgcttcaagcgcgctgttttttctgccactgtttcgtcatgacgctgactagcaactgcttcgcgactataaggtcgatcagttgtattttctgccgcttcattaggttgttcagtctgacgttgctgttgacgatattgactacgtgacatacgtgattgttgctcatcttgttgtttattatccacggttgttcattccttgccagtaatagattgccatgattgtcttagcatcttcaatttcgccttgatcaatcatttcaagcgcttgtggtaaagttacttcttttaacatcaattgttcatcttgatcttgcggcagctcgttgctaacccgttttaatcccgtggccaaataaagagtcatgtattcatccatacaaccaacagaagtataaaatgaagaaatcttttttaaacttgttgcttcataccttgtttcttcatttaattcacgtttagccgcatgaagagcattatcagcatcccgttggtcgagcttccccgcaggaatttcaagggttgttttcgcaattggtgcgcgccactgtttttcaagaatcattttattatcagccgtcaaagccaaaatcgcaattgctggtgcatggtggacgatttctcgttgtgttttattaccatgtggggtgataacttgctgtacttcaacatcgattaaatggccgtgaaaaactgttttactacttattggtcgctcttcaaattccattagaacccatccttatcttaaaacacgaacatgtgctgcttgtggtcccttttgtccttgaacaattactaatgagacctcttcatcagggtgaaggatacgacgacgcgttccttcaattccactataatgaacaaaaatttctccttcgtgaggaactgtaataaagccccatcctttttgttcgtcaaaactttttacttttcctttgagcatttttaccaactccataataaaataccaagcaacaagtgtcacttggtattttacaccgcttaaaaataattgtcatttactggataacgaaaaccagtttttttagagattattcttctaaaccatcttctgctgtttcagggaaattttcccgaacaatcgcagcacagcgagcacataattcaggatatgctggatcactgccaacatcttccttaaccatgcgacaacgagcacaagtttcaccattagcagttgtaaccttaactgctaccccatcgttgtattggtcagcatcagcaggcgcttcatcagctggatggacatgaagagcagaaacccctagcaataattgaatgttttcattaagactatcaagtaattgcttttgatcatcggttaagtaaagatcaacttgagcttcaagtgatttaccgattagcttagcattccgtgcctcttcaagactcttcagaacatgtgaacgtacttccataaagtcatcccacttgctcaatagctcttcttcgccagcgaatgtccgtggatctggaatttcagttaattgaacaaaatcttctggttcattcatgtagctccatacttcttctgtagtatgagggagaattggcgtaagaagtttaacaagtgtcaaaaggatatcgtagaagacggtttgcattgaccgccgaacttctgaattttcagcctcaatatagagcacatctttggcagtgttcatgtagaaagctgaaaggtcattgtttacaaagttgatcaatgccttataagcatcaaggaaatcataattatcaaaatcttcccgcattgtctttaagaagtggttaagtttaaccaacatgtacttgtctaccgattgtaacttctcataagaaacggtattttcttcaggattgaagtcactagtattagcaagtaagaagcggaacgtatttctcaacttacgatatgcttcagaaatctgttggaatgttcccatcgatacacgaacatcagctgaagtatcagcactcattacccataaccggataatttccgcacccatttgttgaacaaccttatttggatcgataacgttaccttgagatttactcatcttgttaccgcgcttatcaagtgtgaacccttgagaaacgatttccttatatggcgcatgtcctgaacatacaacactggtaatcaaactagagttaaaccaaccacggtattggtcagacccttcaaggtaaaggtccgctgggtatgttaaataatcacgttcagctaataccccttggtgtgatgaaccagaatcaaaccatacgtccataatgtcagtttccttagtgaacttaccattaggagaatgttcattagtgtatccttctggcaaaagatcttttgcttcacgttcaaaccaaacattagaaccatacttagcaaataattctgctacatggttgattgtttcttcttccatgattggtgtgccatcttcagcatagaagattggtagaggtacaccccaaacacgttgacgagaaattacccaatcaccacggtctttgatcatattgcgaagacgaacctttccccattctgggtggtacttaacgtcttctaaggcgtccaaaatactttgacgcatcttttcaattgatacaaaccattgatcagttgcccggaagatgattggttgctttgtccgccaatcaaatgggtaactgtgttgtaatggctcttgaagaagtaaagcattgttttcttctagcttttgaagagatacatcatcagcatcttggtagaataccccttcaaagccttcaccgttttccttagttaaaacaccttgatcattgattggggcaaaaattggcaagtcatactttttaccaaagttgtaatcatcatccccatatccaggagcagtgtgaacaaggccagtaccagcatcagcagtaacataatctgctaaaccaacaagaagatcacgatcaaggtatgggtgttgagtagtcatcccttcaagttcttgacccattaaatgatcaacaacttcataatcttcccacccaagtttttctgctaatttctcaagcaggtctgttgcaacaacaaatttccggtcatcatttgctggctttacaacagagtaatcaaactttggattaaccgcaactgcctcagaagcaggaacagtccatggtgttgtcgtccatacaactaaatatgtatcattatctaaacggcctttgccatctttaatttgctctacgaagaaggctgttttagcaacaacatcatgatattcaacttcggcttctgctaaggctgattctgaagaccatgaccagtaaactggcttcttagcttggtataatagacctttcttagcaaattcaccgaatacccgaatttgagcagcttcaaattctttatcaagggtaaggtatggatgatcccattcaccacttacacctaaccgcttaaagtcagtccgttgcttatcaacttgcttaagggcatattcccgacaaagatcacggaattcagttaagctcatcttcttacggtcgtaaccggacttagtcaattggtgttcaattggcaatccgtgagtatcccaaccaggaacataaggtgcccggtagccagacattgacttatagcgcacaataaaatctttagaaatcttgttcatagcgtggccaatgtgaatattaccattagcatatggaggcccatcatgtaaaacaaaagtaggctttccttcatttagtttttgtcgtagttcataaactttattttcttcccatagctgttcccgttgtgcctcagttacaggtaactttccgcgcattggaaatttagtacggccaaggtttaacgtatctttaacacgcattgtaactacccctttcattaattcttgtattttaataataaaaaagcttcctcccattactgggacgaagcttcttcgcggtaccacccggatttaaaactttaagattaaagtttcctcatgtcattagataacgataatgaaccgcctcatcctaactaactcaaatgaggtactccgagatgatcaggaatagttaaacattatcaacctctcaccaattgttgactcgcttcaacgttatgataattattccaattctcttcaacgattttattaaaatacgattctagtgatttacttgttattatcagggaagacaacaacagtttcaggtgcatctgatcctttgtcatcgttaacagctgttggttgtacaggtgtactctcttcttctgtttgttcagcagaagcaactggctgttctgattcaacaggttgttcttcactagcagttgttgcagttgattctacactggttggtgaactgctgtcaagacgactacctaaaattttttcaatttcgtcatatttactcaagtcatcattttccaaaagcttgtcccattcattactcttaatgacttctaattgagattcaagcatgacttgaagccgttgacggaagatccgagtctgtttacgaagatcattagtttcacttgttaacttcttagtagaattagcagcgtcttcaattacttgatttgacttatcattagcttccgaaacaatatcggttgcttgcttttgcgcttcacgaatcataatatctgcttcacgcttagcattatttttaaccttatcagcggcctcttgagcaactaaaattgacttatttaaagaatctttcaagtcagcaaagtacttaatcttgctatcgttagcccgtacttgctcttgtaaattattattttcagttattaattgttggaccgtttgtgaaacttcctgaataaattcttgaacttctttaggattataaccccgcatcttagtattaaattgcttattgttaatttgatcaaccgtcaaactcatgagtaaattcctccattcaaattacgcatttacaactgaaatggtaattctttctttgtctttttttgttttcccattggtcatatcgattctgaggcgaccaccatgacgcacagatatcaaatcatgaaccacaatttgataatctggacaatcaatctcttcccagtttaatcgaacttgaccatgctctattaattgctttgcccggtttcgtgaataattaaagcctgcagctatcacaacatctaaccgtagtgatgaaactgttgtaactatcggtacccattcctctttaggtgttaccactgcttctgttgcgatcggaatccatttaaccttaattcggccaacgtgctcaacgtttttccgtaaatactctgccattggtttcgttacgatcacttgccaatgcgctccatcagttaaaatatcaccaaatgcattccgctccatcccttcaccgattaatgttcccataatttgccgatggtgaagttctgaaaacttaacaggatagtttatctctaaagcctgtaaagtaaagtcttcgatagagggttcataataaggcggataaattaaaactcgttgcatttctgcgccttgccaaccaccatacattgttattttaacattgttatttcgattaacaatcgtttggataataaaacgttcacgtggatttaaaaaaggagtgaggacaggacgatattgaccttctgcagtggctacccagtcatttgcttggtcaataagggtggcttcatccggacgaaaatgttgtttaatattatcttcgctcaaatttacttcctcttagtattaattaaatgattgctgctatatgtgctaatcctgcctgaacaaaatatagtacaaggatagcgatcatcggcgcaaaacttatcccccgattggaggaataaaatcaaaccaatgcatataaggttttaccaaccgattgataacatcaccgagtcgtgaattacgtgcatttggaaaccatgacataatgcaccacacaactatcactaagatataagcatcaactaattgattaagagcccataataaaaatgcgatcatattaactccttttagtgattaaaatttatcaccatcattttttagattactcgttaaactacctgagatttcatagtttttagggtgcagaggaaaatttcctttccgatccgtttcatttcaccatcaattgcaaaaacggtgccatttaagaagtctactaaccgtgctgcaacatttgtatccatttgagtgaaattaacgatcaccgcatgtccttctaataattgggatgcgatctgctttacatctgcataaagacggggttcgtataaggaaatctgactcattttgttaagacgcccgctattaattgaaactactttgttgcttgtgtttgctggcgttgaaacttgttcactcgtttcatagagaccatcttgttcatcaatgtcttcttcaccaaataggctttttaaaaaatttgctgccattgtattaccctccttaataggtctaaacagaaaaaggcggattaaaaaatccacctttttgctaaattatttacttacgacgattcttgaagaacggtggagtcgataagttagtatcatcattgtcatccgtattagccgcatcatcgttaaatacgttaaattctggcttagtaacgtgagaaaattcgttatcagaatttcttgattggttacttgtatcggctgttggatcattccaaccatcaaaaggatctcgttgctttggttgttcttcttgcggaataggccgagttactcgtggtgcttctttttccgctggcttttgttgttgaattttctttttcttatcaattccagtggcaattacagtaacgcgaacttcatcgcccattgattcatttaaggacataccaaatgaaatatcaacattagttccagcagcttgtttaatcacatctgatgcttcttgagcttcaaacattgataagtctttaccaccagtaatatccatcaagacatgttgagccccatcaattgacacttcaagtaatggagaagaaatagccttcttagttgcttcagtagcacggttttcaccagtagaagcaccaaccccattaaggcagaaccttgattagacatcaatgtcttaatatcagcaaagtcaaggttgatgtaacctggggtaacaattaagtctgaaataccttgtacaccttgacgaagaacattatcggcttctttaaatgcttccatcattggcgtcttcttatcaatcatctctaataaacggttattagcaacgataattaaagtatcaacatttgactttaacttttcaagtccttctgcagcatagcgtgctcgacgaggtccttcaaatgagaacggacgagtcacaacaccaacagttaatgctccactatccttagcaagcttagctacaactggggctgctccagtaccagttccaccacccattccggctgtaatgaagaccatatctgcgccttcaagagcttttttaatttgttcttcactttcttgggcagctttttcacctacttctggatttgaaccagcacctaatccctttgtcaatttaggtcctaagcggatcttagttgttgcttgagaattatttaatgcttgtaggtcggtgttagcaacaataaagtcaacaccttgtactttttcagtgatcattcggttgacggcattaccgccagctccaccaacaccaattactttgatttgcgcttccgcaaattggttgtcgttagcgaacgtttcgttatccatagcagtattcctccaaattagtcaaataaattattaaaaatgtttttaaaccgattacttaggccattttgctttttcttctttggcgctggctcttcagtaactggttgctgctgtgcttctcgctgtgaacgttgtaatttatcagatttttcagtccattgttgacgtggctgattaacaacttgtcttttttcttcatgaggactcttaatcgtatcaattcgttgaacagtttgcttaattaatcgatcaatatctgataactgattttcatacatccccaaagctaaactaaccgcatagcgagggtgacgaatgcccatttgttctggaacattcaccttaatattaccagtaaagtactgttcagcaagttccttaactcctggcagagcagccactccaccaatcaagactactcctcccggtaattcaggggcatgaatagccttaagtttatcctgaatacgatcaaaaatttgccttactcgtgcttcaattatttctgataaatactgctctgaatattggacaggatcattttgaccaacaacatcaacgtcaacttgaacatcttcatcggctaaggatgccatagcatatccatgatttagcttaagttgttcagcgttttttaatgatgtattcatgaccgtagaaatatctttagtaatgtatttcccaccctcaggatcaacataagtatactttaattgatgatcatgaataatactggtcgttgtttgaccaccacctaaatcaataacaacagtaccaaaatcttgctctccgtcattaaggaggttaaagtctgttgcgatcggcgtaataacaaaatctttaatgtcataacctgcctgttgaactgccttttttgtattatgaataatggtcttaggtcctgtatacaaggtggccttcatttctaaacggacaccaaccattccacgggggtccttaataccagaaaagccatcaacagtaaattctgttggaattaaatcaattatttcccgctcggggggaatactttgcgtcaacgcttcacgagcaacgtcaattacgtcttggttaacaatctctcttgattgtcctcttgttgcaatcgtaatcataccgtgtactcgttgcatttgtaagtaatttgccggtaagccaactacaacactttgaatctctacgttggacttttcctcggcctgtgctaccgccgccgaaattgcctgggcggttttatcaatgtcgacaataactcctcggtttaatcctgccgatcgttctacaccaacaccaataactttcaactgacccttaacactttcacacaccagtgccttgatcgaggtggttccaatatctaatccaacgtatacttctgaattattcattctaaaaggaaccctcctaagactatcattaattaaattaattgtattttaacctatataagaattttaccacagataaacaatgacaaaaaagggaattatcaaggtttttcacaaaatcatttatccttagatccatagtcataagaataagctccgacttgaagatctataattcccttatttttcatacttgctgcaattgcagggtaatatcccattttatccccgatagtatttaagtcgccataaactgtattaccatcacgcatataaataataacgcgatctggatactctttagtgggttgataactcacacttgaaataccatttcttattgccagtttcagctttcctaactgagcggccgttgtagcaagaacttttttatgaccatcaaaacgtttataagcaataccattatcagcattttttgttcgctgtaattggccgtcagctaaaacagcgtatgtatcattattcatcaccgctgttcctaaaagcgcattttcttttacagatatttgcagagactggggaccggttaccttgatccttaaatcttttatttgaggatttttgcgaatagcttgtttagtgagttgatgacgagcaagataaacgccccaaataaaccgtcctggataaatatttgcatttttttctacttgctcttttgttaagtcatgattacccgttacatgaagcgtggtaattttgcttaagggagaaataatataaagcataaagaggagaatagcactgaacaatacaactaattttaagactcgctcgccgttagaaacataacgcttaatcttaatcccgcgaatcttattaccaacatgcatttttggaggcttctttttctgttgtcgctgttgggcagcagcacttcgcctttctaattcagttaaccgctgtgaatatttatgatgctcaatcgcagatctatcatccaacatctctcctcctccttcctaggctatactttatttttcgtgttcatcaattgccttatgtaagatcttaattagtctatcagcggcatctggccgacccatcttttcagcagcatgcgccatctctttacgcacttcttcatcttccataatcttatctgcttgagtcaataatgcccgggcatctaacttatcttcagtaatcatcaagccagcgttattcttaactaaagcttgagcattctttacttgatggttagcggtaacatacggactaggaattaagattgtaggaactccgagtgccgttacctcagcaatagtggttgctcctgcgcgcgatactaaagctgccactcgaggcatcttagccggcatgtctttaatgtaaggaacgactttaacattatcagctggtctaatattattttctgcaagttgcttttttacatcatcataccgtttttgaccggttgcaaagataacctgataaggacgcttattgaattctggaatagcgtcgacaactgttttattaatttttggtgctccttgacttccccaaaaatcattaaggttggaatatcatctttcaagtcataacttgtccatgaaaagtcactatcttttttagcagctacctgttgagcacgaggattacctgccattgtaactttatcagcagggaactgactgcgtgcagcttcaaatgcaattgcaatttgatcaacataccgacttaaaaacttgtttgttacaccaacaacactattttgttcatgaattacggttgggatatgtttctttgcggcagcatataggacggctccacttacatatccacctgtacctaaaacaacgtcaggcttaaactcattaataatttttttagcatgatgaacagaacttaagaaaagatagattgtcttaaaattttcaagagaaagagaacgcttaaagccctgcatatgcattgtttcaagctcaattccggcatccggtacaattttattttcaaggccacgggttgttccaacatataacacttcagtatctggatcaacctgctttaagcgttcgattaatgctaatgctgggtaaatatgaccaccagttccaccacctgataccaataaccgcatcttattgttccttctttcctgttaatttttcaactgcttcaataaatttatcaccacgaacttcaaagctcgggaattggtcccaactagcattagcaggcgagaggagaatgacatctcctggttcactcagcttccatgcttctggtaccgcagtaattgcattttcactttcaattactggaactccagcttgattccccgcatccttcattttatctttacattcaccaaaaacaatcattgccttgacatgcttcttaaagtaaggaaccaaccgttcaaaggtataaccacgatcaaggccacccgccaaaagaactactggacgatcaaagccttgcaaggcaacttcagtagcttcaatatcagttgattttgaatcattgtagaaaagccgttcttggtattccatcacatattgtaagcggtgacggactccactaaatgttgttaaaactttctttattgcatcatttgtaacaccgcttaattttgccgctgcaattgctgccaatgcattttctacattttggggaccgatcaatcgaatatctttggttggcataacctcttgtccacgccagtaaatcattccatcttctacataagatccttcatgactcttattgagacgagaaaatggcacaatggtagcttgactacgctgagcaatcttttgccattcatcacgatcccagttaataactaagaaatcatccttggtttggttccgggtaatattaagctttgcattaatatagttttctcgtgtcttatgatagtctaaatgattagaaaaaatgttagtaataattgcaatatgcggatgaattgttggtgctcctaataattggaaactagataattccgtgaccaatgtatcgtctggccctaaatcctcagcaattttactaaaggaaattccaatattacctgcatatttcacttgatattttgcattttcagcaatcattagttgagttaaagtcgttgtggtagtcttcccattacttccagttacacttacaaggtgaccatcaaaaatttgccatcctagttctgcttccgtaataataggtgtcccctgcttaacgaatgcagccactaatggattatcataaggaattccaggattttttactacaatatcgaaaccttcattagctaatgaaatgggattatcaccagtaattaccttgattccatcagcttctaaatcatcaacaatatcattatttttaggagttgctttatcattagcggtaacattggcaccaagttttaccaataagtgagccgcattaatgccactaattccgaaacccattacaagaacttttttaccttgatattcatcaatttttttcatttctctttactcctaacctactaataagattgttgtaacggcaataattgcagcaactaaccctacaagccaaaacacaatatcaattttccattcactccatccgttcatttcaaaatggtggtggattggggtcatcttaaaaattcgtttaccggttgttttgaatgaagccacttgaagaatgacactagcagtttcacaaacataaacaattccaattactaataaggaccattcatgatgtaataacaatgaaacagcggctaaggatgccccaattgctaaagatcccatatcacccatgaaaatcttagcgggcttatgattataagggaagaaacctagtaaagttccgatcattgctaaacagaaaagagcaatttcaggataacctggttgattgagatttactaaagcaatgattagataagccgcaaaagaaataatggaaagaccacttaccaagccatcaagtccatcggttaaattaacagcatttgaaaagccgacgatccaaaaaataataaacaaaccgtaaagccaaccaatttgagttgttccaaagcccatttgaaaaccttcatgttggtaaataactgtaaagaccattgctgctaatacctgacatagcgccttttgccatggtttaaatccttcattttgatggtggaagattttaatactatcatcccacatcccaatcaggccataaacaaccaggacaaagaggagtgcccacagcgtattcgtaattaacccttgccaagcagcaacccataaaattgttactactgcagagaagatgaacaataatcctcccattgttggcgtcccagcctttttagcatgccaggtagggccttccttacgaatttgctgaccttcttttttagcccgaaaatatttaattaacgtgggcatcaataaaaacgtaattaagaatgaactaagaatagtcaaaactgcacttaagaaattcatatttacctccaattagtttctctgctagtttttagcttcatattgaacggttaaagttgttccacgcttaatagttgtatcaggtaaaatactttgctgagtaacatagccgtttccattttcttttacttttagcttaaggaccttagctaattgttgaacatccgcagaactccatccagaaatatctggcattttatactcgccaccagtatcaagaataacatgttgatctgttaacacttgttcgtctggaactgctgattgttgtttaactttcttgccagaacctacaacaattacctgcattcctttacctgataattctttattagcttcatcgcttgcttgaccaacaacattaggcattgtaataacctttttcttgaccttttctgcaactttttgttggctcaacaacattttcattgtcggattaaagacgctggcaatttgtttggttgctgtttttttaaggttttgcggttggcgaagggtgacatacataatatactttggatttttagctggtgccatccctgcaaaggagtaaaggtagtttgtatcaccagttgaataaccatgagcaccaccaatttgtgcagttgcggtctttccagcaattcggtaacccttaatttggtaatcatggccaaggcccttttgatcataaacaacgccttgcatgtaaccaaggacctttttcgctgtcgatgcttttattgggtgtccaacaactttaggcttaaccttttgaatcgtctttccgctattaccatctacaactttgctaacaatgtaaggcttcatcattttaccattattgccaatagcactaaacgcttgcatcatctgcatgacatttacagtaattccctgtccaaaagcggtatttgcctgagcaagaatccctttgaatgaagtataaccattaacctcgttactcattccgataacattaactttttttaacaggccaaatcgtttaatgtacttcatccatgtctctgctcccatgtcctgctctacatgagcaaacccaacattactagacatatcaaaagcatctttataggaaattgttccccaaccagaacttgaccaatcagtgatttttccgccacccatagcccatgttcccgaattaaaggtcgcattaggattaaaatgtccggtatcaatagcagcagctaatgacaaaattttcattaccgaacctggttcataagcatcttgaactaacatattccgccaaacaggattattttctgcatgaagagttggccgttgcgtagcggcaataattttacctgttttagcttccattacaactgcagtcattgcattggcgttagaacttttataaactttattaactttattttcgagaaaatgttgggtttgtgaatcaagggtagtgtagatattatctccattgacggcttttttagttacctgcttagaattagcaatttggtatccatagacgtcctgtttatcttttctcaacccgtttattcctgtcagttgtttattaaagtagccttctaagcccaattgtcccactaagttggtctcttcagttccattatcatttttaactttaggagttgccatcccaattatttgagaagcaaattcgccttctggatattgacgtgctggagtcgcaataaaattaattcctggcaagtgccggttcttgatcttctgcattgttgaaacagaaaggttgcttccagcatttccaaattcaacttggtaggcttgcccttttggtttaagaatcttttcaatttgctttggggtcaggtcaatatactgtgataataccttggcagttttttttcgatcttttacatataacggtttaccatcagaagacttttgggttcgatccaaaaccgcatagagggtatatttacttgtatcagttgccaagggattcccttctgaatcataaatatcaccccgtcgcgcttgaataattcgctgctgggtataaatttgttccgcttgtgaccgtaagttaacatgttgaacatccttatttattgcgatatacgcaaaacgaacgataaataaggtaaacaatccaaccgtgattagaaagagccatttgccaaaggtccctcggttttctctatgtcccctatttttcgttcgttgtggcttcttattcattatttattaacgttccttacatttgaatttttatctgataatccatatttatgtgctgctgatttcaaatgcgattgagtcgtcaattcagcgatttcttgctgcaaacttgtattactactttttgccttagtaatttgagtttgggtatcctgtaagcgccgttgctgattattaatactaatttttgtagaaagtaagctaatcattaagcatagcgtaattaagctacctactgctactaaagatctttcaaattttgaccatctaaccggacttggagaaatttttagttgttgataagtcttttttcttggcgcttgctgcggttgttgctctcccgccagttgccttgccgcatttgaaaccataattctgtcactttccttctctaattttctcgattatcctcaacttggcactatgcgcacgatgatttgccgctaattcttcctcactagctacaatcggctttttattaattaatttgaagtttggttccattcccgctggtattactggtaatccctgcggtacatccccacttaatgaagtcttttcacgaaacattgtctttactaaccgatcttctagggattggaaggtaataacacttattcgtcctccaacatccaacaagtctaatgcttgctctaacgattcctctaaagcacctaattcgtcgttaactgctatccgaatagcttgaaaactctttttcgctggatgaccaccatgacggcgagctgctgctggaattccctctttaatcacatcaactaattcaaatgtcgtctttattggtgctatctttcggcgttgttcaatctttctagcaattgacttggcaaatttttcttctccatatcggtaaagaatcttaacgagccgttcatatgaccattcgttaacaacttccattgccgacaatttttgttcctgattcatccgcatgtctaagggggcgtcatgctgatagctaaaacctcttttagcatcatcgaactgtggagatgaaacacctaaatcatataaaattccattaacatgttttacattatagctatccaattccgcttttaagttgcggaaattatcttcaattaatgttaatttttgttgctctattactgtttttaagtgttctttattgtaattaattgccgtctgatcttgatcaaatgaatataggtggccatcgacgagctgttgtaaaatagcttgcgtatgaccaccaccacctaatgttgcatcaacgtaggtacctgttggttgcacatttaatcctgctacggcctcctttaaaagtaccgttacatgtttaaattctgccatcaactaaaacctccattaaaaatcaatattaagatcttcagcaatctcatcaaaattatcagctgtttcgcttgtaaatttattccaccgttcagcgctccagatttctaagcgattagacacaccaacgattacacatttcttttcaagtgaagcatgagttcgtaatgttatcggaatattaatccgtccttgtttatcaatttcgcaatctgtcgcagcggaatataaaaagcgtacaaatgcacgtgcatcacgctttgttaatgggagcgcctttagcttttgttctaaaatcgcccattcatttaatggatatccaaacaaacatccatctaacccccgagtaacaatgaagtgtgcccccaattgttctcgaaatttggcaggaataattagtcggcctttggaatcaatagtgtgtgtaaattctcccattaacacgactaatgtcctcctttaccacgttataggtcaagtctaccacaatcccccacttctcaccacgtaattttgtgaattttaccaaaaagtaatagacaaaaaaagtgagcagaaaattaattttccaactcactcaatatttttatatcaacggtaaccatggtgaaataattaagctaccaatatatataattaaagcataatatgccgaataccgccaaaatactggccagtaacggcgataaatgaattcatgattgtgaataatttgtaaagcaattaatagcagagctagaatcatccataaggcaataggataagctggccaatagaatccaatattaaagattatcagaatccataaaataattgtccatccccaccataaatgctttgtttttttaggatgatgaaatattcgtactaataatcgttctactatcccaatcactaataataaaataatctctaaaattataacttgaatactaaccatcaaccttttcagtccccttctctttaaataagtaatttaagtttaacataatctaaaactagatttgaaaaaggcattaaagatgcgttacactactattattgataaaaatggaaggatggttaataatgcagcgaaaaaagaaaactcgtttccaaaaaattaccatggttgctatttggctcatgttaattgcaatgcttggttctttaatctttggagcagttgcatccttaaacttaatttagcctattaaacatccatgtaatcggaataaaaaaagatcggagaaaaatttctccggtcttttttattcctcacttttttgcttataaacttcccgtggttttgagccattagctggtccgataaaaccgcgttgttccatatcatcaataattcttgctgcacgattataaccaattctaaatcgccgctgaattagcgaagttgatgctttttgttgatcaaccacaaaatctaatgcttcagggaataattcatcttcctcttcagcttgctcttcttgctcaatttcatcgtcagttacaaccatattatcgtcatactcagctactcgctcgttttttataaagtctactactgattcaacatcatgatcagaaataaatgcaccttgaatccggactggcttattttgatcaattggttcaaataacatatcacctcgaccaaggagcttttctgccccattagtatcgataatagttcgcgaatcaaccccactagaaaccgcaaaggcaattcgagaaggaacgttagccttaataagccctgtaataacatcgacagaaggacgctgagttgccaaaatcatatgaataccagcagcccgccccatttgtgcaatccggacaattgcatcttcaacatcatgagaaacagtcatcattaagtcggctaattcatcaacaataactaaaattaatggtaggttagcttgaacttcatcaggatggtcatcattttgttgtttgaccaacttattatatccatccaagttacgaacaccgaattttgcaaacaattcataacgacgctccatttctgcaacaacttttcctaatgcccgagctgcttttttgggttcagaaactaccggactgagtagatggggaataccattataaacactcaattcgacttttttagggtcaatcattaacatctttacctgatgcggtttagcctttaataaaatgcttgtaatgataacattgattgcaacagacttaccactaccagttgccccagcgataagaaggtgtggcatcttagttagatcagccattttgatatccccagtgacactgcgaccaagcggaacttccatgggattatcattactaggagcattttcgaccatatcgcgaaaaccaactgttgcaatttgctggttcggaacttcaatcccaattaatgatttccctgggatcggcgcttcaatccggatatctttagccgcaagtgcaagtgccaaatcatcagccaaatgggttattcgactaacctttactcctactgctgggcgtaactcatatttggtaacggaaggacctaaattaacattttcaactgttgcatccacaccaaaagattttagagtttgttggagcgttttggtgttctttttgatattattcaaatcttcctgctgatctgttgcttttacttgacttagcaggctgactggcggcaattgataatcattgtcttctttagcgtcaattcctgcaagtttaatttccgcatcatcacgttggttcgagtcctgatcatccttacgtccactctgagtttcttccacctgactttcacctgcgaccctaatagttggttcaacaggatcttgagcaggcatcgctggagaaactggcggcgttgacgttggctctgctgattcttggtcagcaaaaaaatctttaacctgccttgatgctttagcaaggggcacgctaatcgatggtaccgtagttgtcttggttgctctctccgttctctttttcattaattgatcgtgagcattagccatggctgctccagattttttaatgccaatcccacattttactagaaattcgcgccatggtaatgcaaaaaagacaataattccgataatcattaacaaccatgacaataccgctgttccaacttctgaaattaaaatattacttccattatataggtaagcaccaatcatccctccaccaaccggaacagttgaatcaccgttaaaaatgaccttactaagactattccaagtagttttgattacctttgcatgaagattcagacgctgaaacattactgtctgaagccacattaataaaccaatataggcaataatagttcctgcaatccaacgttttttgaaatgcggacgatgcccatacaatgcaaaacataatccataaagaaaaacaataatcattgcaattggaaaggatgaccctacaaaaatcttaaaacagttatcgagaaaggttcctaatgctcctaaattaaataagccaactaacattaagaggcaaacaattattcctaatagattatccattaatcgatactgttgttttttccctcttgtccggcgggatgatgccttttttcttctcgccatcgcattattgcctccttaaggttactttaatttatcgaattcatatttatgaacgcgggctaaattaggaaaactctgttgccgcaatacctcataaataacaatcgctgcactattcgataaattcagggcccgaatattattatcattttgtggaatccggatagcattttctggatatttttgcataaaacgttcgggcaagccagttgtttcttttccaaataggaaataatgatctccttcacccgtataatcaacatcactataatcatgagtggcaaacttagaaacaatatataaacggttaatatcaggaatagtcttcataaatgaaggtaaatcctcatgatacgtgatctttactttatcccagtagtctaatccagcccgtttcatatgcttatcatcagttgaaaatcctaatggcttaattaaatgtaattcagtatttgttcccgcacaagttcgtgcaatatttcctgtatttgctggaaacaatggttcaaacaagacaatatggtttgtcataataaaatctccttaataaaataaaaaaagcagggtctcggtgtgggcacggcgaaacgctgctttaatgaagtactccttgataattaccaacgaaacacttatattcgatgtcaattatcaaacgatttcctataataatttagcactaatttagtaatgttgcaataattaattagcttttttcgcaattaataagctgacatccaccgtaattgtttttaattgggttaattcttctttagataatcttttagcgtttgctccccagtgtaaaggcgtcatttccagcattgcctgttgtaaaccgtctggaattctaaattggtaggttaccgtttcaactttactatgaggataatgccggttaaataactcgattactcgtgaattatcatagtggtaattacgttctcctgtttcatataagaggtgacgtaattcgactaagtagttagcgttaggaattaccttaataagggtcccatcttttgttagaacccgtttaaactcttgataataagatggagaaaacaactctaatatacaatcaaaactctcatcattaaaaggtaatttacgtaaatcagctacacaaaaaaatgcctttaacggtaactgagtagcaagcgttatccctggtttcgaaatatcaaagccaatcatcgtatcattacagttagcacggattgtttctaattgtaataatggtgttccttccccagttcctacatctaagatccttaaagattttgaaggtaagaatttactgatattttcaataattggcttaaatagtcctgcatttaatagctgacgacgagattcaaacattgagcaatcatattcagtattagccgctccattaagaaagtgaagataaccatgccgattaaagtcaaatcggtggttatttccgcaaataatactatttccttcaactctatccattggctgttcacaaacagggcattgaaaaagggcaagattattttttaccatttctcgttgacgttcaacttttttcaacttttttcctccattaacaactaaaaattactaataacagtgtatcacagctagaattacgatgggcaaattgctattatataggtaagcattttcaaaaaggaggaaattgccttgattgaacaatttctaattggaacttatactaaaaaaacaagtaaagggatctacaaagttaccctcgatactgaccaagaaaaaataacgaacgttgaattagcaattccatctcaaaaaccagcttacttacaagttggtcaagatggtcgtatttacgcaatcaaacaagtagatgacaaggggggcgttgcttcttactcattaaatgacgataacgctaagatgctaagcgatgtcttagctgccggtgctcctcctgcatatgtaggcgttgataacaaacggcatttattattcagtgctaattatcatacagcaaaaatagatgtttttaagatcaacgaagatggaacgttaacacaaactgattctgtccttcatgaaggagcaactggtcctgaacctgaacaagaggctccacatgttcattatgccgatctaactcctgataatcgtctagttgtatgtgacttaggaatggatcttgttgtggtttacgatgtctctgatgatggtaaattaactgctgtttctcgctataagtgtgaagatggctttggtacccgtcatatagttttccatccaaatggcaattatgcttatcttttgggtgaactaagcagtaaactagaagtactcaagtataatagtaaggatgcatcatttaagcaccttcaaacgctcaaaacaattcctgaagactggacagctcacaatggagcagctgctatccggatttcaaatgatgggaaatttgtctatacatcaaatcgtggtgaaaacactattgccgtctttgaagttcaaccagattttaccgttaaacatatccaatctatttcaactgaaggagattttccacgtgatttcaatctaaatcaagatgaaaattatcttttagcttcaaatcagaactctgataaccttactctttataaacgaaatccatcaactggtaagttaactctccttcaaaaagatgttagttgtccagaaccagtgtgtgtaatgaagtggaaataaattaatatcaacagcgtgaactggaccctgtcaagtagacaataaattatacaaagtttcttaggcagcttgatgccggtattgtaccggtgttaagctgcctaatttttcgtaagcagtccgtatccacacgtctagccatcaaaaacttagtctcctatactaaaagcaatcttagtacaggaggctttttctatggaaggaaaacacgatattgtagcaccaatttttaagaccaagaattcagtagttaataaggaagaatttattcctcgacccaccgcaaaactacaagctgataacattgaattaacgatctttaagggagctaatcccagtcttgcgactgatatagctaaagtggttattcgttatgctcattaattggcaggcaccggagcatgtttaccttgtttgtggtaagacagacctccgtaaaggaattgacggtttagcgatggtagttgcggaaaactttggattggatttatataataattcgctctttttattttgtggtagtcgcaatgatcggttcaaagccctttattgggatgatgaaggtttcattctgctatataaaagatatgaaaatggtagtttaagatggcctaagaacaaaagtgaagttaaagaactaaagccagagcaactaaatgccttatttacaggtctatccccatttcccgagcgacatattcatacaattaaaccaggaaatctatactaagctctttttaaactgttttagctctgatataataacaaaagtttattagattggaggtgacgtacaatggctgagtcattaaagaaagaaaacgaagcactacgtgcgcagttgaagaaagctcaagaacaacttgaacaacaagcaattacgattaagcaactacaggaaataatttttggaaaaaaactgaagttttagagcaggtagctgatggacaattatcactgtttgatccagttgatgatctgaacttggatcaagagattactgaagcagttaaaacaacaacgactaagatcgtacgtcatcgaccagcgaagaaacagctaactcgtcaagagtttttagaccaacttcctcaagtcgaggaagttgtttctttaaaaacgaccacctgtccagattgtcagcacgaaatggctcacattggaaagaggttggcacgacgggaagctagactaaaagagcctgaattgtattgtgccaacttatatgaggaaagctataagtgtaaacactgtagtcaagatggaaatgataaattggtaactagtaaggcaccaatggctttattaccacatagttacttttcaagcagtattatggcatttatcgcctatttaaaatttaatctggcgttgcctttccatcggcaagaaagctttgtacaagggttgggattacctgttagcgccaagcaaatggcctcgaatattattaaagttagtcaaacgtacttagagccgttgtatcagtatttaagcaatacagttagacaagaaccagtcattcatatggatgaaacaccttttaaagtcgttgatagtcctaaatcccaagactatttctgggtaacgcggacaacgaaagagtttgcccaacatccggttgtagtctttcatcatgccaatacgcgttctggtagaatcattggacaaatagtcggtaataattatccgggtattatcatgtgcgatgggtataaagggtatagtaatcaactctatccgcaagcaaaatttggttcgtgcttagtgcatattcgacgagaatttgtcaaattggtcaaagcactgccaaaaacaatgaaggcgtccaaagcgcaacaagcaataactcttcttagtcaggttttccattcggaaaaccagttgagttatcaaacggccaatgagaagttagtgcagcggcaaatccatgtcaaaccgctaatggataaattttacaattacattagccagattagccagccgattggacagttgcgtaaggcaattcagaacgccatccagttaaaatcacgagtgtatcgtgtatttgaaaatggacaattaccgttaagcaacaattcagttgagcaaagtattcggccatcaacactaattcgaaagaattgtctattcgcaaaaaccgaagaaggtgccaagacgaacgccgtctactatagcttagtagagacagctaaactaaaccagcttaacgtccagcggtacttagaatacttgtttgatcacctaccagagagcaattgtcaagatctggcagcttttttgccgtggtcaaaaaacgtacaaaaagaatgttgcgaatagaaaatccccgtgaagccatcaaggacggttctacggggattttttgtctgtcaataacgtgtcaatatggactgcttacactgcttacctttcaactcatagttaatatccatgctgggcgtactaaaaaaggacatgcactgtattaaacaatgcatgtccttttactatagcgtggcaacgtcctatcctcgcagggagcgatcccccaactactttcggcgtgttgaagcttaacttctgtgttcggcatgggaacaggtgtatccttcaagccatcatcaccacactctttgtcccttcggacgagagcttgtgctctcaaaactaaatcctatctattctcttccaataaaccttaccgctccttggttaagtcctcgaccgattagtaatggtccgcttcatgcctcacggcacttccacttccatcctatctacctcatcatctctgaggggtcttactttcccgaaggaaatgggaaatctcatctcgaggcgagtttcacacttagatgctttcagcgtttatctcgtccatacatagctacccagcggtgctcctggcggaacaactggtacaccagcggtatgtccatcccggtcctctcgtactaaggacaggtcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggaaccaccggatcactaagcccgactttcgtccctgctcgacctgtctgtctcgcagtcaagctcgcttgtgcctttacactctgcgcatgatttccaaccatactgagcgaacctttgggcgcctctgttaccttttaggaggcgaccgccccagtcaaactgcccacctgacactgtctcccagcacgttcagtgctgcgggttagagtggtcatattgcaagggtagtatcccaccagcgcctctgtcgaaactagcgtcccgacttctacggctcctacctatcctgtacaagcagtacaaacactcaatatcaagctacagtaaagctccatggggtctttccgtcctgtcgcgggtaccctgcatcttcacagggatttcaatttcaccgagtctctcgttgagacagcgcccagatcgttacgcctttcgtgcgggtcggaacttacccgacaaggaatttcgctaccttaggaccgttatagttacggccgccgtttactggggcttcaattctgagcttcgccgaagctaacccatccttttaaccttccagcaccgggcaggcgtcagcccctatacttcatcttacgattttgcagaaacctgtgtttttgataaacagtcgcctgggcctattcactgcggctggccttgcggccagcaccccttctcccgaagttacggggtcattttgccgagttccttaacgagagttctctcgctcaccttaggattctctcctcgactacctgtgtcggtttgcggtacgggcagttaactactccttagaagcttttctcggcagtgtgacatcggcaacttcgctactttaatttcgctccccatcacagcttgtcaacacggatgtaaacatttgactcacatcctgacttactgcttggccgtactcttccagtcgtacggtttgcttagcctcctgcgttcctccatcgtcaaacgcagttaactggtacaggaatctcaacctgttatccatcgcctacgcctctcggcctcggcttaggtcccgacttaccctgggaggacgagccttccccaggaaaccttagtcattcggtggacaggattctcacctgtctttcgctactcataccggcattctcacttctaagcgctccaccagtcctcacggtctgacttcgccgcccttagaacgctctcctatcacgtgcacatagtgcacatccacagtttcggtaatatgcttagccccggtacattttcggcgcaggatcactcgactagtgagctattacgcactctttaaatggtggctgcttctaagccaacatcctagttgtctatgcaactccacatccttttccacttagcatatatttagggaccttaactggtgatctgggctgttcccctttcgacggtggatcttatcactcatcgtctgactcctgagtataaatcaatggcattcggagtttatctgaagttggtaacccatgacgggccccttgtccaaacagtagctctacctccacgattctttacctcaaggctccccctaaagagatttcggagagaaccagctatctccaagttcgtttggaatttcaccgctacccacacctcatcccagccattttcaactgacacgggttcggtcctccagtgcgctttaccgcaccttcaacctggacatgggtaggtcacctggtttcgggtctacaactacatactttttacgcccatttaagactcgctttcgctacggctccggttttccaccttaaccttgcatgcaatcgtaactcgccggttcattctgcaagaggcacgccgtcacccattaacgggctccgacagcttgtaggcacatggtttcaggaactatttcactccccttccggggtgcttttcacctttccctcacggtactggttcactatcggtcactagggagtatttagccttgcgagatggtcctcgcggattccgacggggtttcacgtgtcccgccgtactcaggatcctgaacagagagtgtgacgtttcatctacggggctttcaccctctatggcacagcttcccaactgttgcgactacgtcgcactttggtaactctaatgttcagtcctacaaccccaacaagcaagcttgttggtttgggctcttcccttttcgctcgccgctactcagggaatcgatgtttctttctcttcctgcagctactaagatgtttcagttcactgcgtctacctcttgctagctatgtattcactagtcaagtaatcagcgactaagctgattgggttgccccattcggaaatctccggatcaaagcgtacttaccgctccccgaagcatatcggtgttagtcccgtccttcatcggctcctagtaccaaggcattcaccatgcgcccttcataacttaacctaaacaatcaaagattgtctgattaattgagttagcgattataattcgttaattaaaactcaaataacgcggtgttctcggtttattgttttgttaataaagaaattagatagtatttagttttcaaagtacaaactctatcaaccttatggttgataatggagaataacggaatcgaaccgatgacctcctgcttgcaaagcaggtgctctcccagctgagctaattccccatatgggcctaaatggacttgaaccatcgacctcacgcttatcaggcgtgcgctctaaaccagctgagctataggcccaaataagcgtcttataggttaaagttttaagaggtaaacctctcaaaactaaacaaagtttctccgatgtgtaggttccgttttattccttagaaaggaggtgatccagccgcaggttctcctacggctaccttgttacgacttcaccccagtcatctgtcccgccttaggcggctccctccataaaggttaggccaccgactttgggcgttacaaactcccatggtgtgacgggcggtgtgtacaaggcccgggaacgtattcaccgcggcatgctgatccgcgattactagcgattccgacttcgtgtaggcgagttgcagcctacagtccgaactgagaacggctttaagagattagcttactctcgcgagtttgcgactcgttgtaccgtccattgtagcacgtgtgtagcccaggtcataaggggcatgatgatctgacgtcgtccccaccttcctccggtttgtcaccggcagtctcactagagtgcccaacttaatgctggcaactagtaacaagggttgcgctcgttgcgggacttaacccaacatctcacgacacgagctgacgacgaccatgcaccacctgtcattgcgtccccgaagggaacgccttatctctaaggttagcgcaagatgtcaagacctggtaaggttcttcgcgtagcttcgaattaaaccacatgctccaccgcttgtgcgggcccccgtcaattcctttgagtttcaaccttgcggtcgtactccccaggcggagtgcttaatgcgttagctccggcactgaagggcggaaaccctccaacacctagcactcatcgtttacggcatggactaccagggtatctaatcctgttcgctacccatgctttcgagcctcagcgtcagttgcagaccagacagccgccttcgccactggtgttcttccatatatctacgcattccaccgctacacatggagttccactgtcctcttctgcactcaagtcgcccggtttccgatgcacttcttcggttaagccgaaggctttcacatcagacctaagcaaccgcctgcgctcgctttacgcccaataaatccggataacgcttgccacctacgtattaccgcggctgctggcacgtagttagccgtgactttctggttggataccgtcactgcatgaacagttactctcacgcacgttcttctccaacaacagagctttacgagccgaaacccttcttcactcacgcggtgttgctccatcaggcttgcgcccattgtggaagattccctactgctgcctcccgtaggagtatggaccgtgtctcagttccattgtggccgatcagtctctcaactcggctatgcatcatcgccttggtaagccgttaccttaccaactagctaatgcaccgcaggtccatcccagagtgatagccaaagccatctttcaaacaaaagccatgtggcttttgttgttatgcggtattagcatctgtttccaaatgttatcccccgctctggggcaggttacctacgtgttactcacccgtccgccactcactggtgatccatcgtcaatccggtgcaagcaccatcaatcagttgggccagtgcgtacgacttgcatgtattaggcacaccgccggcgttcatcctgagccaggatcaaactctcatataaaacatacaagaacttgaatagctctaaattatctttgttattaagcgaattgacttcgcaaatgttttacttcaaatcacatcgtgaatgaagaccctacacatttgattcgtcgaaactttgttcagttttcaaaggtctacccgttggctaatcaagcagccaatcaacacgattattataacatacatcagatcagcttgtcaagaagaaaatttaattaattttgaattccttttgatcgataactcaatcagcaactttattaatatatcatgtcatcaagtggatgtcaatagtttttcagaaaatcatttcaagaattagtgactttacaaccatgtttactcttaataattttaatagatatgatcatttattcacatcttttcgatgacaatagttacattttaccctatatttttattatttgcaataccttttttataaaaattaccagtaagtaaattaattttatcttctggtaattttctactaattaattcaattactaatattcttttgcacttaaaagatcatctttagcgtttttgaaatcacttggcaatggtgccaaaacagtaatattttcacctttaaatggactataaaagctcagccaataacaatggagtgcttgtctagcaattaatcctgattcttcaccatacattttatcgccaattaatgggaaaccaaggctagcaaaatgaacgcgaatttggtgtgtccgccctgtatgcaacctaattttgataaggcttgcttgaacattacattcttggcgccagtattcagttacagatgctttcccttctttccctaccattctttttacaaatgaactgggatcgcgttgaatcggcgcatcaatataaccatgctctgcaggaacttttcctttaattagagcaagatagtttttcttaactaaatgtttttttaactgttcatctaggacagcatgggcaaatcggtgtttaggaaaaacaactaagccgctggtgtcacggtctaaacgtgtcgcaacatgggtaacctgattttcataattttggcgcttatagtagccttttacccgattcaccaaactatcggctaccggaacgttatgagccggaactgtcgctactcctgccggtttattcattattaaaaagtcttgatcttcataaataatatcgataggtgcctcactgatatccacattatcattagcagtttccggagggagaattaatgttactttatcgtggtaattaacagtatcaactgcccacttatctaccccatttatttgcatttttcctccatggtatatggctacttttaataacgaagaagaaaccccatacatttttaatgccgatcgtaatttccgtggtgtgcgatgatcatatatccaattaaattccattaatgcactccaccaataaatgaatcttttactcgattccagaaattattatgccgatattgagcaaaatatattcgttgcttagaaactctataagataattcagttaggtaccgctccttctcacttttaagcatccattgatcacgatcgcatgtaagcacatgcccattttcatcacgcaaacgcaaaattaactcagcatcagcgccaaaaataatcggtgagcctagtgtccggaaaacccggttgttaagtgaagccatttctgctaactgaaagccaacactatttggatcgacaatggcacccccgactgatttattataagcagttgaaccggttggagttgaaatacataaaccatcccccgaaagttttcaaacaaatgattattaatgaacacatcacataccattgttcgtgtaacattccgaattgttgattcattaagtgcaatataattctctatctgcccatcagaataagtagccttcatagcaagtagaggatacgaaactgcctgtccgctatcttttactaaactatcaactaaatcatcaatttcaaaactccgccaatccgtataaaatcctaagtgcccagtatgaattccaacaaagcgaatgttatttaagtctttttgataatgatgaaaagccgataacaaagtaccatctccaccgattgttattacaacttctggatttttttcgacataagttaaacccgcccgtttcatttcagcctttaaaacctttgtcactcgttgagattctgctgtttcattattatatattccaattctcataatttactcctttaactcgtcctcatcaatagaattagttgacctccgcttagaaaacaatgtctgtgcttcctttatttcttctcgaatctctgacatttcattatcaagcttaaatgctgcctctgcggctctttgcaaccttgcagatagctcctcaggaaactcaccttgatatttataatttaaggaatgttctactgttgcccaaaagttcattgcaagggtacgtacttgaatttcagctaatattcttttttctccagtaattaattgcaccggatattcaataacaatatgataggaacgatatccactcggtttaacattggtgacgtaatctcgttcttctaaaatagtcatatcacttcgctgccgtaataagtcaactaccttataaatatcttctacaaattgacacatgattcgtaaaccggcaatatcttgcatatcttgctcaagtcgatcctcttgcacatgtcgtctaatcattttttctttaatactatcaactggctttactcgtccagttacaaattcaatcggagaatgttgcgtttggtcttgaaattgctttcgcatcccccgtaatttgacttttagttcatttacggcttgttgatatggcaataaaaaatgctgccaatcttcaatcataattcagcctcctgttaaatctccgtatattttagcacatttataataataactcttgtaattatcttaaaacgtatctgtcaagttttcataggtagcctttaaatatacagttttagtgggttagtgccttaaaaagttgtcccattggtctacttgtggccgtgttaatcggaattattccttgtactgctccaattgacggctttgtcggtgcctttcttagaaactctccagttcgaatatgcatttcctgtaataggctggtttgagccactcgaggaagaactgttaattgttctaggattatatttaaactagcttgcagttcaccattcattcgggcttcaattaaaccaatcatggctttagccccctgcttagtccatgacttgccctgtttcttcatccggtaagtaaaagcccggtgagaactttcgactgaaccaattaaatgaatatccttaaatccacgcatttgtggtgagaggatataccgccaatttcgctgtagatactttcttaaacgcattaggtcatctgcttgtttttccgttaggttttgtgattcataagtatctaaaattattgttagctctgcttgatcatgatgacgaacggctttaattgctcgcatggctaattcgttgtgccggcctaaagtatgttcaattttctgcaaacaatgatagcggtcgagaaagtattcaccatgtgcactttgaggaactagacttaatagcttagctggttcgtaacctgggccagcgtcactggccaaaaagatcgtttgaccggcaagcttataatggcggtctaaataatcacttagtcgtgcttcaagccgtccttggtgcccaacactgagaaagtcatgccgattaatgatttgattagctactcgctcataaacccgataatggtgcacaagagtcagctgacctgcttcttttttacctttaatcataaaggcatcaccctcaatagttaaatttttaggcatatggcgaggagtagcttggtgttcttttgcttgagtttgtttagctacctgatttcctaactcatgcacggcgtgcattaccgaatcggcagtaattccgctgtcaaatacaaggttcaaaatgtcggcagtattgcgcattgtagttgtttgggcaatcttagccatcatcattaagtagtgtggcgataaacgacgacgtggtttaatttttaattgttggtctaagtaaaattcacgtttctttgtcccagcctgataataccgtcgttgaaaagtcaccgggccaaagataaaattaagcgtccgtggctgtttattaattacttgatagttcgctggagcttgggactttaagcttcgatctaagctttccaaaaagttttgcatgattacttgtcctaactccaataccccttttaaaataatctgttcagcttcaaataaactgcctgatttcaccaaattctgctcgatttctgttaaaatatccatgaggaaagacctgcctttgcttagtattcgacacactaaaggctactggtcttttctttttttgtaaataagtaaattggtctacaaaaaagatttccacgaccagatgaattattcatccaacctatgaaaatcttacactaactcttaaaactaaattctttacaaatagttagatatttgcaaaaataattatgttcacaggattaggattttgagtatacaaatgatcggaggggttaattatgctcgaacttcatctttttgtgaatccattaggaatgcgctgtttacggtgtgaaaaagacgtgttaaaaattgatcgtgatttaaatacaaaaattagttatcagtttgtaccactattcaatatgaaaacgatcgatagcacacttaaatattatcatcttaatccccatgatcttgctgcaagacaacaagtatcaaaaacccttaaccaaataatactagattataaagcagccctcttccaaggacgaaaacgtggacggcattatctcttacaattacaatctgcgcttattaaccaaggcttggattacaacgatgaattaattaataaaattgcacatggttcacaccttgacttagaaatgttttttgaggatcggcaaagtcaacttgctaagcaggctttccgtcaagatcaaaaaatcgcaagtgatctaggcgtatcagaaacggctaccgcagtcgtttttaacaccgaagattctgattacggcctaatgattccaaattttgactataatactttaataaacgcatttaaaagcggaaaattggctcgatctgcatccttagatgaatttgtgaaccaatatcgtccgccaaagctacaaattatacaaaacaataattaataaaaaagagattggaaaagttggcctttcattattgcaccatctatccaacctctttttttattttctgcctagaattgtaatcgttctcttgaaaaagcaagctttactagtttccctagtaattttttgctttcgtccactgcggtttcggccatccgattattaattgtggttaaaaatgcactcacatcctgatgttctgctatttccttatccgtattattttgaacattcattgtttttgccattacttgcaattcaaagttttcttcaatattctgtgcttgacgataattttggtccccaagcgcagcaattgtatgagtgagccaatacatatcgtctattgaatattcagtactagtgtttcgataagggattggtgtatcgtcaatatttgcataaaagggaaccactgcattaaaagtattaggaccaaatgctaaccaatgaacaccagcaatacttgcaggaacattattacgtatttgtagaatatgtaattctaagtttcggtttagtgcaattgacctaaatggagctttatctctttctaaatgatacggatcaaaagctgtcccttgataatgagaactcattaacttcttaatcgtagttacagtaagcttttcttttgcataacagatgaatggaaggttattactttgcgggttagcatttatcgtccctagttgctgctgaacataccatgctcgtgggttgttatagatagtatcagtagcagttgcacttccacaaatatgtcgtaaattgtattcgtcttcgctaggattcaacttattttgatcaatccactgtttcaaatttggtgaactcattgtgttgggactatcaaaatcaaaattagtaatattaaatcgattaggggcaatcacataggcattgtcgggaattttaacagctacccaatgatgaccgccaatcgtttccatataccacacttcattattatcactaaaagctatcgcattagcctcataagtgccatacttttctaataaacttcctagtttcttaacaccatcttgagcactcttaatataaggaaggactaatgttacaaaatcttcttcgccaattcccgataaggtgttataaggatctattgctaatatccgggcattagtagtaatagtttcagtcgcactcatcgcaacattcagaccattgataccgcccgcaccaaaaattccatctttatcgtcagcatcaggcgtagaagtatattttagcttaggaactggtaaatcaattttaaagtcagttgttttgctttgatatttacgtggctgtctttctggttttactaatacaaatctttgaggatcaaatgcattactataatcttcctcacgacaaactatagttgacccgtcaatcgttgcattctttcctgctaaaaacattgtacatgtgtgttgcatactatgatctccttttaaccagctgtagttttaactgtgaatcattaaaccatcttggacgatgaattaaaataagatgattatcccttctacaaattactttaaaggcaattaattcgtttgtatattggttgataataatattgcggattgtttctggaggtaaacaaccagggaataaccaattgcttttgtttaccttcattaataatcttttccattccttatctctccaagaataaaataaagggaatttctctatctctaatattacaccaattcgccagataatcattggaatagacattgccggccagcttgcaatgagatcatggcatactagtggacattcagataaagcatgtccagtaagttttaaagcagttaatgatagttttcttatttctttatttggaaaatgatactgtttcttctttaacatttcaatctgctccattaaaatagtttttttatcatactttaaccggctataggagcaacgccaatatttctgatcaataactaattgcgcccttttcacatcccaaaacaagagaacaaactgccttctaaagatttgcgtaaactgaacgattttcttatttcccaagttacgcaaataaggcgatcctaatatccaccaaaccggaattcttaactgacgatacccttcattacgtgctaataacttttcaaggcttaagggactacattgaaattcaactgctacagtttgtccattaatttctaaaagaatatccggtcgttgagtaattgttggaaaatagacttctaattgcggattccaatgatgcttttgtgcccattgataaatctgttctttcccttttaaatgttctaatgtttcaccctcgctaaagccacagtcatttcccttcttatgggcataatgagtaatcttatgctttcctcgccgcaagatcactccctgcccgcatcctggacaataatatgccatatcgctttttgcgttttcagccaacactaattgatcgttatgaactgcaattaacatttaatccccctatatatttatatacggaaattactcaattttgcacgaaaaaaaactacgttgagtatgaactcaaacgcagcttattcaaaatagtgtcgaattaaatgcaaggcagatactgacattattttctttccatgttcacttaaaaaatcaaccgttgttgccgtgggatttccatattcataagcaagagcaagctgatctttaacatcattactgttcaaaatagaatcagaataagcaattgctaaataatacaaatcattgtacttatataaatatgatgaaacatcatcattatcggcaattttcgcaaaatcaattaaatcttcaaaagaatcaaacgtaattacttgccagttcgtgtgctgaatctcattatcttctgaatcattaatcgctgttttcctttgatcttgatcttgactatttttttgaatcaaatgttgcttaatatatttggacacctggtcattaatcggtccatgctgttcattcccagcaaaattagaatcatttttactaataaataattctaagccattattagtgggcatcacctgaaaagtaaccgcatcgttattttggaattggcgatcagtatctacttctttcaggatactataaaagaaatcctctatttgctgatggtcacctagcaaatctagaatggtgataccccgagcagataaatcatcattatctaccaaaacgcgaatagtattttcattaatgcgttccatctccattgagcagcacctccttttaccaaaactagatgttacttctattgtaaggattttcgcttaaaagtaaagttactcggttaaaagaataaaaaaaggaaagcataatactttccatattctatcagttaaatcatatttgctttttcttgagcctctactagttctagttcacgaacctttcgtggtaagaagcgacggatttcgtcttcgttgtaacctacttgaagccgtttatcatcaataataatcggacgtcgtaacaatcctggatttttactaattaacttaaacagatccttcatcgacaaatcattgagatctatgctcaacttctggtaagctttagaccgctttgaaataatgtcttcagtaccatcttcagtcatccgtaaaatattcttgatttcatttaaagacaatggttcagaaaaaatattccgttccttaaaagcaatatcatgttcttttagccaggcacgtgctttacgacaagacgtgcaacttggagacgtatatagtgtaaccatttcgtttagtggcctcctttattaagttaaactagaacattcattaatacattgtttattatactccctattcaattaatattaaagcgatataacaaaaattattgactttttgtaagttctattgatattagattttccatttatgtcttatcaaaaataaagtagataaaatttacaatttaattattttacattaagttgtactataataagtatgactactaacttctgaggagggattaatatgttaacaaaaattagcttaacatttggttcacgacaaattttacaatcaatcattgataaatatcccgaacgtcattttaaattaatgcaggcaactactcatacaagaaaattagcattatttgatctttctggaaaagatactatttttcagtcaccagtaaaattaacaactcttgattcaacgctagatgctcaattaaatggaatgttttactaccaatcatttcaagtaaacggtgaccgtcaaaagctactttataatacacttcaaaaggtattaactgaaccagctaatatgaacggtggttatatgcttagcgttgataataaagcggaagctactactttagttttactaactgcttgggccgattttgaagccttaactgcatggaaggaaagcgatactttcacatccttaaagaactttactagtatggggtcagataatagttattatgatgagatttacaaacccattttttaataagtagataacgtagggtatttgccaatggtatttaactgatacctacaacaggactatgaattatcatttttggtaattcatagtcctgttttttagggtatacactttctggtatggatagagattccatgccaaattttttatcccgaaatgtcaatttaagttagaaagaaagtagttgctcatcagtgacgtaggacatgaatacctcatatggagttcgatagcctagtgatttgcggggcaggttatttcgcttactcatcagttgggtcaccaattcatcgggaagattgcggaaatttagccgttttgttaagccgtcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgccacggaaatttacgaagccactgacctaagtgttggttaatcgcatcagccgtcttttcgtgcacattgagtacaatttcgaccttcgattgcgttcggtcagggtcattaccgccccttggtgctttttaccttggacggtatcagcttcaaggtgcccaaattcagtggcatagtgcggaaagtccttggcacgctcgtgaatacttcgccccaattggccagccttcccgcggcgctcgacatagccattcgggtgccgcttacctcgcatcggcaaggaacggacatcgaagccgaactggccacgttcaaacatccggtaaagagttcgcaggctacaactaattgggcgctcagcgcgcccaataatggtatcaggcgtccacccctgggcaattttgtcgttgatataagtgagttcagccagtgacaactgagtacgttttcggccacaacgttgcttattgcgcatatagtgatcttgataatcagcaattgaggcaccggtttccaggtaacgataaacgcgataaacggtttcggcgctacggttgatcatttgggccactcggtacgctctaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgaatggaataacttcttcaatctgtggtaaaccatctaaaaaagtggtccgctgaccagattgctttgctttccggtgacgcaccacttgctttattttcttttcagtcacttccgtgactgaaatatcaggatcttgaagttgatccatttcttgctcactaaataaggattgttgtccatcaacgacgggctccattacttcagtctttttcccaaatatttggttcttttgaagtttgataatagctattaattgagcaatcttttcattgaccatagctaattgttgtttaagttctttgatttgttcttccgctgtttgcttcatggtacgtcacctcctttgaattattctttggtaattatatcaaagaattcttcttttaaatagaggtaactcaataaaaacttcccggtcgaacagcttgaattttacgaattggtaatgggttcagtccttgcaataaccagtcgagctgttgatcagataattctttggcttcattactgtttctcggccaactaaggtggccattttcaaaccgtttatagagcataataaagccctcgccatcccaaaacaatcctttaaagcgattattacgtccgccgcaaaataagaaaagcgaattattatataattctaatccatagttctcagcgattaccattgcgagcccatcaataccttttcgcatgtctgtttttccacagactaaatagatataatctgggtcatgccaattaacgagcataacgaataaccactttaacgatatccgaagctaaaacagaattagtccccttgaaaatcgttaattcgacttcattcacattaatttttacggcagggcgtgccgtaaaagaatgcttttgtaaattacttggcttgtttttgaaaactggggtaataatttcattttgttctgtcataaataaaaaatctccttactgatgatagtctcagtatagaagatccggggtagctagagctagacgtactgttattgactgcttacgatattgtagagcctttttaattcgtattttattaactgtttaccttttactaacaaaaaaacttcccacctatccgtagaaagtttttatttatcattaattatacggtccgtacgagactcgaactcgtgatctcatccgtgacagggatgcgtcctaaaccaactagaccaacggaccaaaattgcgggggctgggtttgaaccaacgacctccgggttatgagcccgacgagctaccagactgctctaccccgcgataataaagatgacccgtgcgggatttgaacccacgataccagcgtgaaaggctggtgtcttaaccacttgactaacgggtcattacggagaaggagggattcgaaccctcgcaccgcttgcgcgatctacacccttagcaggggcgcctcttcagccacttgagtacttctccaatgggcctaaatggacttgaaccatcgacctcacgcttatcaggcgtgcgctctaaaccagctgagctataggcccatatctaagcgggtaacgagaatcgaactcgcgacaacagcttggaaggctgtggttttaccactaaactatacccgcataatattaagttaatggcgcgggacggaatcgaaccgccgacacacggagcttcaatccgttgctctaccaactgagctaccgagccaaatataaacggtccgtacgagactcgaactcgtgatctcatccgtgacagggatgcgtcctaaaccaactagaccaacggaccaaaattgcggggctgggtttgaaccaacgacctccgggttatgagcccgacgagctaccagactgctctaccccgcgataatataaggaggatgagggattcgaaccctcgcgtcgctctcacggcctagcggttttcaagaccgcccccttcagccacttgggtaatcctccataatgaactaataagattaaacaataatgattcatcaaagctaatctctgatggaccttgtaggactcgaacctacgaccgggcggttatgagccgcttgctctaaccaactgagctaaaggtccaaaacagccagccaatcgcggcgggggggatcgaaccctcgacctcccgggtatgaaccggacgctctagccagctgagctacaccgcgaaaaaactaataatatattaattttataaatcgggaaaacaggattcgaacctgcgaccccctggtcccaaaccaggtgctctaccaagctgagctatttcccgaaaaaatgcacccagaaggagtcgaaccttcaaccttctgattcgtagtcagacactctatccaattgcgctatgggtgcataataagtgccgaggaccgggatcgaaccggtacggttatcactaaccgcaggattttaagtcctgtgcgtctgccaattccgccaccccggcattatagaactggcaaagcggaagacgggattcgaacccgcgacccccaccatggcaaggtgatgttctaccactgaactacttccgcatatgaaagtgccgactagaggattcgaacctccgaccccctgtttacaagacaggtgctctgccaactgagctaagtcggcaattgacactttgtttttttattatcagataaaatttctgataatgagccgtgacgggcttgaaccgtcgaccctctgattaaaagtcagatgctctaccaactgagctaacggctcatgagcttaatcgctcaatggaggatacagggctcgaacctgtgacctcctgcttgtaaggcagatgctctcccaactgagctaatcctccataagcgtggcaacgtcctatcctcgcagggagcgatcccccaactactttcggcgtgttgaagcttaacttctgtgttcggcatgggtacaggtgtatccttcaagccatcatcaccacactctttgtcccttcggacgagagcttgtgctctcaaaactaaatcctatctattctcttccaataaaccttaccgctccttggttaagtcctcgaccgattagtaatggtccgcttcatgcctcacggcacttccacttccatcctatctacctcatcatctctgaggggtcttactttcccgaaggaaatgggaaatctcatctcgaggcgagtttcacacttagatgctttcagcgtttatctcgtccatacatagctacccagcggtgctcctggcggaacaactggtacaccagcggtatgtccatcccggtcctctcgtactaaggacaggtcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggaaccaccggatcactaagcccgactttcgtccctgctcgacctgtctgtctcgcagtcaagctcgcttgtgcctttacactctgcgcatgatttccaaccatactgagcgaacctttgggcgcctccgttaccttttaggaggcgaccgccccagtcaaactgcccacctgacactgtctcccagcacgttcagtgctgcgggttagagtggtcatattgcaagggtagtatcccaccagcgcctctgtcgaaactagcgtcccgacttctacggctcctacctatcctgtacaagcagtacaaacactcaatatcaagctacagtaaagctccatggggtctttccgtcctgtcgcgggtaccctgcatcttcacagggatttcaatttcaccgagtctctcgttgagacagcgcccagatcgttacgcctttcgtgcgggtcggaacttacccgacaaggaatttcgctaccttaggaccgttatagttacggccgccgtttactggggcttcaattctgagcttcgccgaagctaacccatccttttaaccttccagcaccgggcaggcgtcagcccctatacttcatcttacgattttgcagaaacctgtgtttttgataaacagtcgcctgggcctattcactgcggctggccttgcggccagcaccccttctcccgaagttacggggtcattttgccgagttccttaacgagagttctctcgctcaccttaggattctctcctcgactacctgtgtcggtttgcggtacgggcagttaactactccttagaagcttttctcggcagtgtgacatcggcaacttcgctactttaatttcgctccccatcacagcttgtcaacacggatgtaaacatttgactcacatcctgacttactgcttggccgtactcttccagtcgtacggtttgcttagcctcctgcgtccctccatcgtcaaacgcagttaactggtacaggaatctcaacctgttatccatcgcctacgcctctcggcctcggcttaggtcccgacttaccctgggaggacgagccttccccaggaaaccttagtcattcggtggacaggattctcacctgtctttcgctactcataccggcattctcacttctaagcgctccaccagtcctcacggtctgacttcgccgcccttagaacgctctcctatcacgtgcacatagtgcacatccacagtttcggtaatatgcttagccccggtacattttcggcgcaggatcactcgactagtgagctattacgcactctttaaatggtggctgcttctaagccaacatcctagttgtctatgcaactccacatccttttccacttagcatatatttagggaccttaactggtgatctgggctgttcccctttcgacggtggatcttatcactcatcgtctgactcctgagtataaatcgatggcattcggagtttatctgaagttggtaacccatgacggccccttgtccaaacagtagctctacctccacgattctttacctcaaggctccccctaaagagatttcggagagaaccagctatctccaagttcgtttggaatttcaccgctacccacacctcatcccagccattttcaactgacacgggttcggtcctccagtgcgctttaccgcaccttcaacctggacatgggtaggtcacctggtttcgggtctacaactacatacttttacgcccatttaagactcgctttcgctacggctccggtttttccaccttaaccttgcatgcaatcgtaactcgccggttcattctgcaagaggcacgccgtcacccattaacgggctccgacagcttgtaggcacatggtttcaggaactatttcactccccttccggggtgcttttcacctttccctcacggtactggttcactatcggtcactagggagtatttagccttgcgagatggtcctcgcgggttccgacggggtttcacgtgtcccgccgtactcaggatcctgaacagagagtgtgacgtttcgtctacggggctttcaccctctatggcacagcttcccaactgttgcgactacgtcgcactttggtaactctaatgttcagtcctacaaccccaacaagcaagcttgttggtttgggctcttcccttttcgctcgccgctactcagggaatcgatgtttctttctcttcctgcagctactaagatgtttcagttcactgcgtctacctcttgctagctatgtattcactagtcaagtaatcagcgactaagctgattgggttgccccattcggaaatctccggatcaaagcgtacttaccgctccccgaagcatatcggtgttagtcccgtccttcatcggctcctagtaccaaggcattcaccatgcgcccttcataacttaacctaaacaatcaaagattgtctgattaattgagttagcgattataattcgttaattaaaactcaaataacgcggtgttctcggtttattgttttgttaataaagaaattagatagtatttagttttcaaagtacaaactctatcaaccttatggttgataatggagaataacggaatcgaaccgatgacctcctgcttgcaaagcaggtgctctcccagctgagctaattccccatatgggcctaaatggacttgaaccatcgacctcacgcttatcaggcgtgcgctctaaaccagctgagctataggcccaaataagcgtcttataagttaaagttttaagaggtaaacctctcaaaactaaacaaagtttctccgatgtgtaggttccgttttattccttagaaaggaggtgatccagccgcaggttctcctacggctaccttgttacgacttcaccccagtcatctgtcccgccttaggcggctccctccataaaggttaggccaccgactttgggcgttacaaactcccatggtgtgacgggcggtgtgtacaaggcccgggaacgtattcaccgcggcatgctgatccgcgattactagcgattccgacttcgtgtaggcgagttgcagcctacagtccgaactgagaacggctttaagagattagcttactctcgcgagtttgcgactcgttgtaccgtccattgtagcacgtgtgtagcccaggtcataaggggcatgatgatctgacgtcgtccccaccttcctccggtttgtcaccggcagtctcactagagtgcccaacttaatgctggcaactagtaacaagggttgcgctcgttgcgggacttaacccaacatctcacgacacgagctgacgacgaccatgcaccacctgtcattgcgtccccgaagggaacgccttatctctaaggttagcgcaagatgtcaagacctggtaaggttcttcgcgtagcttcgaattaaaccacatgctccaccgcttgtgcgggccccgtcaattcctttgagtttcaaccttgcggtcgtactccccaggcggagtgcttaatgcgttagctccggcactgaagggcggaaaccctccaacacctagcactcatcgtttacggcatggactaccagggtatctaatcctgttcgctacccatgctttcgagcctcagcgtcagttgcagaccagacagccgccttcgccactggtgttcttccatatatctacgcattccaccgctacacatggagttccactgtcctcttctgcactcaagtcgcccggtttccgatgcacttcttcggttaagccgaaggctttcacatcagacctaagcaaccgcctgcgctcgctttacgcccaataaatccggataacgcttgccacctacgtattaccgcggctgctggcacgtagttagccgtgactttctggttggataccgtcactgcataaacagttactctcacgcacgttcttctccaacaacagagctttacgagccgaaacccttcttcactcacgcggtgttgctccatcaggcttgcgcccattgtggaagattccctactgctgcctcccgtaggagtatggaccgtgtctcagttccattgtggccgatcagtctctcaactcggctatgcatcatcgccttggtaagccgttaccttaccaactagctaatgcaccgcaggtccatcccagagtgatagccaaagccatctttcaaacaaaagccatgtggcttttgttgttatgcggtattagcatctgtttccaaatgttatccccgctccggggcaggttacctacgtgttactcacccgtccgccactcactggtaatccatcgtcaatcaggcgcaagcaccatcaatcagttgggccagtgcgtacgacttgcatgtattaggcacaccgccggcgttcatcctgagccaggatcaaactctcatataaaatatataagaacttgaatagctctcaattatctttgttattaagcgaattgacttcgcaaatgttttacttcaaatcacatcgtgattgaagaccctacacatttgattcgtcgaaactttgttcagttttcaaaggtctacccgttggctaatcaagcagccaatcaacatttttattatagcatatatcagattagcttgtcaagaagaaattttaaattatttttgattttcttttgatcgataactcaatcagcaactttattaatatatcatgttgtcaaatctatgtcaacaattatttttaacttttttgtcaaaccatctcaacagcgcttaactgttttgacaacgataattactatacatgggtttttattccccgtcaactgttttttctaaaaaaattaaaaagtattctcaaggtcatataaacagttaaaaacttcaatagcaactaggtcaatatcatcaaagcgaaaacgttcataagggcgatatcgaacgaagataaattcttccctactatggatataagttacatcacataatggaataccaaatttttcaaatgttcgtttctgtcgatctcttgaatcatcgttttgcatcgcaatcaaacgtttaataatcactaataattctgattctttcacaatgataatcctccttcatacaaataaaggatcgtgccttcacacaatccctttttctatctttttactttatcaggttttataaatacagctacaattccggcgaacattccgaagtaatatgtgagtagtcgccataagatcattgctaaaatcaattttgtatttgagtgaataaaacttgcaaagagaacggaaaaactatactcggctccccccgcccctcctggaattggaaaaagcgaaataatcataaaaattaacacgtgcaagctgagcaccatcacaaaattaatgtggtcaattccaagtgcaagcataataaagtatgggattgcatagtaaaagaataattgaaaaatagttactacgcaaaccttaagcagcttcttataatcttgcttcattcggagactctcttggtaaaaagtatccactttttcatttaagacaactttcatgtgctcatatcggttagccttcataaaaatggcagctggtttgataacgaggttcattagtctcttagtaaaactataccagtacatcaccatcagtaatccgacaattaccgctaaatgaatcaaaaagccaaatattactaataatgaaagagcatggagtttctccgcaataaaatgaaagccaattaacaagctgattaagaagttaacaacaatcattgcctgaaatacaacaaacttcattaaaagaactgaacttgctaatccccatcaacacctgattgaatcattgcaactaattgcgctggttgtcctcctgttgagaatggagtaattccattaaatagttgttcgattaatggtaatcgtaatgcatccttccaggtaaaaccatcgtgacgatcattcataaaaatctttacgacaaccgcctccaaacctaaatataaacaaatacagccaagtgcaacgagcatccatccccaattaatggcagaaacatcctgtaacaataggtggatgtttgagttacgtaatgagtagccgagaattccaactccaataattagcattatgcttaatactaaccaatttcgcctgctcactaagcatccccctttcgcgcttgctcctgataaaacttagtccaaacatctgctaagtgttcttttgagtattccttagcagctcgctgggcctgagtttgccaatgtgccagtcgtgcaggatcattgcgtaataatgtcaacttcatttgcatctcattgacatctttagcaggctcataatccccttcaacaatagaatgataaaggtcaagatcgcgtaacattactggtgtcccacagctaaaagcttccaagacagacattggaaatagttcattatatgaaggtaaaagaaataggtcggcaagattattcagttcagcaatcttatcccgtgaaacgattcccgtaaaatgtaaattagctggtggattatctaccaccttttttaattcactataaccatctgttaaacggccaaaagaaaatccgccagcccaaaaaaactcaacgtccggattttggcgagcaagacgaataaagtctggaactccttttcgttcttgaacctggccgcttcctaataccacaaacttatcggcagcaatcccatatttttttcggagagcagttcgcttaacagccgaatatggatggaaacgatcattatcaacaaagttaggaatataggtaatctttttttcaggaatcccatatgctactaactgcttgataaaagagggattcacaactactaactgatccattcgtttataaaaggcaataatgtaatgataaaaaagcccgcgaaacggttgcgggattgtaagacttccttctaacgtctcgggaagaaaatgcacatagccaatctttcgaccccgcttttttgaaaaagttgacaggtaaaaaagagggtcgattgtatgataatgactgatctgactcttcccataacggttgatttcaatttcaaatttgtcactgcactggttgcgcaacaagttaattaattcaagataggcacttcctactccttgtcccgcaaccttatctgcagatgaaaacattgttattttaatcatcattagctccttgggcggtgaaaaagacgatgtgatttttcagcttgattaagttcatcatggacagccatatctttttgacaatcctggtagaactgaacaaccctttcaacaaagacctctgctgagatctcatgcagcttttgttgtcgtctcacccttgattctgagttttttggttggttaaggtaaaataggacaccattaaccaagtcagcccgtttttgaaaactaatgccaatcgctgggtcatcaatcaattggtcagtatattcactacgcataaccacaattggcaaatccgaggcaagggcttcatcataagtcagtccttgtgattcagaatcggaggctgaaacaaaaacatctgccatttggtaataatggtaaacttcatcatttgatatctcaccagcgaaactaacattgtcattaagctgcatttcacgaacttgacgctccagagtatgtcttgcgggaccatccccaacaatcagcagctgtgcatcaggcttgtgagcaagaatatctggcattgcttctatcagtgagtggatattcttttcatatgctaaacgactaagcgaaagtaaaactggggtctcttcactgtagcctaactttgcccttaaattagctatttcttctgctgaatctcgtttactatatacccgtaaattaatcccagtcggaataacacgaattggtgattcaacatgataactggttaaagtatccaaaacacggtcacttggagcaataatcccagaaatattttttaaataaagatgagcaagccgggcaacatcattcggcttaagaatatggccattcgcaatatagtggagataatcctgatacatcgtatggtaagtatggagacaagggatatgcaaatgcttggcaaccgtcttccccataactccaagcgcaaattcagtttgattatgaactatatctaattggaactttttagcaagcttgatggctcgaaatacgccacgcaccgcaattcgacgatcagaaaacgaaacaaagggaatgcttgcaaagcggtatatcccattttcaacatcatcatgtttagccttaggatcagttgtcgtaaaaatatatacatgatgtccctgagcaatcaattcatcacgaagcgtcttaatcgaagtcgccacgccactcacctgagggaaatatgtatctgtaaaaataccaatattcaacctaactgctcctttttcatcataagttttctagataataattagtcataactgctattatactaaagcattcactgaaccgcaaaacggatttaagatattttaaatcttcctcctaatagtaacaagactcgggaagcctgattaagatttctttacaaaatcttttaataatgagaataaaaaataaccctcttgaaatggtgaacaatcaagaaagttaatttcatttatcaaagttttacctgtggaacatacttttccactaattcttggaccgccacggcagtttcagcatgaatcgctcgatgaactaatggttgtaatttgcgcgtattcaactggttaattaaagagcgaacacgtaaaatctgactactgctcattgaaaattcatcaagccccatcgccattaatagaggaaccgcataaggattattagccatctctccacacattccgacccacttgccttcagcatgcgcagcttcaatcacttgccgcaccatccgtaaaactgctgggtgaagttcttgatataggtatgctacttgctgatttccgcgatcaacagcaaataggtactgaataaggtcattactgccaatgctgaaaaaatcaacatattttgcaaaatgttcagccataactgcaactgctggaatctctagcatcatgccaacttcaatatttttagcaacttgaatacctgcttgctcaagcttttctttttcatcgtcaagaattgctcgtgccgcttggaactcttcaattgttgcaatcatcggaaacataatggctaaccgtccataaacggatgcacgaagaagggcgcgcaattgaggacgtaatatttctgggcgtgccaatccaatcctaatggcacgaaaacctaggtaaggattgtcctcatgaggaagagcaaccatccccagctttttatcgccgccaatatcaagcgttcgcgcgactacccgttgtccgttcatcgctgaaacaaatcttttgtaagcattaaattgttgctcttctgttggcaattcatccttactcatatagaggaattctgttctcaaaagaccaattccctcggcaccatcctcttgagcatcaataacgtcagcaaatgttccgacattagctcccacttcaaatcggcgcccatcagcactcacagtttgcttatcttttaacgctccccacttttgctgctcctggataaatttaccggctaacaaacggtaatgctcaacctcttccttcgttggattgacaatcactttgccatgaatcccatcaacaatcagtaagtcgccatcatgaatgatcgcagtagcatccttgacaccaacgacagctggtaacgaaagagtcttactcataatcgtaaaatgagaagtccgccccccgttagttgtaacaattcctgcaacatatcgtttatcaaattgagcggtatcagtaggcgtaatattattagcaacaaagatcgcgcggtggtctaaaagtcctgggtctggtaaaggaacattcaataggtgactcaaaactcgtttggtcacatcacgcaaggcggttgcccgcgcatataaatattcattatcgttcttgcgctcaaaaatacttaaataataatcttcaacgcgtttaacagcccactcggcggtatcatgatggctattaatacggtcaataatcttcttttgtaaagtcggatcgtctaaaatcgcaatttgggtatcaataatcgtcactgcccgttgacctaacagctcatgggcacgcttagataaatgctgaaattcggtcttgcttaacgcaaaagaatcatgaagccgggcgacctcatgattctcatcagctgtatgctgtttttttatagatagatctgactctactaacaggtgtgccggagcaatcgtaataccactactagcggcaagtccggttagtagtatagacattagtcagtcaatccttccttcttcatagtttcagcaacggtgtccaaagcttctttttcgtcgtcaccattagcagtaatagtaaccttggcgttttgaccaacaccaagggacattacacccatgattgacttcaagtttacactcttaccttcgtatgaaagagtaatgtcagatgaaaactttgaagcagcttgtaccaaaatagtagctggacgagcatgaataccagtttcagaagtaattgtaaattcacgtttttccatattaatcagtctccttcgagcagatataattaatttattatcagtagcttgaccactgatacacctcgataattacattttagcaattgtaagcgttaaatacaaggctacatcttgcgatttatcgctctcttaattgataaataactttaccgcctcgctgcgcttcgcctttaatttgcgaacgatacgcatacgagtgaaaaattggttgaaattgctgaaaattctcaggggtaattacaaaatgatcaatctttttatttcgcaagtcatccaacaattgctcaaaattttcttctgccattcaatcacctcaacataaaattttattttcttattatacacgaaattactttcatctttctattttagcattcatggctaaagagtgctaaaatcaaagtaagctgttttcggtattcctaagtaacttagctatgcggaaaatcgctctttatttaagaaaatatttaagttttatggcttgctttgcgataaaaagtaagtataatattaatcaatggtcaagaaaggtcaaaaaattcttgatggaactatttaggaggtattaaatttagatgcaatgtcaatactgtcatcaaaatccagccacgattcatcttcaaatgaattttaatggacaacggattcaaatagacctctgccaaaattgttatcaaaaattacaaaatctacaaacagatatgatgaatggaggtaacggaatgaataatttcggttttggaagcctcgaagacttcatgaacgcaatgaacaatatgcaaagccaagctgctggtgctaatggtcaaaacatgaacggccaatcccaacgacaaggtggcggacgaaatggaaaaggaatccttggtcaatatgggatcaaccttactgatctcgctcgccaaggtaaaattgacccagtcatcgggcgcgacaacgaaattaaacgagtaatcgaaattttaaaccgtcggaccaagaataacccagtcttgattggtgaagctggggttggtaagaccgcggttgttgaaggcttagctcaagcaatcgttagtggccaagttcccgaaaagcttgctaacaaggaaattatccggctcgatgttgtttccttagttcaaggaacaggaattcggggccaatttgaaaaacgaatgcaacaattaatggaagaagttcgtaagaataaaaacatcatcctctttattgacgaaatccacgaaatcatgggtgcgggaaatgctgaaggcggaatggacgctggaaatgttcttaagcccgcccttgcccgtggtgacttccaattagttggtgccactactcttaatgaatatcgaaagatcgaaaaggatgcagctcttgcacgacggttccaaccagttgaagttgatgaaccatccgttgaagaaacaatccgcatcttaaacggaatcaaaaatcgttatcaagattaccaccatgttaaatacacagatgacgcaattgtagcagctgctaaactttctgaccgctacattcaagatcgttacttacctgacaaagctatcgacttacttgatgaagcgggatcaaagaagaacttaacgcttaaaaatgtggatccaaacgcaatcgaaaatgaaatccacacagctgaagcacacaagcaacaagcagctgataaccaagactatgaaaaagcagctttctaccgcgatcaagtcgctaaacttgaaaaggcaaagaaagaagctgaagaaaaccatactgaagattctgcaactgttaccgttaaggatatgcagagaatcgttgaagaacggacaaatattccagttggtgacctgcaaaagcaagaagaaaatcaacttcgcgaccttgataagaagcttgatgaacatgttattggtcaaacccaagcagtggataaggttgcccgtgccattcgtcgtaaccggattggtttgaacaagtctgggcgcccaatcggtagtttcctctttgttggtcctacaggggttggtaagactgaaactgctaagcaacttgcccttcaattatttggttctaaagatgccatgattcggttcgatatgtccgaatacatggacaagacctctacttctaaattaatcggggctgctcctggttatgttggttatgaagaagctggtcagttgactgaacaagtacggcggcacccttacagcttgatcttacttgatgaagttgaaaaggcgcacccagatgttatgcacatgttcttacaaattcttgatgatggtcgtttaactgattctcaaggacgcactgttagcttcaaggatacaatcattatcatgacatctaatgccggaactggtgattcagaagcaagtgttggtttcggtgctgagtctaatggtagtacccactccatcattgacaagttgacaaactacttcaagccagaattcttaaaccggtttgatgacattgttcaattcaatgccctctctaaagatgacttgatgaagatcgttaacttaatgattgatgatgttaataacatgcttgctgataagaacttgcacatcgaagtcactaacaatgttgaagaaaaattagttgacatgggctttgatccaaagatgggtgctcgtcctcttcgccgggtaatccaagaacaaatcgaagaccggattgctgattacgttcttgatcacagtgacgctcataaattagttgctaaacttgatgataatggggacattgttgtcgaagaaactgaagaagtaccaacaattgctaaaaaataattgagtataaaaaacgaggctgaattttttagcctcgttttttatatgctcaatttacttccaaacgacggcggacctccaatactggaagagcaaccattggaacaataataatcgccaatatcaattctgcaagtccattagtcgccatgactgtttctaaagcaattaataaatgattaacatttaccccataagtttgcgcaactgctggagtacgataaaatagataaataaagcctaatactaagccagtattagtaagggctcctactatcgcagcacttactgcggcaatatattttactttgaacaaacgacacataaggataaaagtatagccagctaaaatcccaatcataatgcgcgggacaacggaaacaagcgggttaacaaaaactaagggagcaagcggactacttggtgcaacaaatgctcgcacccaagtcaaaagcccccaaataccaccaataattgcgccatcaacgggccccaacacgattgccgcaataatgactgttacatgaagggttgtaatactaagcggccctagcggaatgttgccaaaaaatgtgacaaaatcttgtaagagaataattgcgataaagattgctaatgtcgtattgtgcctaatttgttggtgccgtgtttttgccatttttcttctcctaaataaatttgaataggcttattgtaataaaaaaatcacctattcgcaattctcaagagaaatatggtcgttccttatcgtgtcagctactaaaaagcgctataataatagagaattaaggttacggagtgttaataatgattgacaagtttaaaacaggaaatcctatctgggtttactataatgatatcgattcaggagcaaaccttaccgtcccgcaattattacgcggattcatcggtcaagaataccaaattgaacaaaaacaatttcctaattaccgatacgtaaaaactgaaggtgaaactaagggaacatttgatatgcggcaacgaattgtgcaccttttttatcggaaacaaaattggggagaggttcaatcgattgaaatgtatctccacctcgatgcccctacacaggtatttgacacagctggtggaatgccagtcggtgccccccttcctgctgatattacagttaagtcttttcaccgggttgcaactaagaatggtcagttttggtatgaaatcggcgctgatcaatggattaaatacgatcaaatgcacgttgttgacaatccattcaaccaggatatccggaaagaaaaatcaaaacttattaataatttaacagtgattcccttgaagaatgttcaggccaaagttgattatctccataataagtcaatcaatgtttacgatgcgccttatggaaataaagtggcagagattccaaacggcgaaacaattaccctaattggaaaattaaacgataatgatgagattacctggtaccaagtgggccgcaaaaaatatattactagcaactacattcaaattgaatatccggaagatgatgaataaaaaaagcgagaggttgagaaaaagcaaaagttttttctcaacctctcctatttttacaaacaatagcaaaataacatggaactagcttcgcatcaccacaaggctcaaggctcaagactaatgctcactcacttttattaatcccgccgtaattgaattttattattaaagaatcgcgctaaagcataaacaatgattaagtaaataactaagattacccaaccagtaacgtttgagattatgattgatttaaagacaccactagcagaaagtgcaggaattaagccaaccagtgaataagctaacatcatcaataaaactaggcacgccattggaagcccaattcctacaatccatttccaccgacgatttaataaggcaaaaccattaccaattgccatcatcgttaaagaaaaaccgaagtaccataaaagactatgccaagcagaaacaagatcaaacggtgtattcattaagcccaccagttgtgcgataaaccaaactactaatgtcatcaggaaaagagataaaatccgcccttgccatagtgttttacgagaaataccgttttgaattgcccatttaaagtcagtataaggagttacaaggaaaatcgccattaaaagcacgcttaagattgatgaagcaatgcttggaagggcttggaggctaaccaaaaaagattcaaggttgtgtgaaataattaatccaagcaggtaggttattaatgcaattcccagcccccaacctaaggcaattcctgtagcgtgacctgcttgttgaaacatggttgaaataacaaggtttctcttttgattttccattagtattctcccccattcgttaagtaaatgaataaatgctgcaaatcataatgaccaatcttaacttgatcaggaatcacacgctgttcatctaagcgatcaagtaagtaggcagtcttaatattacccatcatctccgttttaagaatttttaagcctgcagtatactcatcaaccattttttccggaccactaattgcataagccttggctaataaactttctgtatcttcattaataatgatgtggtgttgatccatgattagaacatgttcgactaattgttgaatttcttcaattaagtgagttgataagacgaaggttcgcggccgctcttgataagtcttaactaattctttatagaagctatcacggtgattagcatctaaacctaaaatcggttcatctaataaaacgtaatcggcattgactgctaaagcaacgatcagcttggaggctgtccgttgcccagtcgataagttagtaattttcatccggtcattcaagccaaaaaccttgaggagacggtttgctagatcatagtcaaaattattataagcgacatcggccaagtcaaaggtttgacttatcttcatgtgacgcggataaagattaacttcactcatcaaaaagatcttgctgaggaggtcatcattgttattaacgtcttcattaccaatttttacttccccgctcgttggaaaaatccggttgctcataatattaagaagagtcgtctttccagccccattccggccaaggagaccataaattttagcaggttctaggataaatgaaatattatccaatactgtttggcgacggtactttttgacaatatttttaactattaattgatccatcattctcacctcgttcgattaagtctaataaatgctgcttggtaatcccgagcttacctgcttcaactagcaaactctttacatagtcgttataaaaactttctttacgttgttccataattttttgttgtgcacctttttttacaaacatccctagtccacgtcgcttttctaagaggtctttattaaccaaaatattcatccccttaagaactgtcgcaggattgatatgcaattgctgagaaagctgggtcgttgacggtacctgcgaaccttcatcaaagcccccagagaaaatcatctcttcaagctggtcagcaatttgctgataaagcggcatcgagtcattaaagtcgaaattcataagtgcacctccttttcgtttaacacttcattacttatgtaactaagtatatatgtaaatgagagatttggcaagagggtaaaagaaaaaacttcctgctcggctgaggaggaagtttttaatattattgatctatccatgatttctgataactgtttgtggatccaaccattcaccatggcctgttgcttgactaggatcattccaacttggaacaaaggaattctttaaatcgatgccatagtttggactagtattaattcctaagtgaagatgatcaaggtcacgataaccaattacttgaccggcataaacgatatcgtttggtttaacagtgatcttatcacggttactaaatgcttcctggtaaacatataagtattttccgtcccaaacagttgtaaaccaccatagaactttaccatcatcatcttttaccgtatttacatctaatactcgcccaccatgaactgcatgaacttctgaacctggatgatcttgagtcccaaagtctaggccatcatggaagccattcttacgaatattgctggtataaccaaatttctgtccctgatagtgccaaccttcaccagaccgtggaaatggccaactccaaccgtcattttgcggaagtgcacgagcaatcccatcagtaccaaaatcataacaatggccgtcaacccattgaataccagtatacatttgaccataaagctgatcattgtaaacccataagtcatctgggtcacgttgaacgtcataaccgtctgagaaatagtagcgattaccattaatagttcgccaaccagtagctactttcttagttgcaggatcatcataataaacttttccccagctagtagctactccatttgcatcaaagacataggtatttccatcgatacctaaaaacttagattctgctcgtgagccatcattggtaaagtaaaatttttggcctttaccactggtcatccactgattatcccaacgtgcaccgtcactaccgaaataataggtccgaccccaattagtatagaattggttggtataacgcgcaccatcggctccaaagtagtaggtgtggccccagttattatagaattggttcttatactgcttaccatcttttctaaagtagtaaagcttcccgttttggttcaagaaataatcgcgttgcatccgtccttgatcatcaaaaagatatgttgcatcgccaatagtggcaacttgtgaagttgcccgtactccatcgccaaaaaagtagtaactattgccccaacgattcatccattgattatcccaacgtgcaccgtcttgcccgaagtagtatacattcccccaagcattcttaaacttatcatcccaacgtgcgccgtcagctccaaaataataagtccgaccccaattggtatagaattggttggtataacgcgcaccatcagctccaaagtagtaggtgtgtccccagttattatagaattggttcttatactgcttaccatcttttccaaagtagtaaagttttccattttggtttaagaaataatcgcgttgcatccgtccttgatcatcaaaaagatatgttgcatcgccaatggtggcaacttgtgaagttgcccgtactccatcgccaaaaaagtagtaactattgccccaacgattcatccattgattatcccaacgtgcaccgtcttgcccgaagtagtatacattcccccaagcattcataaacttatcatcccaacgtgcgccgtcaactccaaaataataagtccgaccccaattggtatagaattggttagtgtagcgagcaccatcagctccaaagtagtaggtatgaccccagttattatagaactgattcttatattctttaccatcattgccataataataaactttattatcgactgttttaaagctatttggttgcccagtttcagtaatgttttgttctgaagtatcggtactttgtgcagctggagtaacaggaactgctcccttattatcattaccaactgtgctattactagtactttcagtattgtcgatgacattttcattactagtattagtttgagtctcagtaactgattgttgaacttcaacattactattatctaatgtagaatctgcttgaacagatcctacgcctaaaatcgtccccgcaagaacaactgctacagtacaccaaagtttaccacttttatataacttaaaatgtttctttaattccaagattattttctccctgattgataattatttaactacaactgcaaaacgtttaatattatatgaattttcaaaattacttgctgaaacccagtatgatcctccagcaggatcttcaacgtgataataacctggacgataaccatcaagagtcatcacatgactattattaacacctactccccagaaataattaccatattgaggggcagcccaatgcatcgtgacatagacaacaaccgggttaccattaagtaattgactttgtaagtcagtaggagaagaccctgaaatattctgaacattaccgaaccgtgaaccccattttgctaaaggttcgggataaattgattgaaagattccataggttactcgttgatatccgccaccgaatccttcattaggattaccatttggtgaaattggcatcgttttaataaatgattgaatgttgtagttgttggcatatcccttattatgaagcgcttctaacaaggctgtcgcttcacacgccatatcaccaacttgatattgattaatgtaaggcgcatttaataaagtaccattaattattccactatttggatcaacgtaatagttctgatgtccaagaataaaatcctgcttttgtagggcaccgtcatcaccaaagtaataggtatgaccccagttgttgtaaaagcggttatcccaacgagcgccatcactaccgaaataataagtgcgaccccaattattatagaaaccattatctaagcgacttccatctgcttgaaagtaataggttcgaccccagttgttgtaaaagcgattatcccagcgagcaccatcactaccgaaataataagtacgaccccagttgttgtaaaagcggttatcccaacgagcgccatcactaccgaaataataagtacgaccccaattattatagaaaccattatctaagcgacttccatctgcttgaaagtaataggttcggccccagttgttataaaactgatctttatattcttttccatcagcaccaaaataatatgtcttaccatttctttgttgaaagtaatctgtttgcattattccttgtgcgtcaaatgaatacacatcattattaatttgagctaattgattagtataacgtgcgccatctgctccaaagtaataactatgaccccaatttgtataccattgattcttagaaaggatcccattattgtcataataatatgttttattgttaatggtattgaatgtatttggttttccagtttcagatatctcatctacattattactttgagattgtggtattactggaacttgaatttttccttcatcactagtattttgatccgtaagagtttgattactatctgaagatatattctgcgttatttcaacattatttaaattttgattttctgttgtactatcagcttttgcgaaagtaggtgttactattaatagacctagagcaattgcagcataacaccatttctttccacttttgtatagcttaaaatgttttcttatttccaaaataatccatcccaactgttaattttaattaaacattattatcataatatatttttttaatttcgccgtttgtaaaattaagttagaaaaatagaaaagccatttgtggtagacttttgaatacccctaaacaaaagaaaggaaaccacaaatgacttacacccatcttaccacaaacgagctgacaatcatcgcccattctttcgtgcaaaagcttaaagcgtaccgagtggcccaaatgatcaaccgtagcgccgaaaccgtttatcgcgtttatcgttacctggaaaccggtgcctcaattgctgattatcaagatcactatatgcgcaataagcaacgttgtggccgaaaacgtactcagttgtcactggctgaacttacttatatcaacgacaaaattgcccaggggtggacgcctgacaccattattgggcgcgctgagcgcccaattagttgtaaccggcgaactctttaccggatgtttgaacgggggcagttcggtttggatgtccgtgctttgcccatgcgaggtaagcggcacccgaatggctatattgagcgccgcgggaaggctggccaattggggcgaagtattcacgagcgtgccaaggactttccgcactatgccactgaatttggacaccttgaagctgataccgtccaaggcaaaaagcaccaaggggcggtaatgaccctgaccgaacgccaatcgaaggtcgaaattgtactcaatgtgcacgaaaagacggctgatgcgattaaccaacacttaggtcagtggcttcggaaattcccgcagcacttcttcaaatcgattacctttgacaacggaaaagaattcgccggctggcgcgagattgccaatcaatttgaccttcacacttactttgccgaggttggtgctcccaatcaacgagggctgaacgaaaacaacaacggtcttttacgccgggacggcttaacaaaacagctagatttccgcaatcttcctgatgaattggtgacccaactgatgagtaagcgaaataacctgccccgcaaatcactaggctatcgaactccatatgaggtattcatgtcctacgtcactgatgagcaactactttctttctaacttaaattgacatttcgggtttgaaaaacttttttcaagaaaaaattatctcttacagaaaagagaagtcgctatttaataacagacttctctttggtaaatttattaagcttttacttaaccaagccattttaaggatgcggtatagtttacaataataggttctccatagtttacattactagtttctacggatgcaagccagaaatcataataatattgatttccatctgcagttgtatacgttttgcttccttttacttctttaggtaaaagactctttacatcattaacagtactttcgctaacatctttacctttttctccagttaaagcttctttgatatcttttgaattcaagataccagaaaacgcattatcacttttatcagttattaaatctccctgctttagaggattatcgattttaatttcctcattgttaacagtattccaaacctgagatattttaatttgtaatggagaagttgctacttgagtacctggttcagaatcaacgactacagttgccgaataatttgcaattaatggttgtccatacttggcatctttatttgcagaaacaaacgtatttaccttattatttccgccttcaagccagtaaatatagtgataccgtgcaccatttgctgctgtgtatacttttgaagatattccatctttaagccgtccagctagcttagttaattcagcattaccaatcgattgaccatcatttccacttaattgagtagttccgaaaaggtctgtcgataactttgttccttcagttaatccatcattaggaataacgtcagtctcattccaaatttttactaattgggttgaaagagatgacttaacatttttggggctttcatatccatttaacattccattataaacgttcaatgattgcagtggatgtccatgatcatcaaataatgaaatattatcccaagatgaacctccccatgcttccttgccatcataatacaatactgaatctggcgcatatcctttggcatactgtgaagcccatcccgaaccataaatgttagacattaatttattatattgccaattattccacccagcctttactgggatccatgctggttcccaataaaaagcaccgagacctttttgtgcaataatcgcattatacatatcctcaatttcgtctacctgaccttgaggatcagcactatatcgatctatattagtagtttcattattttcaccaacggagttatgggtgccatctgcatcgttagtattatttagccatccagattccaaaatcaccgttcttttaccaaattcattccaagccattttttcaatagcttcaagatttactggtgtattagctccgtatccaagatcaacattatcataccacccattgccttgtgtggtactccagaatgggtagtacgaagttccaagataatcataatctacattatttttctttaagacattcataatcccacgatatttattaatttccggagtttctaattgaatagcaactttaatagttggatcaattctccttacagcggaggaaccagcttgaatatatttagcaacttgatcaccatcactggtttcccataatgaagcccagttacctccaccattacgtccagtgtaaaggccaaatgctccattggtaatttcattaccaatttgaaccatctttacagatgcaccagctttttgcaaatcatttaaaattttagaggtgtaaaggtaaacctcttgactcatttcaccatgagataaatttctccaagcttttggcaaaatttgctgtgctggatcagtccaaaaatcagagtattgaaaatctatcaataatttaagaccattatcagatgcttctttagccatttttatgagattttcttcattattgtctccaccagcatatggctgcccctgtgcattataaggatcattccagactcgcaatcgtacccaattgacacctgaatcctttaaaattttaaataagttcgattcttgcccattaaagtcataaaattttacaccagcatttatcagcgcttggtaactcgaaacatcaaccccacgaaccatatcatcagtcattccagggatcttttcaacctttacactatcataacgaagtcctgtgtcagtcccggtcttataagctaagtctaactgttcatctgttctttcacttgcagggaccttactctcattagagttagtaccagtttcttgaccgaatacaagtgttgcagtgtaatttacctttagctgatctccgtatttagcacccttgttaagtgcaaggaagttatttaatttgtcatcagctgattgaccttctagccagaattcataatgataagcatcattaccattatagtaattcttagtgccttctactgcagaagtattacctgcaaaagcagcaaaaattgctttaagaacctcctgactaataattgtacctttatctccttttagaagttcagcagttccattagtcaaagcatttccgagatctgcactattaactacacttcctttagttaagccattatctacgtcaacatttacgccagccttcttaaagatatctgaaatagaagcactaatcgtggaagtagcttgtggttgttcagctttttctcctggtttaaataaaataattactaacttatttttatttaggtctgccccaacaccaagcaccgagttgtctgcatttgtaaagtcataactattcataaaggtattagtaatcttttgaggatcatcatttgtaaaatcagtagaatatactactaaaaccttaccactcagtaagttattagcttgtaatttcttttcaattacatttttatcaggattagtatcaccttgagctacttcttgtgcaatatcatgaagcgctaattcttgataatcgttattggtgtttcgccaatcatatttaacacctttaataccttggttagtcaaagcctgagcaacttccttagctactgtatctctagtttgacccatatcggaagtctcggtcgcttcaccattatcattaaattcgtatcctttaccatcaatgactcttacctgattagtaaccataattccttgattatcaaagtagtataccttaccatctctatttaagaattgatcggtgtaacgagcaccatcggaaccaaagtagtaggtgtggccccaattcttgtaatattggtcttggtacataattccttgattatcaaagtagtataccttaccatctctatttaagaattgatcggtgtaacgagcaccatcggaaccaaagtagtaggtgtggccccaattcttgtaatattggtcttggtacataattccttgattatcaaagtagtataccttaccatctctatttaagaattgatcggtgtaacgagcaccatcggaaccaaagtagtaggtgtggccccaattcttgtaatattggtcttggtacataattccttgattatcaaagtagtataccttaccatctctatttaagaattgatcagtgtaacgagcaccatcggaaccaaagtagtaggtgtgaccccagttatgataaaacttattaacaactaatgatccatttccatcaaagtagaataattggttctcatttgctgttaagaattgattttttaatggaataattccttcattattaatccagtagttaatcccatttatacttttaagctggttttgaagaagcgccccatcattaccaaaatagtaagcacgaccccattttaccatgtaacggttatcccaacgggcaccatctacaccaaagtaatacgtacgaccccaattattatagaagctattatctaaacgactaccatcattttggaagtagtaagtacggccccaattattatagaaacgattatcccaacgagcaccatcggaaccgaaataatacgtacggccccaattattatagaatccattatctaacctagcaccattggcttgaaagtaatacgtacgaccccaattgttataaaattgattacgatacaagtcaccattttccccataataataggtactaccattaatctctttaaaagaattcggcgttgatttctctggaatactatctttaatatctgtattttcagctttaacgttaactggagttgtttgttcttcactattattagatttagtttgttcttgattaatctgttgacttgaatctatatttttattctcatttatctctttttcattagtactattcttgtttgtgtcagtaaaagttgactccgaattagaatcagtatcactagtattatcgttttttactaaagaattattagcatcagaagtagatgtaatagtatctgcatcagctaaaacactaggcgaaccaatagcaagtcctatccctaaaacagtagttgcgattgctgcacaacaccattttttaccatctttatataatttaaaatgcttttttatttccatgacttttccctttcaataacgttttacctaaataatataaatcatcttttaaatcatttcaatcagatacttaataaaaaagcggtactatacattttcaaattatgtataatgcaatgccacttttttattacaattattttatttataagcaactaacttattagcataatcattgatcaaagtttcgttttgttcattattgtaaatagcggtaagttcctttaatggaatagctttctcaacaaatttcgaatgagcaatatcagtagcagtagttggatctacatatttaataagcacttgcccgtcttgaatttccttaaagtagaaccaacttgttggatcacccttagcagtaatgaaactgtagccatcatttacgcccgatgtaacttttccataatacatcgtatggttactcaaacaatccttgaaccaatcagcattctgatatagaccgactaatgttccaagatattgagtataatttactctattaataccatttggaattaatgctccatcttcattaaaaagataattttgtccattaatatcttgtttaccagttacgggatatccattttcatcaaaataaattgtacttccttcatacataagccattgattgactaacatccgaccttcactatcaaaataatgaatatgagtattagaatcatctttatctaagaattggttggtgtaacgggcaccatctgcaccaaagtaataggtattgccccagttcttgtagtaacgattttgatacattactccatcgttatcaaagtaatagaccttgccatctttagtcaaaaattggtttgtataccgggcaccgtctgcgccaaagtaataggtattgccccagttcttgtagtaacgattttgatacattaccccatcgttatcgaagtaatagactttaccgtctttggttaaagattggttagtgtagcgggcaccatctgcaccaaagtaataagtattgccccagttcttgtaataacgattttgatacattaccccatcgttatcaaagtaatagactttaccgtctttggttaaaaattggttagtgtagcgggcaccatctgcaccaaaataataagtattgtcccagttcttgtagtaacgattttgatacattactccatcattatcaaagtaatagaccttgccatctttagtcaaaaattggtttgtataccgggcaccatctgcaccaaagtaataagtattgccccagttcttgtagtaacgattttgatacattactccatcattatcgaagtaatagaccttgccgtctttagtcaaaaattggttggtgtagcgagctccatctgcaccaaagtaataagtattgtcccagttcttgtagtaacgattttgatacattaccccatcgttatcgaagtaatagactttgccatctcttgtcaaaaattggttagtgtagcgagcaccatccgcaccaaagtaataggtactcccccaattatgatagaacttatttgtaattaatgaattatttgcatcaaaataataaagttgattatcatttgcagttaaaaattgattacgtaaaggaattatcccctgattatttacccagtaatctttcccattaacatttaagcttttattctttactaaggcaccatcgttaccgaagtaataggcatttccccatcgaaccatataacgattattccaacgtgcaccatcattaccaaagtagtaagtattaccccaattgttataaaaaccattatctagccgagcaccactaggttgaaaataataagtttgaccccaattactatagaaatcatttttaactagctgtccttctgaattatagtaatacgtattattatttattgttgaaaaagtattaggagctcctgtttcaggaatagtttgttgtgctacatctttattttcagttgtttcaggcttaaccggcgtctgattatcactttgagtatcagtgccagtactattattaccttgtagaggattagtattagtgggagttccagtagttaaagtatctgtagcaggtgtctcattattaggcatcatatctgcatgcgctatcgaccctagactaatacctagccctagcgaaattgtagcaatagcaactacacaccatcttttaccgtttttatacattttaaaatgttttttcattactatcctctcccaaaaagttattacttaattaagtatatacctctatataaaattattaaacctattacaactttgccgttaacttcacatcaggatacttttgcttaaaccaattttcagcaaattggttttcaaacaagaatagtggctgatcatggatatccttgactaagatgtttcgtgatgatgacatcttttcatctaattggtctggatcaatccaccgggcagtcttagttcccattggttccatgacaacctcggaattatattcattttgcatccggaacttgaatacctcaaattgcagttgaccaacagcaccgagaatataatcgccagtagaataactccggtaaagctggacagccccttcttgaactaattgattgattcccttgtggaaggacttttgtttcatcacattcttagcataaacacggacaaacagttctggcgtaaattgtggtaacttttcaaattgaatatcttttttaccattgtaaatagaatcaccaatttggaagtttccggtatcgtataaaccaataatatcaccggcaacagctgtctcaacattttcacgggtatcggccataaattcagtcacatttgataaccgcattggtttcttagtccgtgataatgttacatccatcccccgatcaaattcaccggaacaaatccggacaaaggcaattcgatcacgatggcgaggattcatgttagcctggatcttaaagacaaaaccagaaaattcgggatcaaggggcttaacaacatcctcgtcctcagttttgtgatcacttggtgcaggggcaaactgtaagtaggtttccaagaaagtctgaactccaaaattagttaaagcagatccaaagaagactggtgtttggtcccccttggcaatcttttctcggtctaattcattaccagcaacttcgactagttccatatcatccattgcatcttgccattcaccatcaccagctaatgggttatctcctttaacattaccgtcttcatctaatggtaagtaaggattattttcatcagctgggtgagtcaaggcaacacgttggttaaagcggtcatagattcccttgaactggtgaccagaaccgattggccagttgattgggtaagtttcaattcctaatacgtcttcaacttcatttaaaaggtctaatggttcgcgggcatcccggtcaaatttgttcataaaggtaaagatcggaattccccgcatcttacaaatctggaacaacttcttagtctgcggctcaatccccttcgcgctatcaataaccatcacagcggagtccaccgccattaatgtccgataagtatcttcagagaaatcttcgtgccctggagtatccaaaatattgatccgcttaccttggaaatcaaactgcataacagatgaggtaacagagatcccccgcttcttttcaatctccatccagtctgactttgcaaagttaccggtcttccgtgctttaacggtcccggcttcacgaaccactcccccaaaaagcaagagttgttcagtaatcgttgttttcccggcatccgggtgagaaataatggcaaacgtacgccgtttattaactgcttcagcaagttcttttggtgacattaaatttttcctttcctatatattatttaatttaaatctgggtaatatctctactatattattacaattttttatgaaagtctattcttagaaaaagttacagaaagtttaaagtcttacgatatatttgaacttgatattaattttctgctatattaataaagttagaacttattttattgaggtactttgtatatggataataacaataatcacgaatcacgggaacattaccgtaaacggatggaagaacgtatccaacgtgacgttaatgagcgtaaacggcgagaacgcgaagaagcacataataatcgtgaaaatcgattgcggcacgaagaagcacaatcatcaccagactttcagccaccgcaaaaacaccactaccgaactcctaattgggtacggctcctgattggtctcctaatctgccttgtggttgctggtggattttacgaatatcataaagttcactcagttgccaaaggagtgtttggcgctggtgatggtaagattagtaagaagctgcaaaaaggtgagcctgtctctgttcttacgatgggaaccgatgttggtgccctagatcggggtaacaagggtggtaataccgattcactagaattattcaccattaatccaaagaacaaaacaatcacaatgacgagtattccccgtgacattttagttcgtgtcgaaactagtgatggtccagactatgtcaaaatcaatgcggcttatgcaattaatggccctaagcaaaccgttaaacaagtatcagaactacttgatgtgccaatcgattactatgccgttatcaacatgggagttctcgaaaaagttgtaaactctgttggcggagttgaagtcaataatccatttgcctttgactatgaaggtcatcacttcaaaaaaggaaaacaacaccttaatggaacaaacgcgttgaagtactcacggatgcggtacgatgatccaaataatgactacggtcggcaaaaacggcaacaacagattctgaagagcgttatcaataaattcaaaacttccggatcaattggagcagctaataagattcttgatgctgttggggatggggttaaaactaatattccgattgacgacattgcaaccctttatggtaactaccatggagcaatgaataacgttaaaacgtaccatttccaaggtcaaaacgcaacaatcgaaggagtatccttccaaattgccagtccaaaagaaatcaaccgggtatctaaattagttcgtgcgcaactgggcttaaaagctaaaaatgttgttaatcacgaaactaagatgtacaagtcgcaaccacactacaacggatataatgaaactaacttcattcttccaggtggtgcaagttacaacgatcctggtagtggtaatggtagcgatgaggttactggctctagtcaccattcacaaactagtcaaaacgaaggagaaagtacctcagtaaacaatagcagcgaagcatacagtgaatcacaagctgttcctgctacagaaaatcatgcacaggctgctactacccaacgttactcaacaccgcaatatcacacttatcgcagttataataatggttatcattcaacctacactcacccagcatacggtaaccattatggatatacacatcgatattattaaagaaaaaatcttcgttgaaattaaatcagcgaagatttttctttactcttgttcttcctttattggatgttcaattcggtaaatatcaaagaagtattcacaaatggtcttaataaccgcatagaatggaatacaaagaatcattccaccaattccagcaatatgaccagcagcaagcaacagcataataattgttaacgggtggatttgtaatgtcttaccaataatgtttggataaacaatgtttccatctacctgttgaacaacaattacaacaatgattacccaaataattttatttggcgccattgttaatgccacaaataaggcaggtgcaatcccaatataaggcccaatgtatggaataatattagttagtccagcaacaattcctagcacgattgccaatggctggccgataattacataaccaattgatgtaaacacaccaacaaataggcactcgatcatctgtccggaaatatatgaggacaaggtggaattcatcttcccaagaagctcattcacctctttagcatgatgcggtgaaagccatttctgaatacttggaataagcttagaaccatccttaagcatgtagaatagcattacgggaacagtaatagtcacaacagtaacgtttgtcaacatcccgataatatcaccaacccgttcagatagtccttgtagaactttttgagcatagccagctaactggtgatcaaactgacggtaataagaatttaaatcaacgttctttaaaaatgagtgttgaatagtatcattaattaaatgctgtaatccggtaactgtttgcggtaaatgacgaactaaggaagatatttcctttactaccggcggaatcagcatcgttatcccccgacaataatcacaattagcaacagcacaattaataaactagctagccccttgttcatccgaaaacgaccaattttaatcttcataaaaagctttaaaaccggatttaacatataatacaagaagccagagataatcaggggaacaaaaacaactgaaataaaagttaaaaatggttgaaatacaaactggattttcgtacacatccagattaaagttgctatcgacaataacattaacggccaaaaagccaatgataaaatttttgcttagacatagatactccttaaataaaaagaatcaatatgtccattataaaagacatactgattcttttaaattataagtttaattacctgtaacagaattggcagtaacatggtaagtatgaccatttccagatacagtccaattattagtaccgttttgcgtagcagtgtaaccatctactgaatcaattgatggcaaatcatcagtagactttcctgctaccccacgatcatttaattggttaccaatatgttccttaacaatattccgcgcatcggtagcagtcattgttgactgttgggcattagagctttgttttacgcttgacttagcagaaccgccgttacttgatgtcgttgttgaagaaacagcataattagcattacttgatgagttacttgcactagaagtactattcttagaagatgcgctattttcactagtttgagaatcttcattactattacttgcagtttctttttcagaactaaccttatctttattagaatggtgcttcttagtaaccttacttgaggtaacttcagaactactatcagaattatcagaagcgctattattaccacacgcagctaaagttaacattaaggtcccagcagctaaagttgtaaataatttatttaatttcattaaacttctcctcgtttctatatcatcgctattataacagagatcattattaattacagttaactaattatatcagaattacatattgatgtagaagcttggcttaaagtattttgagtaaccgatctttacaacgtcacctggttctggggcatgaacataagtaccattaccaagagaaatagcaacgtggtatggtgcaccatcactaccaaagaataataatgaaccttttggcgcattcataacatcacgcttgtgaattcctaaagtagcttgttggtaagtagtccggtatgatgcccctaaaccataagcccattgaactaaaccagaacaatcaaaaccagctggggtgtttccaccccagacataaggaacaccgcgttgtgataacgcacgatctactttagcatcagtattattctttacggttaaaacacctgctgaatcagcatgatatttcttaccattaactgttacatcattattttgaactaaagcaccgtcattaccaaagtaatattggtggccccaattagtataaactgaattatctagacgagcgccatctttaccaaagtaataagtatgaccccagttattgtagaaactatcgtctaaacgtgacccatcagcttggaagtaataagtatgaccccaattgttgtagaaaccattatctaaacgggcgccatctttaccgaagtaataagtatgaccccaattgttatagaagccatcatttaaccgcgtaccatcggcttggaagtagtaagtatgattattttggtttaagaaataatccttttgttgttggccttgatcattaaagtaatattgtgagccgttgatgtctttaacaccagttgctttttgaccatcactgtagtaataagtgttaccattttctgtttgccaaccatttaattgagccggtgcagctgcttgaggcttaacggctacagcatcagtagcaatacttgtactggtgcttgctgactgagttacttgacttgccggttgagcaacttgactagactgagcttggttacctacctgtgatgtattatcagtagccgtactattattgatagctgtttgatcagaaacttcaacttgttgtgaagttactggtgtagttgctgcatctgttgtgtcagcattagctacactagtagttgatactccaaatgcaattgctgctgtagcgattgccatgtagcaccaatttttgcccttcttaaacattttgtagtgtttctgttctcccattattaataaatcctaccttccatttgtcatttcttttctttagataaatttaacgattattactttaccacaaataaaaggctggtaggcaaatctggctcttttgttaagcaatgataatgttcgcaatactaatgtaatgagaatgtcataatcgagtaggagataattgattagttcaattatcgacctctcacaccaccgtacgtacggttccgtatacggcggttcgacaacttaatcacattgaattgactggagcgtcttggatatattcataagtccaagacgctccagttttctattagttagagaatagctcaaggtcttactatgtgcagttcgccagtagcccttgcgggtactagcgaagacatatgcatcacgctgggacagccccaatttctgtaagttagttaccttagttttaaactttttccattgcttccagatatactgccttattcggaccctcaaccacttgtcgaggcgttgaataaagttagttagtttcccaattgagtagtactgaagccacccacgcatttttcgatgaatttcttcaaacattcttgtcagagatattccacgattacgtttagttaataacttcagcgctttctttactcgttgttgcgattgtttagctggacgggcgtaggccccattgtggtctacacccaacgaaaagccaagaaatttcaaccgtagagggctaccgactttggttttatctgggttcactttaactttcaagcgcttttctagaaactgggtaatgcttcgcattactcgttctccggctcgttgacttttaacatagatattacaatcatccgcatagcgcacaaagtgatgaccacgtctagtcaactctttgtccaactcatttagatagatgttcgccagtagtggtgacaatggccctccttgtggggttcctttttcactcttagcgaaaagcccatggtctaagactccgctagttagaaacttacgaatgagtcttagtgtccatgggtcatcaatatattgttggagatacttaatcattaagtcatgattaacgttatcaaaataggcttttaggtctaagtcgacaactcttcgatagccttgattataaagatctactacttttgcaatagcgtcatgggccccacggtggggacggaagccaaaactattatcagagaaaacacgctcaaagataggcgtaataatttgggctacagcttgttgaaccattcggtccaccacagttggtattccaagtcttcttactccaccattaggcttcggaatttctacccgtttgactggtgctggtttatacttgccctcacgcaaactagcgatcagttccatcttattttctctgagatatggcagaaggtcattgactgtcatatcgtcaatgcctgctgctcctttatttctcttaactcgcaaataagcctgattaaggttattgcgatccaagactaagtcttggatagtgacactcatacctttaacttcaccataaccggtactacgcgcccttgtgtactttcggttttccaaacctatcctcgacaagaggtcagcttgttgttctgttttctgcgatcgtcgcacctgattacacctccgatataagttacaagttattgtcgttcagtccttcatctgattactcaaactactatgacctcggctgactcctgacttactcaacgctacatcactgtaccgcttgcttctgtggaaatttatcttattcctcttgtcggaagcttgtaagtcaggcctccccgggtaagaatattagctttcgtaccatgtcatcgttagctttactgagaccaacttcgagtagtattggacttcaacttgtctagcagccttatccagttaatttcagccttatagctacttcttgttcatcgatgcagtactttgccttagacttccttcagattccacctcacggtggacacccttgtcctcagttcatggttccgactactacggcccatagcggactttcaccacctagctaatacccatgccgggcgcactagaaaagcagtccatatcaccaagagaatatgaactgctttatttttagataaaattaaagattaaaggctacgcggtcatagcgggttagatcataggtattaattacactacgtaatgaattagtatagctagatgctgttgcataaccatctgcccgaattaaataagtagctgtatttgcatcacgaaccccaattaaattatggtaacggctattcttaactaagaagtcagtatggtcctgaacactagcattattatctggatagcgacggaaagcatcattaattaagaccatccgtccaccgtactcttcataggttggcatattaactgacatacctttatagctccccttaataccaaacaaattgtggtattgtgaagcaagcgaagacttaccccatgcgctttcaagaattgcttgagcaagtgttaatgacggcaagatttgatgttgtgtccatccttgaatagcaccattgacgatactgccaataaaagcattattagaggttaaacgtccttgactatcaaagtcaagattaccataacctaaattaatagattgaccttgaagcaatgccccatctttgccaaagtaatatacattaccccaattgttcataaaacgattgtcccagcgagcgccatcactaccaaagtaataggtatgaccccaattattataaaaactattatctagacgagcaccatctttaccgaagtaataagtatgaccccaattattgtagaagccattatctaagcgagcgccatctttaccgaagtaataagtatgaccccagttattatagaagccatcatctaaacgggcaccgtctttgccaaaataataggtatgaccccagttgttatagaaaccatcatctaaacgagatccatccttttggaaatagtaggtgtgaccccagttgttatagaagccatcgtttaaacgcgtaccatcagcttgaaagtagtaagtatgattagcttgattcaaaaaatagttcttttgttgctggccttgatcattaaagtagtagtctttaccgtcaatactttgttgaccagttactttttgaccatccttgtaatagtaattattaccattatctttttgccaaccattttgagaagccgctgcctgtggagctaccgcaaccttactttcacttaaagttgcttgaacattgttatcttttgctggttgattaatagtttggtcagcttgtgtattattattgttattcgtcgatgcttgtgctcctgcttgatcagtagccacattatttggtgttgaaggtgttgttaatgatactgtattggtaacttgacttagtgcatctgctgaagcattacttacactttcagtatcattggctgtagtatctgcattaacactttgagaaacagatagcgtaccaacagctactgaaagcgtggcaattgccatgtagcaccagttttttccctttttaaacattttataatgtttatgaacactcattgacttatttaccccttttttatttttaacattatctatcctatcacatgtttttaaataagttctcattctattaaattgttactaaaggataatttttgaaatatttttgtaacttaaaagcgttgattaatataatcaacgccctatcatattattagcttaatttagaatactcataatttactaattgtagaaaatcattcatattatacccagtaccaaaataactgctagctcgattactccagtaaccatctggatcagtatgattagtattacctaagtattggctaacattatggtgtgaccaaagagttcctgttccattggactgagctaatgatggtgtcaatccgtacttgcgcatgttgtatgccgtgtagtaagcagcattaactaattcacgagcaaaattccaggcaccataaacttcaacctgttcaaattgaacagcacgaccgttggcaggatatgcagctccccatgcttcatgatcggtatcggaaatttgaataatgttattagcatcaacaaatgcatgaacaaacgcactattataatgctgcttttcgtaattaatttcaccccaaatactatcattgggattatcggtttcatgtactactaccatattaggcttaccgtctgtcgttccggagtatgaatggctacttacatcaggaattgcattaacatatgaaatattagcatgaccaataccattattcataatgtaactattaatcttattattgtaaactgagattggtaaaagaatcccactgttatcggcacgatagaagcttccattaacccaaattcctgtgccttgtactagggctccatcattaccaaagtagtaagtatgaccccaattgttataaaagccattatctaaacgagaaccatctttttggaagtaataagtatggccccaattattatagaagccatcgtctaaccgaacaccaccttgaccaaagtagtatgtgtgaccccaattgttataaaagccattatctaaacgagaaccatctttttggaagtaataagtatggccccaattattatagaagccatcgtctaaccgaacaccaccttgaccaaagtagtatgtgtgaccccaattgttataaaagccattatctaaacgagaaccatcttttggaagtaataagtatggccccaattattatagaagccatcgtctaaccgaacaccaccttgaccaaagtagtatgtgtgaccccaattgttataaaagccattatctaaacgagaaccatctttttggaagtaataagtatggccccaattattatagaagccatcatccaaccgggtaccatctgcttggaagtaataagtatggttagcttggtttaagaaatagttcttttgttgctgaccttgggcattaaagtaataattcttaccgttaatggtttgttgaccagttaccttttgaccatctttatagtagtaactactccctttatctgtttgccaaccattctgtagagcggctgcttgcggagccacagcactcttatttgtggctgaagattgttgatcagtttgagtagttgaattagcctgatcatcttgcttagccgtttcacttgtactttgcgttgcaggtgttacttccgcagcaacatcagtcgtttggtcctgtgccttttgtgaagctactataacactggtggtattgactgtactatcagcacttacccctgtgaaactgataaagcaccaactgctactaccaatgtggcaattgccatgtaacaccagttctttcccttcttatacatcttataatgtttatggatactcattgatgtgtacctcccctttttatttataatattatctatcctaccataattacaatttttaaaatttcatttttttagaataattttcatatcttatgtgaaatctaggtctcatctttacctctgtaaagattttacctatatactcacctaagacacttagtgaaagaagctgcactccccctaaaagccaaatcgatatcattaatgaggaccagccagaggtcgttccccgctaaacttctgaactaacgtataaatcataagaacaatacttacaataattactaatattccaagattcattatcaactttattggtgttgtagaaaaagaagtaattccgtcaaaagcaaaatgtatcattttctttaatggatattttgacttaccagcaaatctcttctttctcttataaaaaactttagctgattgataaccaataagaggaaccatcccccttaagaatagattccgctctttatattccaacaaagctaaaacagctttcttactcatcaatctataatcagcagaattgggtactaactgtactcctagttttcgcattagtgcatagaaagccaaggccgtgttcttcttaaagaaagtatccgtttcacggctgctgcgaacaccataaacaatttcatttccttgatgatatttatcaatcatttcatacattgcattaacatcatcttgtaaatccgcatcaatagtaatcattatatctgaatattttgaagcaatgcttagacctgctagtagtgcattttggtggccataattacgcgtaaaagtaatcccagtaacatatgaataatgtttactatagtcctcaattagtgtccacgtattatcgctgcttccatcatccacaaataatattttgcttttagcagagacctttcccccatcgattaagtcatttaaaatcttaccgacttcttttcgtgtttccggtaaaacttcttgttcgttgaaacacggaataataatcgttaatatatcattcattagttttcccctatactttaactttttgttctattgaattaaactagtaatttttcacattgtttctctaggatcttaagattttttcatagaattgattcagctcttttaattgacttctaagcctctttaacttgctaaaaaataacgtttaatgggcctcaactaaatttgctaaaaagctagatactatatcaaataattttccaaatagctttctaataagaaaatcaattataatacataccgtaaaaaccaaaaaagacactattaatgcatttcctaaatagctaagccaattatttgcaaagcaatttgaattagcaatatgctgccatagaataggacggataaacgagtcctcgctgatcaagtataccccaaacattgacaaactaatctcattaatcactttgctataaaattcaaaccttgtgaaaaaaataaatatagaaattgccaagaaaaggtcaatcggattatagagtaatacaaaaatattataatgattatacaaaaaactgttttgagtacacaaatacatccacagtactactattattattcctataattagcatcttccagagattattacctccatataaaaattctagtccgtgtctttgaatgattccaccaattaaatataataacaagaaataggctcctgctgaattaccgaaaacatcatacgtaaaatcgggtttccctggaaaaataaatccgagagtcggcaatactgaccaaaaaagcactagtatcataaacgtatttagcaacattttcatactaaatttttgtaatattaggttcattgccggcatacatagtaacataaatatatatgctccaacaaaccaatatccacttggcaaaggaattggcaaaagtaattgtgatactgtttcatctacagacttaggaaatagaagttttagtaaaccgaatatcaaaaagctataaaatacagttattgttactaacttaatcggtcgcctaacactataacttttctgagacagaaaatatgcacctagaattacaaataaatctacccctaacttcccaaacaacaaaattatcatatttattcttaaagtcggtaggtttgctatagaatactgatgccaattaaaagtcccatgataggcataatgatgtagcacaattgcaaacatactaataattcttagtaattcaaaactagagtttcttcgcactttcatatagaactctccctacattttatcctttaaaataatacgttgtataatatctgcccgtttgtattgttttataagaagctttgtccatttttataccattttgaactatatatacccctctttttttactcttcaattttctattgatcggcaaatcaacaatattccattttccaaagtgattataagtcataaattctgatggctgagcatatagagtctctctatgaaattcataaggattaatttgttggtagaaaataggtaaaacaaaataggataatgaattcgtttgtctaatatcatggctagaaactaaaaatacattattataagacgcagcatgatgtatcatttcttttaattcacttggtgttgtattttcatagttgttgtaagttccgttattataatcattaacataagatttagcggcacccaaaaagaaaagagtaaatattaccatgaaagtaattaaactttggtaattatcaaatgcttccattattccccttgcctcaaagtaaagaattggaactataattgcattaaaatgcgtaaaattaggctgtatcaaaagtaagttccataaagctgaaattagcattatgaacataaaagtatcaagtaccgacttttctttaacaatataggtaataataccgatgcaacaaaaagaaagcattaatggtaaaaaagctccaaaaaattgtggagttattttaggaatcccgtcataaccattaattagcattttgatagaatttgttaggttattaataatgcttgttaataagtgcctattctcaatagcaaaagctgatcgagaagtggctaacttagtagctgtaaatcctccaaagaaaatttcccttttactaataaagttaacatagaggaaaagaattaatggaaggcattctattaataaaataataaatgagactagcacttgtttaatgtcaatctttccttttagaagaagccatgtataaaagcaaatagcaaaagaaaataaaaaaatccaattattagaataacaataagctaataatccaataaaaatcgttatagtaatcaaataagcatttcttgcgtacttactagtcgttgatataaatagaataaataaacttaatataactacgactagcggaataaacaaattactctcaatagcccatctgctagcacatatagttaccggacttagaaaaataactatcaatagcattaatctttgaatatttttaagtattcgtgtcttatataacgaatatgttagaagcaggattgagactaaattaataataattaatggtagtcgatacgtagtaatcgttaatcctaaaattttaacaaatggtactgaaattaagggatataagatattcattccagaaccccaggcatatagataaactggatttttcactaaatgaaaataatcaacaccatactttcccaacgaccaagagttaattcctcccattgcttcatcaagatccaaattaggaagcttatcaaatttataaattctaaccataaatgccaaaattaaaaataccaatagaaatattttatatttgatacttacttttcttattgtatcgttctttcttataaacacagctataaccaaaaaatatactattgtaatagtgaaatatattatctgcattacattgatcctttatttatctgccttaactactatccaattaataattgagtggaatataactaattaattcaattggcaatcactccacactattatacgtacagttcgccagtagttcttacacatactagcaaagatatatgcatcgcaataaaacaaaactaacttttgtaggtaacgtcattaagttagtgttttaatacttaatgtttgattttctctctgtattttgaaatattttagttaacttaaaaaccatctaattggcaattccctgattgttaattaggtggttttgtctatttaataaattgttatagcacttccattgtattcagaagcaacgctcccccacgaacgccaactatctgctcctgtatcataagcatttcctcccattgaatgcgcaccttgccctctgccccagtaacatggatccaatacgtggaaatagccattagactcaccaattataacttttgcatgattacgatttccatacatccgttcaaaggaagaaaatccataatataataccggatgaccagtggcaactatagaagcaatttgagataagtccttaccagaaatatcacgtacactactatctatatttttatatgcccaccatgctaatgctcctgctggaatgatacctgaaaaggcaccagtgttatacacaccgccagactgtggtacatggttataggcatatcctagattaaaaaacttacctttagtacttaataacattgccaatgcagctactgagcatccttccggtgcattgattggtgtaaattgactaaagtattgagctgtgcgcaaggaaccgtcagattgagcataccaatcttgtgagttaagaaatacataaccatttctcagcaaagcaccgtcatttccaaaccaatatgtatggccccaattactatatgtttggttagtataacgggcaccatcatttccaaaataataagtattaccccaattattataaaagcgattatcccaacgggcaccatctccaccaaagtagtatgtgtgaccccaattgttataaaagccattatctaaacgagaaccatctttttggaagtaataagtatggccccaattattatagaagccatcgtctaaccgaacaccaccttgaccaaagtagtatgtgtgaccccaattgttataaaagccattatctaaacgagaaccatctttttggaagtaataagtatggccccaattattatagaagccatcatccaaccgggtaccatctgcttggaagtaataagtatggttagcttggtttaagaaatagttcttttgttgctgaccttgggcattaaagtaataattcttaccgttaatggtttgttgaccagttaccttttgaccatctttatagtagtaactactccctttatctgtttgccaaccattctgtagagcggctgcttgcggagccacagcactcttatttgtggctgaagattgttgatcagtttgagtagttgaattagcctgatcatcttgcttagccgtttcacttgtactttgcgttgcaggtgttacttccgcagcaacatcagtcgtttggtcctgtaccttttgtgaagctactataacactggtggtattgactgtactatcagcacttaccccctgtgaaactgataaagcaccaactgctactaccaatgtggcaattgccatgtaacaccagttctttcccttcttatacatcttataatgtttatggatactcattgatgtgtacctccctttttatttacagaattacctaccctaacataactacaacttcttaaatattttagaatgttttagaaaccccattttttaccttcccaatttcattttctattcaataatagcaaattctttgtaaattagaaatgctcaattaaaaaaacttacgtacttcttgcaatctaaattcaaattcccttctctcctgccgttgaatagcatctagtgttaatccactgtaaaaagagattatagctgctattgcgcaaaagccacatataataagtgtcggcatgtttgcaacaactccagtcatcctatatggaatccatacacgtggaataaatactgctatcgatatgatcatcagtattaacgatagtataccgtagaaattaaagggcttatgattccggtataaagtaaatattaacctaagaaccctaaatccatcggaaaaagtatttagctttgagacgcttcccataggccgatcacgataatcaattacatagtttttaattgccatattattcactatagcaaaaatactcatttctgtttcaatttcaaatccacgtgataacactggataagtcttgacaaactccaaactaaaagcccgatatccagtcataatatccttgatatcatttttaaagaaaaaattaatactccatcgtactagtttattaccgatcccatgaaaagctcgcttattttcagtaaaatagctagaactaaggcgatcaccaattaccatatcatatttatcttttaaaatgtaattagccattttaggtatttcttcagctggatatgtatcatcaccatcaatcataatatagcattcagcattaacttcgcgaaacattctcctaataacgtttcctttaccttgtttatgttcataacgaacaattgccccagctttttttgcaagttctgccgtattgtctgtagaattattatcatatacgtaaactttagaattaggaattgacgaaacacttttcaggcaatcttcaacaactttttttattgtttttgattcgttgaaacagggaattaatatagcaattctatccacttaacattcatccttccttacatttcttatatagtaaatattatttttaaatatctcaactatattcacaaatccaattcctgctaaagtagtaatgaatgggagaaattgaattaggtatctacttcttccgccttcaaataaaagcaaaaatatcattccgccacttactacatactttaataactgtacttctatttgcgaattcggtaaagtagctaaaatacacaatagtacaactatccatagactttgtacaattaaactattcccagaccaatcctttcctgaagtatccgaaacgtatgttttttgaatttttgctatcaaaggattcttagaattcgaatatggtatcaaaaagccaacttcgccaccatcatttcgccaaccaaaagtagcatcagacgtattagaaatttgtttattgaataaaaacttagtatagccgagcacttgtttctcgtgcaatctttcttttataaggttaatgttcatttgatttcttttactttgatctttaattttttcattaagcaaaacatcctgttcattatatcctccaccttgtgctagtcccattgccatatagtgtgtaagagtcatggctctttccttttcaacttttacaagactggtatgagaagctgcactgttgaacacaggaattataattaacggtaaaattacgaaaataattaaaataaaaaaatgctttttgctgatttttctattcgtcatctcaacaaatcccattaatatccaagcaaccatatataccatcaaactcggttttactaaataggaaatagctaataatgtcccaagcccaaggcatagataaccttttttaccaaaattagatgttcttataacacgataacccattgctagggtaatagtactaaaaaataaggcccaaatatcactatatggtattgctattagtggagaaataactattaaagtccaaaagaaaaaagctgagactacagatatttttttgccaaatgttttttttagcgaagagaataaaataagtaatgacgtatccaataacagcaagtttataatattaagaatcttagttagtgttattaatctagggtgccctgcaactatataaacaaaatgctcaaaaaacagcaataataacgtatttggataaaaagaaaaatagtcttttacccaataactatgaccagcagctgctctcactattatagaaggatcccatgtagtacttccagctagcgacatcacaatcataaattgccaaagaatcgtaactagaaaaaatagaactagaaaaacgcgtttattcaatactataaattttcttattttctttgccaaataaacgctctttccccaatatgtacctataaaagctatcagcattatcaaaacgatactgatcaacactattagtttagaggatcttccaataatagtcggtaaaaccacaatggcacctattatagatactacaactaaaattactagaaagaaattaattattagattacttaatcgaattagcttcatgctcttccctccatcattttttgactctctgatatcataattccaacacataatggaacaactgaaacaatcgggaaagcatatctatataaaacaacagggcctagtaaaaatgttcctagtaggcttaaagttaaaactattaggaaaatatattttctttccttaaaaataatcatccacgctgtaaagaataataagataaaaacattaaaaccaatgctatcaatcatcgatattacaggaatacgctggtttggataactattaacaaaattagtatagaatttatataacggttttaaggctttaggtgttgctactctttcatgatgccatgctttctcatttttgtgttcttgcttaacgtacgatgaatattctaagaaatacttgtaatagcttcttcgatccggataagaggtatctgggtaccaataaccaatagtcatcttagcaaaagcattcaaatattcattaggattttgttttgctaatttgaaccataatttccaaaaattctgtttgttttttatatactggtcggaattaaaactagacttaagtggatcagataaagactgacaattttgagattcatacattttataatttggaatataaattctaacttgatttacctcatctgaagtaatatccaaatttttttgtgacgcaacacttgaaagctgcataattggaatgctcaaagattcacgtaccctatcctctttatctatatgcccatttagacttcttgtcacggggccattatagataactgttccaaaaagaattgcaatacaacttaatagcagctcttttcgaatacttttttggaaaagaaatgcgaaaacaagagaaagcgtgataacatatacgccttgattttcaaatattaaattaatgagagcaaataaaacaaaaatggtccaatactttaactttccgaactttaataaccaattttttctttctaaataccacaggactagaataataaaactagctgtataaggtacattttttgttacagaaatcgacattatgcctatatatggtgaaaggcaaaaaattacaaaaaaacatatacgaatagcatagtttaaatttatttttcgtagatattctaatactcgagaataagcaaacgagagccataagatttgtaaaaacgtataaataaacagtccttgtgtctcgccacctaaaatatttctaccaatttttaatacaaagaaaattagtagttccgtatgtgcaagtggatgatgaagataaatttctctagtatttagataactttgtaattggtatcccgcatcataggcgtaattacctggataggtagcaaatagttctattagccaaaatattatcataccgaaccaaagcaacttccacgtttccctgcaattgaagaatctttgaagggcattattagtagagaaaatagaattgagctgcggaagagaaagatatatataattaactattacaaacaaaagaggtaaattccctatcacctttatccatgtctttaacgacatgaaattcacattattataccgatataaatttactccaataactagtaatattgaataaatagttgccaaacataaaagaacgaatattgatcttcttgaattttttaaaaaatcagttgaactatacaatttgtaaattacaacaaatagtaaaacggaactccaactatttgtatatgataaaccttgattaggatctttaattaagtattgaaaaaacacaactgcttcaaaagaaagaataaaagctaacaatttatacagactttttctattttcttctatcatttttcttcctttcttttttaactaagaaagtctttaattcactaaaagggtgttgccgatgcatataaaatgatcttaaaaaaggtatgtacggcatcattaacgcaataatcgacacaaataatattcggtatacaacaccaaaagcaatggctggtaaatagccgaaatgattatttaccatttgaataaccttaggccataattgtacataatcaagatcaattaagtggaaacataataaaataagagactgttctccaaaaaataaaaagatcctttcaaacacctctattacactagcagttaagttttctatatacatactaaacttcataactactatacttgacgttatcccaactggaagcgcaatataaatattcgttgcattgaccccttcaaaatcaaataggttaaaaaatgcatcccaaatccacaataatagcagcataactattactaaccaattcaccttggatagaatattatacttttttatcaaataacctgacatgagaaagcactgagctattaacgcaggttgtactgaaaacggcaaaaagaaatatttagctgtttgaacacctaccaaagttaataatattattaccataactttgtatcgtacttttattttgagtttcataatcaaattaaaaatttgattagcaatgaacattgccattaaaaaccaaatagcacctatagcttttatttttatagatgtatctggaataaagacatctccacctgctccataaatagcagagaagaaaaagtctctaaatgatgaacccctactaggcgcaattatactgttaggaaccattctgtaaaggaacaataagataaatccaatcgcaactgttgcaatgtaaggcattaataggttaaaaaaattctttttttctagtgttttctgattttgctcatgatataaatatccacttaggataaaaaaaattggcatatgaaaggcaaaaaggaaattacccaaatatccaggccaatagttgcctaacgaatgtcccgcaacaactgcaataatagcaattcctcttgcaatatcaatccatgcaattcgtttattttttgtattggttttcatctatcttaaaatccatttccttttaaatttagtttcctccagaagaaagcgaaaaatgaaggaaagtaatagttaagccaataaattattttatctcggctaggtaaaatatcattctttaaaaagtcataacgatactttttttgattgtttctcaactcatccatcaatttgggagaaatttcttttttattaggagctaaataaatatttctgagaatagaggttgaactccatagaattgatgcattaatggcactcactactttaggataattcattggctcaacaataagttttattaaactataagtttttaaaacatctaaggattcttttttaaaatcactaccgtacttattagaattaatttggctatcagaattaactatataatgatatttcacttcaggatttaagctaatacggctacaatgagataaatatttacaacagaatagtaaatcttcagcaatcttaatcccattatcaaagctaattttattctctcttataatggataatttaaaaagtttattccataagtatccttcatagccggtactaataaaaatatcatgtaatgcttcttcacgacttaagttttgctttgtacctaatcctttaaaacgaactatcccatttttttcttctttgcagtatccaacaattgataaatcacactgttgtttcttatattgatccaacaataattccaagtagtccttttcgacatagtcatccgcatctataaaagtcacatattccgaatttgccaattcaagacctcgattgcgcgtatctgaagcaccagtattagatttattaactacctctactctgttatcatctttatattctaacaacttatttaacgtaccgtctgttgaaccatcgtttaatacgattattcgatatttttcttcagtggtttgattaagtaagctataaaggcaacgatcaatcgtatttattgcattaaatgccggaataataatgttaattttctcttccatctgttcttctctcttttaatattttcttaacttgatttactattggtgcacgtaaagcaattatacaaatgatataaatcaaggcacccaaagcaacctgtaatattaagttagctattgtcatattcataatattatcaattcttgatacaactaaatacataaaaaatccacttaaaatatatcgccatataggcgcaaataaccgtctacgtcgtattgttccttgaatataccatagctgaacggctgttactgaaaattcagaaattacagtagctactgccgcaccatttgcaccgtatcttgaaattaaaaagaggtttgtaataatattgactaccgctccaacagttactgaaatagtaaattcgtgttcacgatgaattggcattaaatattgggttcccgtaacattactccacgcaatcatcaaaatagcaggtgcttctaaaaagattacacccccagtcggctcgtactcatgtcctaaaaaccaaggtgcaaatttataggcaatcgccattaaaccaaacatcatcggaactgaaacagcagttacaaagtcaaatgatttatataaactatctctaacccctttaacatccccagaagcaaacttatttgcgatgtgagggagcattacagttcccgttgcagtaactattgctaagaccaatttcacaatattatctccaaaattaaattgcgaaaccgctgcttgcggtgccatgcgccctagcataatccgattaaccactaagtatatttgagtagtgattgttggaatgaataataacaaagctggataaaaatgttttaacggatgccattctttaatttttacccattgaatattttgtcgtaagtatggccataatgtaagactacccgctaattgagcaaatcctaataggaagatatatttcgctaaatcgccttgattacgaaccataataaaaatcaaggcaatcgtaattaatttaacaattgtatttctggaaacagttttcttgaaatcttccattcccataaaataccacgaaacatcaatcccgtaagcaacaatccataaagcttgtaagagaaaataaaccttaaatgcgctactgaataataaaaccgccaataagtatattattagtgcaattgaactggtaaaaatctgaagagacattatcccccaaaaagtttttgaccgattatatttatctcctcgttgataggctatttctcggttaccatacaatgaaattccaagttgtccggcaagatagaaaaaagttacccatccattcgtataagtgttaattccgttattatttgcgcctaatacccgtgatacatatggagtggtaatcactggtgccaacattaataatatttggtatcccgcattatataaatagtttttaatgaccttcatacaataacctcgtctatcctttcaaactaaaaactaattttaccactgtcctcttataaacaaaaggtaaccttaatcaatattaaaaacgacgagttaagttttcccactcaactcgtcatcaggatttattcaaattctttattaacagccgtcaatgctgcatgcaacacctgatccatgttgtaataacggtattggcctaaccgaccaccaaaaataacattatcagccttttcatcagctaacttggtatattgcttgtaaagatcgttattccgttgattgttaatcggatagtatggttcatcaccacggtgccagtcagcagggtattcacgagtgatgatcgttttatccttatcacccttgccgaactcaaagtgtttatgttcaataatccgtgtgtatggtgtttcggcatcggtatagttaattaccgcgttaccttgatagttatcaacattcttttcttcagtctcaaaacgtaaacttcggtactgtaactcacccaattgataatcaaagaactggtcaatcatcccagtaaatactattttcggataatcttcaaggtacttagccttttgatcaaagaagtcaacaccagtctcaacatcaattaagtcactatcaagcatcttctcaacgatctgagtgtaacctccaattggaatcccttggtaggtatcattaaagtagttgttatcatagaccaaacggactggcaggcgtcgaatgataaaagctggcaactcggtagccttttgtccccattgcttttcggtatagcctttgatcaacttttcatagatatcacgaccaataagtgaaatagcttgttcttcaaggttctttggttccttgccagccattgcttgtcgttgctcattaatcttagccattgcttcttctggcgtacgaactccccacatttcactgaacgtattcatattaaatggcaggttatacatatgccccttgtagttagccacaggactattcgtatagcggttaaattccgcaaattgattaacgtattcccaaacttctttattagatgtatggaaaatatgggcaccatattggtggacttgaattccgtctacttcctttgtatagatattaccagcgatgtgatcgcgcttttcaattaccttaacgcgcttacctcgcttagcagcttcgtaggcaaaagtagcaccaaaaagtccagcacctactactagatagtcataattattcatattcctacgacccaactttcataattttttctactgctttattaaaatttaataaatacacctcaggcataaatttttttgaagttttttgaatcattaatggtgtaggcatttttttattatcaataattttttgtattatttttgttaattttttactattccctgatggataaagttctccattataattattaattatatcttcagggcctgtactaatatcagcactaatgcaataaactccgtgagagatagcttcgcaaagaaccattggtaatccttcatatttagaagttaatattagtgcagttgctctatttattacagaccatggctttttaacaaagccatgccatattatatttttatctactcccaattttcttgcatactcttttactggcgtcgcttgagcagtattcccatatatatctagttttagctccccttttacaccagataatgcatttaataattctcgtaaatttttttggccatctagcattactctaccaatataaagaaaatgtggagtgctttgtggcctgttaatcaaacgtaaattagttgttatcggattaaaaattaagaaaatcctatttgaactaattccacgttttttaagctgttcttttatcccagaactaatagctaaatagtaatctgcagagtttaaaaatatatgcttaataggcttttgatcaatcgaatagtgataccaggcaatcacaggtgtcttcctttttaatagctttaaactctttttggctaaataccaaatcactggattagttgatataacaaaatcaggattttcttttctcaaatagttaaagatattaagcggcataatcgttaacgcatataaatcacgtaaaaatcttcgcttactaatccacttaatatctatttttacgttttctgcccagctataatcaaagcttccaccaatagagtatacttttaactcaaaagcttgttctgacattaaacgtgccttaaacaaattttttataaccgtttctgttccaccaaatccagtcataaatggtacaattatgatcccttttttcataaaaattccctttaccaaataattgcttcgatgtttgcaatagctttttttatatgattaccatttcttaaatcatttgaaaaagataacgcatttttcttgactaaactaaaatcactctgggttatactacttaataaccctggtaattcataaaggctactaatagtatatcctagcttatttttagaaataatgcttgctatcgcagctttattccaaacaataattggaatacccgtacttaaataaagtgatgccttatgtggacaattatactgtaaatattcaccatacattccattgcactcttcagcactagagccatcccaaatcaaaccaaagttttctgttaaatgggcaggcaattcttcaggagaataaactcccttatatttaacatcgttatccgtcactccactaaaatttggtccataaacatccaatgaaatctttgctggaactttagacaaaaattgagccttttttaaatttccagcaaaacaaagtgtctttgtatattgataattattgttaacagattgaggatttaaataatcaaataatcctaatataaccatcggagttgtaattccattatctttaatccactttgccattgtattattatgaactatcaggccatcaacttgttttaaccaattaatttcctccggtttatacgttggatcatccttataagatcttagagattctaaatcatgaataatcaaaattaattttgcctttgtataagcacgaatatctctaataaacgcattcattaaggctcgtgaataggttggaaattgaaagaaaatttcatctgcttgtaaatttttcattaatctaggaatattccaattgatatatttaaattttaataattttgaatgccagttaaatcttaaattaattacttgaaatccctcttttttttaaaatcttatcaatatctgttttagctttaggaccagcattatttttatcaatttcattaacagaaataattactctctttttttcattaggcacttttttgaacctactttcattttgaattaaattctttagacgtaataaaaacaaaggaaataattaaaccaactaagccccccaaggcaactccgacagctacatgcttttttattgaaggagatgtcttacttgaagtatcacttttcgttgctttatcaacaattcttacattttctacacctggctgtaccttaggcaattctttgacaaaggctttagcagatgcatttgcgattgttacagaatcttctttggattttgtagttgcttctaatgtaagtactaatgattgtggttgagttttagcatcaatcgcactatttatatcattttgtgaataatcttttttcatttttgaagaaagatactgccgagcttctttagaaacagtcatattctttgcaatttcttcatatgttggcatcatatttaaatctgcattgacaatattgtcctgactcttattatcattaatctttaagtcatgggaaatgacaatattagttttagcagtatacgttgttgattgatgtctttttgcacgaatccccattattcctcctccaaggatcgccaaaactataattataagtaaactcttccaaaaatttctatataaagtttcagatttcacgattttcctccaataatgttcttagacttgtcttttgcataaacctctgctaatagcgcgatcaaaaacggatcataactaacatcaagaagcctttgttctacaactgcgctaatggatataactactaaaactgtcgcaagagcatatttctcattgctaattgaccgaaacgagataaacgtcattattcctaaaacaattaaaagtgcaattattccatataaaatcataatccgaatatatgatgagtcaataaaaaaatatttactttgatttgtcataaacattctcatcccagttgttcctccccaactgtgttcaaccatatgttgcccaaagatggaaaaaccatactgctcaaatcccttttttccaagagctaacctaccggataataagctatttatcttttctagaattaaattagatttattgtagaagtaggttattaaaaaaattatatatgctgataatattggaactgaccagtagtaattagctatcttttttgcaaacttctttcctcgttgtgacgctttacctattatcataacaggaattaataataggagtgatacggcacttaaacgagcatcacaaaagtaaataagtagatatgcaagtaaacaaaatacaaaatagctttttattgatattttctcaaagaataaataacagtatgctaaaacaaaatataaaacatgtgcagcaaagtctgttgggtaaacaacaccaaatgattgtctaattgttccagtggtttgtcctctgcgataaaccaaattctgaattacaccggttaatgagctgaatacagcaagtgttaatataattattcctacataaaagtacaaataaataattctatcaaagtttactcctctagcaccaagaataaaaattcccattgaaaatagcataaaatctgaggaagttcgccatgtaagtactaaaaagcctaaaacaaatatatctataaggaaattttttattgtttgttgatcaataaaaaataatttaaaaattatcatccccaatgcaatatacgaaaacatatgaaacgtatttttagcgaaaaaatccataaaagttgtaaattgtaagaaaaaatcagtgaaataaaatacaaatgcaacttcataaattaattggccatttatatagaatttatttatttttaaattattcactcaattatggtctcctctcctaatacgcgccatcacgcttaaaaatactaataatgttcttaaacattatctttgtatcaaaagcaagtgaagccttatcaacatactctaactcgacatcacagcgttctggatatggaatgttgctccgaccactcgattgccacaatcccattgcacctggttttactgataaaaacttatcaacccgatcaccatattcttcaagttctttttttacaataggtcgggggccaataatgctcatctcgccacgcaagatattgataaactgtggaatttcatcaattgatgtttttcgtaaccaccgacctaaacgggtaatccgtgggtcttcttctggctccagtttatagttattggcaacatatttagcatacatttctggatcattttctaaaatcttatccgcattcacaatcattgaccgaaacttataaatcttaaatggtttgccatgccaaccaattcgttcctgcttataaaataatggacctttgttatcaccaaaccgattcattataaaaatagtcagaaagactggactaaaaccaatcattgctaatgacgacagcgtaatatcaaagaaccttttccagaaaaggtatccctttgattgttgtttaatttttaccttctcattcatgattctcaaccctactttttctctttaataatatatattggccgtttcttggtctgcatatagatccgaccaatataacgacctactattccgaggcaaagtaactggataccacccaggaataaaataatacaaaccattgaagcccagccaaaagcactactagcaggctcaataatctttcttattataacaataatcatcccgataatggagataaatgccgttaatccgccagcccaggtagcaattgctaagggagcttctgaaaaatcggtaatgccgtcaatcgcatacttaaataacttccaggtcgaccaatctgttgttccagccacccgttcgacatttttatagggaaggtacttggtcttaaacccaacccagttaaaaataccttttgagaaccggttatattcagttaatgacaacaccgcatcgaccatctggcgggtcatcattcggtagtcacgggttccagagacaattttagtatcagaaattttattgataacattataaaactggttagaaaggaaggacttaaactttgcctcaccttttcgatctgtccgccgcatccccacgcaatcatattcacccttagaaatatcctgatacatctctggtaaatactctggcgggtcttgtaaatcagcgtccatcacaacgacataatcacctgttgcgacctgtaagccggcataaagccctgcttctttaccaaaattccgtgaaaaagaaacataatgaacccgttctggatcttgtgcgtgcagcttgcgtagttctgctaaagtgtcatcactcgatccatcattgacaaaccaatattccgtttctactggcatctgtttaactactttttcaactgctgggtaaaaaagtggaatagtttcttcctcattataacaaggaacaactattgacaattttggcattcttgtctctccaatcgttaatgttcaccatgaccggtgactttacgttttaagaacttcacaatctttaatggccagttttgcttttcaagaaatacccggttaacttccactgtcttgtattgcggattagtcaacaaccaagtatctagtaaaagctcactcaaaaagccaaagacccgttgctcatatggtgtgtagtcagaataatcaacttttttctcaacttcgcctaaaacatcaaacagccaggtacaatattcatccaacggctgcttcttcataatcatcatgttgaaataatgagccgatgtctgtttcattactttttcaaaagcaggtaagtagtggggatatttatcctttaacacctgccgcgtaatttcaagcggctcgtgctcatgaacatggaggtaatgggattcatttgtttcaatgtaatagtgccgcttctttggcaagattacatcggcatcttttaataactcttcaacttgtccatgattgaggatggtcgaaagatcctttgagtgtcccagcgtcaagtaacgacggtagtggactaatcctaatgcatccacatcatcaagatttttccatccccagtacaaagctgttagctcattgtaatgcggattcttttttgaaatattatctccggtattatcaccctgaaatgtatgattaacagtcgggtgaatctctttaccaacaaaaactggtaaatacattggatcatctggcatccgataatttttatggacagccactaagattttaatattcactattgtactcctaattattgtttttaaacataatcattaaaataataccagtaattcccaatcttggaaagttattattggaaatcctgcgcagctagccagctctgcacgtcatccagatcaaagcccttgcgatacattgtctgcttaaaatgctgctcacgctcgtatccttgataacggagagcacgacgccattgcttcgctgcttcttttgctaaaaggtcgttctcttgctccagatcaggttgtggaacaacttcatccttaatcatttcatacacactactagagaagccttttgtcatgagcccctgttgtaccttttgttctcgtcgccgctctggctggttccgataacggcgaaatagttttacagctaacttctttgctaattctgcttgaacttcgggagtaaattgcgttaaagcatcatcaatatcgttttcgccaatccctttttgtcgtaagtgttgacgaattaccccaggccccttcaagtccgtgttaatcatcgtgcggacataagaagccgcataggcatgatcatcgattaactgttgaccccgcagctttttcaagattggctcaacaaactcttctggcgtatcaatttcttttagcttcttaacgatgtcgctttccgtccgcatctgataagaaaggtagtcaagcattcgtgaataagcctttgcttgctggtcagcagtcgcaatggccgcaatttgcttttcatctagctcagttcccttcatcaaacgaaactgaatcaaaacactttctgcaaccggaaaagcatacttaccatcaaggtatatattatatcgacccttccgtttttgcgtctcaattttcgaaatttttgccatttttaaatttctccttaacattctcaatttttaatcgtttataaaggtgtaagcagtggccgctacttaacaaatcaaattaaacaaaggaagtttttatcatgcaaatggttcgtaatttcaaatccgctaaaattcagcttaccctcaccaacagtgaacatcccaagggcgttaaacatccctttaacaacattattgaggatgtcactaatgagcaggtagcacaatttagtgcggcaattgaaatacttactgctgaaagatgccttgatacagacattatcgttactagtcaagttgcaatgaacaactaatttcaaggaggaaattaatttatgcgtacattaagcttaactttcaagggtagtcttggtaaaaaacattcattaaagttgaactatgccagtggtgatctcgatgccgaaaccgttcggaaggcaatgcaagaaattgcgcaaacccacctctttactaaggaaggcgaagatatttatcagcaacctctttctgcaaaatacattgatactgtttctaccgttatctttaacgacgagcaaaagtaattaaatatcgagttctaaagatcttcaacatttggaggctaggaaaaattcctagcctccatttttgtttgtactctttctttctaccagttgccaaaagtgtttcttggcatgcaactcaccttcatgacattcttgtagagcagcatttagcgccgcccccagcatgatgatatagccagaaaagtcaagccataccatcatggcaataaaagctccaattgtcttgtaggaaattaccccgtgactaaataataaggtatagaacgagaataaacgtgataatcccatccataacaaagacgccaagaatgacccagcaagtgcatagcgcaaccgaaccttcgcattaggaacaaagtaatacaaaagagcaagagcaataaacaagacgccaaatgttactggccaccttaatgagctaaacaataaaatgtagtcacgccgaaaattaaaaatcggctgaatactctttaggacttgttcaccaaaaccgtacaaaataataataataaaaataattaccaataatacaatcatccaaataaacgagacgattcggttcatcaccggattctgattttccgcaatcccatacgcatgattaacgctgcgttgaaaagcggcaatcccctgactggtcgaccaaagagcaatcaaggccccagttgtcagaacaccaccactcccccgtcgtaagaaatcataaatcaacggctggataaaatcatagaccgattcaggaattgcagttgagaggtaggctaaaatcgtcttagcgtcaattccaatcatcggtaataaatttcctactaccatcacggcgggaaaaatagataataaggtatagtaagctaagacagcagcagaacttgaaatctgggccattgtaatatgttggattaataacgcaataaaagtcttccctttgcccggttccttgtccataataacctccgaaaacattttataggtttaattataacaaactgaacacccgacaaatattacagaatagataaaaaagcggctgggagaaaacttttgttttctctcagcctcaattacttattatgaataatagtaagataacgtggaactagcttcgcgtcgccacaaggctcgagtctaagtacgaacgataatcagcccgtgccgtgctaatcatcgttccagcttagcccaccgccttgtcgagaaggttatttcccacttccttttttatcaattacccttcaacatggtgacgctttgcggaaatttgatagaagaccaacgcaacgattgcaaagaagattggtccagcaagtgtccagaaagctgtttgataatctttttgtaatagtggttgaacaaacgtaaagacgattccgacaattaaaatcaattcaacgaaacatactaatacatctgtccagaaacggttcttaaagacaacgaatggccggtcaaggtccttctttgccttaaagaatgggaaagccccgatcaagaaaacatatgggaaacaagttgaaacgttcgccatatcagtcaaaatcaagtagaactgttgagcagcatttccaccaaaggcaaccaagaaaacaataattgaaacaataattgcttgaagccacattacatttgcaggcatccccgccttgttaagtttcgtaagtttctttggccataattctggattagaaccaagaatgaaggccttgattggggagtaaagcagaataaacaacgcgcccaaaaagccaagggtctgtgcaaaggcaacgatccgcgtcatgataagtccaaaagtaagggcagcaccgtgcgaccatccaagcgtatcccccatggtaacccctaattgattaaagacaacataggtaacattaccaaggttaacgctgctcttagtcaaagtttgttgataatttactgaccaaccgagcatgaaaatcattaagacataagtaccaattgtaaagatacttgcgatgatcaatccacgagggaatgtcttttccggatttttcatactatcagtaacagaccctaatgattccattccaccgtaagcaaaaatagcataaacaacaaacgaaataatggcaattggtgtctggaattgtggattaggtgatgtaatgaaagttgaagcaccatgaattggttgctttaagattcccttatcggcaactaaaacaataacactgacaataacaaagataatgttaacaacaattgtaaaaataccaccaagtgaaccaactttagcaatggcggtcattccccgtgaactgcaccaagttgttccaagaatcaacagaatcccaaggaccccaatcaattgagtcgaagtcagaccaaatgcatgccattgttgggtagtatccttaccaaaaagcaacgcagaaaaagtaatccaaatccgtgatgctgttgataccatccatacaatccaagatgctagccatacgaaagtaccgacaaaggcgattcgttcaccaactgaaccggcaagccaggaataaatgccccctttagcatccttaaatgtggaaccgtactctgccatcatcaagccacagggaaagaagaaacaaatccctgctaatgcgtaccaaataatactaccgtaacccatttgtaagtaggcgtttgaaacattcccaaaaccaaaaatggcggtaatgatcatcgtcactagtccaaaggtagtaatcatctttttattactactctgttcgtccaaaataatgcctccaaagctttaaaattcttaaataaaaataagaaattatttaataattattagtatagtcgtcttttaaaaaataaaagtcttttaaataatttcacattacttttatactaccttttgtatttttacgccaacttagcaatctttattcgtttatttgtatattttgttataagcgatgtatactattttcattacttaataatcgctttcacatttaatcttaatgctatggatagcgttttccgacgctgctataattgagttaagaaaatttatgtgattttcactctaatatataagatcgtgaggtggagtaaatgagtgagaaaaaaggtattaatacgacggaactaacccttttaatcgtgggatcaacaattggttcgggagtatttggaattaccagtgatttagctaccgcggcggctcccggaccagcaatcattgcctggataatagtagggattggcgtcttgactttagttctctccctaactaatctttcgcaaaagcggccaggccttgattcagggattttcagctatgcggcagctgcttttggtccgctgggcgaatttatttctggttgggcatactggctttcagcgtggctcggcaatattgcttttgcgacgattatgatgagcgcccttggaacgtttttccccagcctatttgccaatggtcaaaacttattctcaattattgttgcaattattttaacctgggttttgacattcttggtaaatcgagggatcgaatcagcggctttcatcaattcaattgggacaatctgcaagattattccattagtcgtctttgttatctgtgtgattcttggttttaaagctaagatttttactgctgatttctggggcaatgtaacacagaatctcagttcaaaaatcgaaactggttcaatctatgaccaagtaaaggcctcaattatggtaatgatgtggctatttgtcggcgttgaaggtgcctcggttctttctagtcgtgccaaaacacggactgatgctgaacgggcttccatcttcggtcttgtaagcctactcgttatctacattgtggtttctattctgccatacggggtaatgacccgcgcccagttagcagctggtggtcaaccggcgcttggggcgatcatgcaacatctggttggaacgtggggtgccgcccttatcagcattggattgatcatctcagttttagtttcatggctctcgtggacaatgctaccagctgaatcattaatgctaatggctgatgatgaaacccttccaacatcatggggtaagctaaatgacaaaaaagcgccaacacaggcattaataatcaccggggttcttcaatcaatcttcctcttctctttacttttcactacctatgcttacaactttgcatatacgctttgtacggctgcgattttgatctgttacctccttgttggcatttaccagatgatgtacagttggcaacaccaagaatggggacaatttgttattggactaatcaccactctctttgaactgatggcaatggttctctctggctggaaagaaataatggtcgtttcagtcggttttattcctggattcttcttttacgtccaagcatgcaaggaattccatcactcaatcacagtaaaggaaaaatgggcaatggggattatcgctgtctttgcggttatttctttagtattagtaatcaacggaacaatttcaattaattaaaggaggaaaagatcatggtagaaatagcacattttggtgtcgaagcatggctaaataagtgggaaaagagcgcgacttatgatatttcacaaagtacaatcgcctctttgagtatgcacgatctcttaaatttagatggtaacaatggtgaagagttttatgagatgcttgataagcagcaaatgaactacgggtggattgaaggatcacccgagttcaaagaagaagttgctaaactatatcatcatgttgatccggaaaatatcttgcaaacaaacggtgccacaggagcaaatattttagctctctatgccttgatcaatcccggtgatcatgtaattgccgaatacccttcttaccaacaactctacgacattcctaaatcattaggtgcagatgttgattactggcatattcatgaagaagataactggtacccacgaatcgatgacctaaaagcgatggtcaaacctaatactaaaatgatttgtctaaacaacgcaaataatccaacgggaacggttcttgataaagagtttctcgaacaagttgttgaaattgctaagtcagtcgatgcttatgttcttgttgatgaagtctacttgcccctcgatcaccccgaaaaatttgcgcagattattgatctttacgataaaggaatctctactaattctctttcgaagacttattcagttccaggagttcgaatcggttggaccgcgactaacgctgaagttgccgatatcttccgtaagttccgtgactacaccatgatctgtggaggagtctttaacgaccagctcgccacctatgttttacgtcatcgtgatcaagttctcgcccggaaccggaaattagttcttggcaacctcgccatttataaggattggattgatcatgaagaccgagcaagtgtcatcatgccacaagcagtctctacttcctttccaaagcttgacgtgccggttgatattcataccttctgtgaaaacttacttcatgacgaaggggttctcctcgtgcccggcgatgcttttgatactccaggtcacgttcgcctcggctactgcgcaccagaggcaactttaaaagaaggcttaaagcggctttcaaagtatatgcatcaatatgattagcgttacaaaaaaggatgttagaaacatgcaaaagttttctaacatcctttttactgctagcgattaattttcaaactgcttagcaaccttttctgcgatctcacggtaatggtctaagtacttagcataattatcatcgtacatgtaatcagcatctgcttctggatcttgagacgtcaaaatcttcggaccatcattcgtaataactaaggtatgttcgtattggcaactccaaccaccatcagcagtcttggcaagccaaccacttggatcactggtatcagcttcccaagtaccagtgttaatcattggttcaacagtaatggtcatcccgttacgaagacggattccttgaccgtgttcgccgtaatgaggcaccattggatcttcatgcatcgttggttgaataccgtgaccaacaaattcacggacatccccatagccattctcatcttctgtgtagtgttgaatcaccgcaccaatatcaccaatccggttaccaggaacacattggtcaattcccataaacagtgacttcttagtaacgtccattaacttttggatttcaggggaaacttctcctaccgcatagctccagcaagaatcactgaaagcaccgtcgacactgacaaccgtatcaacctttactaagtcgcccttctttaagattaacttcttacgagggaacccgtgacaaatttcatcattaacactaacacaggtagcgtacttgtatccttcaaagccaatttgttcagcttttgctccagcagccttgaagtacttccgagcgaattcttcgatcttccaacttgagatgcctggcttaataattttacgaaggccaaggtgcattgctgctaaggctgccccggccttttccattgcatcgatttctcgaggtgattttaaactaatcattttcgcgatctccttatttacaatctaacataaatagtataccacttgtctgccctgatatcgcaaaccgtgctatactatatgaacgttatagatttaatggaggttataaaatggcaaaagcacttgtagtatacgcaaccattaccggtaataatgaagacgttgcggacattattactgacgctcttgaaaatttaggagtagaagtcgatgaagttgaaatgacaatggctgatccagctgactttgaagaagctgatatttgtgtgatctgtccttacacttacgatgagggagctcttccagaagaaggaattgacttttatgaagacttgcaagaagaacaactagcaggcaaagtttacggagttgccggctctggtgatactttctatggggatgacttctgtgtcgccgtcgataaatttggggatgcccttgccaagacaggggcaactaagggcgctgaaaatgttaaaatcaacctcgcaccagatgaagaagacattcaaaagctcgatgccttcgctaagcaattagtagaaaaggcggctaaactgaatgattaaggatctgtgggtaaaatataagtcaatcattgcctaccttttctggggcgttgtcacaacggtggttaacttagcagtattccagattttgagtccgggacttcactggaatgttgcccttgcaactgtaattgcgtggtttgcatccgtattagttgcttattttaccaataaagtctgggtatttggttcccattacactaccgttagtgactttattgttgaaattttccgatttttcttttatcgtggattgactttatttatcgatttaataattacgtatgtaggtatcaaagttttgaaattcgatacacctctccaacaatttatcgttaaatttattgataatgtcattgtggtaattgctaattatattttctcaaagtggttaatcttcaaagataaccgtgatattgcagataaataaatgataggattcggactgtaaacttacagtgcgaattttttatttatcttaaaaattccaactataataaatacgaagaaggtattgacctaaaatgatgaaaaaattcctaccaattgaaaaaatattagaagcttatacagcaattgctgacggtcacgttaaacttgaaaacgatcaagcactcgtaacctcttctaatgaagcgaaaacttataccgtcaccctttcacgacaatacctatacttcaaatgacaatgcctcatactggcaaggctatcttggctatcccggaattgctgtcctgatgcttcaaggaaagttaccttatgataaggaattagctcaacaatttgctggagttgattggaataaaatcaatcaagaatataagcgtaattatgcgcaagctgctgatgctgttatgactgttaaaggaattgataagaagaaagcagagacggaacttcatcatgtttacaatgtcctaaagcaattaccaattatcgttaaacgtggatcattacgatcacctaaagcaaactaaaggtgaataagagactactcttttacataaaaagctctcttattcaccttttttattgttgtgataagtatttttcaacaattttaagaatcttttcgcttgcgtgcccatctccaaatggtacttccgctagttccatttgccgatacttcttctcatcatttaacaattcaaaaaccgcttgttgaatcgttgtcggatcagtaccaacaatttttacgccccctaggctgaccgcttcttgacgttctgtttcatcacgtaaaagcaaaagagggcgatgcaatgctggagcttcttcctgcaaaccgcctgaatcagttaacagaatcgaactccgggcagcaatatttaagaaatcatgatgatttaatggtgtaataagatgaatccggtcatgatctcctaaaatatcattagccagtaattcttcttctggatgaggatagacaggaaatatcaggtcaagattgttgttagtttccacaatatcacgcattgtatggaaaacacgcttcatgggggcgccgaggttatctttgcgccgcattgtcattaataaaatccgattatctgctgggatggactgcagtaaaggatgcgtaaaatcttcttgtaaattatgcttcacgctatcaattgaagtatttccagtaacatagattcgttttgctggatggtgctcttgcaataaattatcgcgggcacttgtcgttggcgcaaaataaaggtctgctagattatctgtaaggcgccgatgcatttcatcagggaatggcgaataccgttcataagtacgcaaaccagcttcaacatggccaagtgaaatatgatgataaaaactaatcaaactggcagccaaacttgtagtagcatcaccagccacaaggatcatatctggttgtccagcattaatcacattatttaagttatgcaacagttggctcaatagttcaacttcatttgtacttgttacgttcgatgaatcaacactgaaatcaatttggaaattcaaatatgccaacgtgtcgtttaataattgtgaatttcccgttgcaacaagaactggttgccaggtcgcaggattttgatgcatcaatctaatgatcggcgccaacttcaaaacctcagcccgcgtaccaaacaaaaacataatcttatatggtggctgcattaatgactctcccttcagcttttaataaaaaagacgtaatcactaaacaaagcaatcacgtcgacagtgcattatcaaatggtcccatccggatttgaaccggaatcgaccgcttaggaggcggatgtactatccaattatactataggaccaaactaaagaatattatcgcatttacgaaggatttcgtaaagacggtaattattcttttttagttttcgttatttttacgacgatgcttcaaacgaattcctttatttttgcgattctttttctttcgccgtttctttggcttagagaatccactgagagtttgattcatctttttatgggtttccccacttaattgttctttttgcaagtgacgactagcctgctgtttgattgaaaccacccgttgaccctcttctggtttctggttggttaatttattatcaccaatgtagagcttagttagttcatagtcactatcagcaagcaacttcttaaggtcacgaatatcatgatcatcacctaaactaagtgctaatcctggttctccttgtcgcccagtacggccaacccgatgaatataggtattgagcgatgtcggcaagtcaaagttaataacggcaggcaatttaggaatatcaatgccccgggctgccaaatccgtcgtcaacaacaacttgatttgccgcttccgaaacatccgcatcgctttttcccgttgtacttgtttttgtctaccgcccaaggtatctaccggaacatgttcgtgtcgcaaccgacttgcagcatagttaagggtgcgggtactgttgaagaagataagcgcccgaaaatctttaatacttgtcagccgacgtaaagttgctgttttttgcgcattggttcgtgcacttaagtaaccatgttctaccggtccctgagaagtatcctcatcacgaacatcaatagtttcaatatcgcgaccaaacatcacattcaattcatccagaacaggagattttgtagcagaaaagaatgctagttgagtagataacggggtcgcacgctcaatatcttctacgacagctaaagtatcgtcttgaagcatgtcatcagcttcatcaataaccattgtcattaaatggccgagttttaagtgatggttatcaagcatatggagtacccgtccaggtgtccctactacgacatcagggtgttggtgtaaattcataacttgtcgccgtaaatttgcccccctgtcagggattgaacgctaacgccaattaaagttgcccattcacggattaccttggttgtttgaattgccaattcttgtgaaggtgcgagaaccaataattgagttccctcgcctggcataatcttaggcaagagtggcaacgtaaaggctagggtcttaccagagccagtcggtgctattccaaggacagattggtcagtttttaatgccggcgcaactgctttttggattgcagttggttgcttgtatttttcatcaaagtgtttttgaaattgttcgatcaaattaaatcatcctattcttgatcgttatcagatgggaaaactagttgagcagattgacgaagggagtacataactgagttgaccgtcttagataattctaaccaatgcttgtacttcttcatttcttcttcatcatcaggattgttaaagaggtctgcgaaatcattcatttcatcagtcattgagttttcttcaacgggcgcttcgattgggtgcgcattttggtcagcatcataataagtaacctttcgcgtatcaaaaatactatcaaagactaaagtatctttcaagccgtaaacttcagaataaaggtgggagttagctgtcttaccaaagttgagagtgacagtaaatttgtcatagttaagaattgcaacccctttaccatcaaccccagttttagtcagagttgggaaataaactacagattctggttcaccgtaaatagtaacggccccatatacagcatatacaccgaggtccattaaagctcccccagcatacttaagggtaaaaatatttggatatggttcactgccattaagaactttatcaaaacgtgatgagtatttcattacagtgatggttgctccttgaatataatgttccttcatctcatcaactttcttcaaggcagcttgataaatcttggtatggatatgacgagctgcttcaaccaaacgtgccttaggatgggctgccaataatgattcaatcgcactgtattcacttggatttacgaaagctggcttttcaacaataataaatttatcgttttcaattgctttccgtgcttgttggtagtgcaaactatttggtgaagcaatataaacgacatcaaaatcgccctcttcaaagaacttatcaatgttatcgtaaaattcagttgccccatatggcttgccaaacttctcagcatgttctaatgtccgagaatagacagctgtcaattcatattttcctgttttcttggctgcatctaacatctgatcagtaataatatttgttccaataacaccaagttttaacataaaatcaactcttccttttcaaatatttctttgcttacatctaattttaacaattattgcgcgtttttaacagaaatgaaatcttctgataatagaaatgtgtgtataattagttatgttatagaatgacttatcacttaattgaggagactgataaaatatgagaaaaaaaggaatgttacttttcggcgcgggactaatggctggactcaccagtactttagggttcagtcgtgcgaagaaaagcaataatacgatctcgttacctatcttttatgcgggcacatggcaatattatgataaagaacgagatcgctctcataaaataaccatctctcctgaattaaagctcggtatcgataaccagatcattccggcaacggttcaacaaatcaaacctgataagttagttttccttgatcgatttggttatcacattactattcgggcaaatgaacaacggccagtttcattaaccgatgaagctgatgaccaagtttatactattcaaccattaaaataatgttggcgctgtaagacagcgttttttatttttaaattatttttgagcgtactgacgatgtgccggtgctttataattttgcataaatgccaaaatctggtcaaactggtcactaaaacagatactatttagataaggatcttctacaaagcccgccttattcatttgcttaaataggtcgtttaacgaatcataaaagccattaaagttgtaaaaagcaactggcttatgattatccccaactgttgtccatgaggcggcttcggtaatttcctctagtgtcccaaagccgccgggaaaagctaataacccatccgcaagatccatcatcgtttgcttgcgaatatccatattagggacaattcttacatcttttaattcgttataaatggctccacgttcagctagctcagtagttattaccccgtgaacaacgccgccattttttaagactgtccgagcaagggttcccatcaagccaaacgcaccggcaccataaactaattcaatatcgtgttggaccagccattcaccaaatcgttgtgcttcatgattaaatgccggattatttccatcacgcgcaccacaataaactgcaattcgtttaatcatacaactactcccctttaatattttttagagaatctaattgatgcttaattgttgctgccgcactcttaatctcttcttcttccaatgggtaaagttttaagagaagaaggttgccaattccttgccgaccaattaacgctggaaaactaatgtaagtggaatactgcggctgataaattgcaaccggcaacgctaattgttcatccgcaaaaattgccgtaataattcggagagtccaagcagtaacagcactaacattgtaccctaatccatcgagagtgtaccaattactaaggttcgccttaattttaagctgactttgatctaagtgatgaccattgattgccgcagttaagggttgtccattcacacgaacagttgaccaagcaaatacctgatgaccatcgtgttgaccatagacaaaaccagttacattggcagcggcgacctttgcggcttctgcaattgcccgataaaggcgcgccgtttcaacaaccgtgccaatcccaattacttgcttttgcggcaagccaactttttgctggagaacagcagtaattgcctcattaggattagtaaggttgattaagatcccactaaaatcactcttaaaaatcttattaccaacttgtaaggcctgctgatagctggtctcaagctcagccattggttgttgcttcatcaaagcactctttccaaaggcggtaataaggatatccgcatcggctaaggcagcgtaatcttgaataattatttttgtgtgggtcgccaagaccgtttgggaatcatttaaatcagtctgaattgcaatagctagttgatctttttcatcaatcaaaactaattcatcaactcttccgttcattactaattggttggctagcatttcacccacatgaccgaggccaataattccaatctttctcatttttagcgcttctttctatttcccgggaaataacgaaagtgaaaacaaggttattaccctactttaaaaagatagagactaggaaataatctcctcagtctcttttttacttttcctgaaaatcctgaacttctggaaaatcactaagaattacatcacgggcaccctttgagaaatcaaaagttgcttgagcattatagctttcttgatgatctcctacatataatactacttgcgttggttgcaagtctatttggacacctaactcaatggcagctttaaccaattgttgaacatcatctgagtaaacatcgctgattgcttgcaatggatgttggaaattaatatttttcgtgtaacgatcattggcaatttttaacccaaatgataataaatcaccattttcaagttgatctgctaactgaccgctaagagttagcgaaggatcatccactcgtcgttgtacaaacttcaaagcaagctggtattctcgcggagcattaaactcaacaataaagttttgcaactctgcgattaactgcattgcttcttcatgcatccacggtaattgttcctttggcttttgtaaggccactccattattccgcttttttgcttccgctaatcgttcctccaagttatcaggtaatggtgaaagaatactatttaaaagcattaattcaaggaagttaatcgtatcgtcactaattcctgttcgcgacaacgggtcaaggtcaaaattacgaaattcaagataatcaattcccttatgtaaggccccatcaatatcatgcatatcatggttatgccgccgtaaccgtaccgggccaaagaattccttcatactatagtaagtgccattgtccatgaagtgctttagttctgcaaaatactggtcgtatgaagtataggtaacttgctcattggtaaagttatcatccccataatcactacaacgcaaactccgaactggcagctccaaatcctctggaatactatgtggcatatcttcagaaaccggacttgctccatataagtacgtaaataaccattgataaaggtagaacttttgcgctaatttaaagtaaagatgattttgaaaatcaatacggtttggataccggtccgcataaaagcggtgataaatctcgttgattaattcaccatccaaactaaaattaacatggacatcccctaaaatttcttgaacaataccatatttcttccctagataatcatgagtctcttggtcccatttcttagtaaatgcagtttgtaaatattcaaggtcatgctgataagtcggtcctggcgccatacttaacggccataatcgttcatcactccgtaaatgtgagataacaatctgctctaacatttttagttgccggactgcatttttagctccaacaactggacccgtttcaaagtccatcatgtcatccgtatagcctgagttcaaataaatattatattgccgtgaacgcagattttcaggatatggataacgacttgcccgcccattggtcaaaattcggtgcttctttgcctctaaaccaaactgtgaagaaaaaagtttggcatttaatgacggttcttttaaagctgctttaagttgatcataatcggttcccatccaagaatccctccaatcaatcattttaattttattcaagttcaaccataacacgtttggaacataatagacaataacaacttaattatttcactggataatcacttcaaaatagattaacgctttctgtccttaattataccaatctccgccaccaaggaacataaaagtgctgaaatgctttattcttagcaaagaaatgattaattccgctatttttacactgatgttcttttaatgaattgacataatcagcataaacttctattcgctgcgaatctggaacgccccgccatgcgataacatcctgcatattttttactaagtcagcataattaccgccatcatcataatcaataggtgcctgccaatattttttagcaacccttcgaagctgactatcggtcggttgagtaatatcaagacgttgatgagtgtgacgatatttaccagttacataatactccccatagggaattccatagttaaaagattctgtatcagcgatttgccgtaattgattggtcgaataatgcgtggggtctgaatcaactcttccttggttatcaaagcgataaatattccattgactaacaaactttcctgtttcgatatcaacaataaattcaatcattcgggctggattagcataccgacgatacgaattacgaactaattgaaccttcatattagaggggtaagcaaatttatgatgataacgattatggtaattagcaccagttttaaagtctaatttaaagtgattatcgtgggcataggaaagcaatcgttgaaaatctgtcgcttctggtgaaagagagggacgctgatattggcgaataaaagtgatgttttgccgatcaagataactgcgaaataaatgaattttgcgtcctaacaaatctgcttttagccctttcttccctgaataagccgtcacaactagatcacgaaaataaggatagaaaaaactggtaggggctaactgaggtgaaaattgatatacagttggtgaaaattgaagaaatccatagttatcaatataagcttgtaaatggtgattaataattaaatcaagctgttcatgagcgttaagaccgctttgtttcaaggttcttatataattaacggaaccaatttgatttgcttttatcatgttatttgtcataaatatcatttaacggttcatgaaccatcgtaatatgctcgcgctcggcctccataaaatggtcacccacagattcaaaaccatattttttgtaaaagtcctcaacataggcttgggcatgaatagttatcttaaagttggggaaattcactttgattccacttaataaatgttcaataatctttccacctaaaccaatcccgcgtgcttgtggagccacaactacgcgaccaaaagttacaacatcattctgaataaaataacgtgcataggcaactacttcaccattagtagttgcaaaaacatggtgcgcaagtgggtcactatcatccggatcaggataggaactctgttgttctccattaaaaacttgtgctcgtaacttaagaatggcaaaaagttcattaactgttagttcagtaaattgtttatcaaaccattgcataatttatccctcctataattttatatattatacaaaaactagtaagttagcataattttcccgcaaagcaattttattattaaatttatggaatataataaaggtaaggatttatttatgaagggagcgttcaataatggataatttttcacctaatcgtcgaaacgttgttgatattaccgacttaaataagtttttaacaaaaatgtatggtttaatgaccctggcagtattgctttctgccttaaccgcttggctcgtaatgactgttttcgctcagcaatttactgcttttatggtcaataaccgctggggaatgtggttaattatcctcttgccaattatcctaacgtttgggattaattttaatgctacttgtagtcctggtctttgtctgttcctattaattttaacagcgatagtctacggaattacctttgcttttatcgcaggcgcttatgctggtactgatattgcaacagccttcgtttcctcagcgggtgtattcttaacaatggcgattattggtactttttctcaccgtgattttacgcgacttggttcttatgccagtgcggccttaatcggcttgattatcgccatgctggttaacttttttgtgcaaagtccaataattaattatctgctttcaatcgttgcggtaatcatttttacggcattaacagcttgggatgcacaacgaatgaaaaatatctataccgagtgtaatggtcaagtatcatccaatgggctagctgtccttggtgcattacagctttaccttgattttattaatctctttattagtttcttagacatttttggatcaagtaatgaaagttgaactactcccacttagctaaacctacggtttaatgcttgaagtgggagattctggaaacatcgcatacttaccctaccgattctgaacgaaccttcaagcagaggttacgactattagccaaggctcgtcccgagcctaactttatctatcggatagctaatcctttttgcaagatgacttgtgcagcgttaatatcacgatctaaatgtttaccacagtttggacaatcccactcacgtaccgctaaccattccgatttattcaatcctaaccgatgattattcttcccacaattagcacaaatttggctagtatatgacggattgacctgaataagctttttaccgtaccagtaacacttatattgcaatatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgccgatacttcgccaccataatacgagctttctgataattcgtaaaatcgtctaattgccgtggaactaacactttattatgatgatcccaggcgatttcctgctgggcctttaagaaccgacgactacgcaatttctcccaacgatacaactttttacggtatttgtcttcaaaatgattgatcggttccttgcatccatctgaaagattaagtaatgacttaagtcctaaatcgccaccaatatatttacttgttttaggaagagtttggttttcgctttccactaaaacagtaatgtaatattgaccagcaacgttcagacgaacagtgacattcttaattttacccattggcaatcgaccagctctaaaatagacgataccgagttttggtaactttatatgatggcaatctaaaactttaatattgccattaacgtactttgaattgtagctctgagaatattttctggatttaaatcgagggaacttattttgacctttaaaaaagcgttgaaaagcatcagctaaattgcgattagcactttgcaaagcagttgattctgcttgtttcaaccaaggatactcaaccttaagttgtttcaacagattattcatcccaaaggcattcacaaatttagcttccggattattcttgcgccgttcaatttgcatattaagcatttgattccatacaaaacgaacacaaccgaaggtttgccagagctgatttcgttgtgctgaatttggatagatgcgcattttaacagcttttagaaccattattttctcccttgactttcaatatatcgttttacaacttctaaaagcgctccaccagtgctaattaagcaatatctttgtgtccaaaaggctgattcccaaagatattgcttgatttctggaaattgttttttgaccattctggagctagacgatttgtaatcatttaaaaatttagccatttccgtatgaggcgttgctctaaacaaaacatgtacgtggtcctgatcatgattccattcttgcaaattaatgccgtatgcttgtctcacaactacaaaacgatgtttaagatattcagatatttcatcgttaattacttttcgacgatacttaaccaccattaccaaatggtaattaggtaagtatactgaatgctgatttctatctaattctattgttatcaccacattttatagatatatactaaatatatcatagaacaaaagaaaaagcactaacgtgctttaagagagcgattcatcccctacttatagaagtgggggtattctcgcaaatttatggataaaatcaatagacaaaaaagtattaagagagtcattaagcatccctcctaatataaatataagatagattttaataactctccactattacacttttaatcgtctaaagtaattattttttcaaagcgaaacatttcattattagtatcatcctgagtttcatagttaagatctagatggctttggttataaaattctacagcagcaaagccacaacgattgatataaaaatgaatatttcgtttatcaaaatacggggtacatgtctcccaaagaactgtttgtggatatttctgctctaatgcagtccaaattttataaccaattcctttattttggtgtgcagtatcaacgtataaaaagtctaaatgattgtgatgtgtttgatcatcgatttgtacaattgcgccacccacaatctcatgatctacaaccgccttaaatccatgggcattatcacaagtaagagatacataaatatcttcagtcggtaatacatcttctaaggagctatcctgtacttgagctgcttgattaaacgaatctttcattgcaggaacaaaaattggtaaatctttttcattaagtggcataagcttaaaatccatcgttttacctcctaaaatacataaaactaaacaactaataatttaaggaattttaccatttgctgcaaatttttgaccacttattacatatacaatataagcggtgacaaatataatatacttagattagaaaggaagtgggaattatgaaagtaaactgtcatatcgaccctaatattgaagaggaacacctcgatttatttgtccgtgaaatgaatccccaaattaataacctcttaaaaggttttacaagtaccgaaccagtattatggtgttatgacgccgatcaaattatccccattaaattctcggatatctttgaactaactgtcgctaagactggtactaaaatttcaacaaaagatcatacctacttttatcgtgaacggttatcccacttcaaaagcaatcttccgaatgattttattgaagcatctgtcagcactatttttaattatcattaccttgatcaccttgagttattagataatggtttgatagatgcaattttaacaaatggtagccatattcagatttcgcgacgaaaaatcaaaaatttgaaagcgaggttaggactatgaaaaaatatgtcaaatatacgattggtttctcaggaattggtgttctaattggcttagcaatctctttagttttcaactatcttaacggcagtaccacttactacccatcatcccctaattttgttaaccaattcgctcatcccttaacggcgtaactgtttctgttattttatggatgctaattggctgtgtttttgggtttggcagtttaatttttgaatttaaaaattggtcactgctaaagaaaacgatcattaatttttgtgcttactatgctggctttgcgccattagcaatcctatgcggttggttcccattgacttggattaattttgccattttcacgcttatctttattgtaatttatgtcataatttggcttcttaattggtactcaataaaaaaagagattcgctcaattaatcagcaaatcaaaaagtagttttccctcacatttgattgtaataagcctggactaattcaacaaagttattaatattataagttgttccaaataacttacgagccgatgtcgaccaataagaaattgggtcttcatgatcagttccaccaagataacttgaaatcattgcatgggtccaaacagtgccaccaccatctttggttcctttcgtcacgggcaaattattctgttttaagatataggctgtatagtaagcagcattgccaagctggtttgcaaaagaagctgcggtatattcatgaggcatttcaaactggacaaaatatggattagcatatggccctgctccttctgccatatattttgtatccgcaatattaataatttgttgattatcaataaatgtatgaacaaacactctagttgaactataattttgcttcatgtaagatacttcactactaatcgttgaattttcattcccagtatcatgaattacgaccccacgaggatttccagatgaagtactatacccgcgttgttcaaatatacttgaaatttgtttagtaattttagcgtgtggaagaccagattgagtaaggtaactattgatttcgttattcattttcaactcaatatcggtggcccgaacaaaataattttttccattatagttaatccgtgcgtaagtatcatcgttatcattagaagtcagatagtagcgattgaccttaactaaggcttgatcaggcaggttggcgcgttgaattgctgaaagtgaattatatactcttgcgccactgcttaacgtagccatttcactaacagcatatgaattactaacctcccgcgtatgatgagaataaaaccaactcccaccgattattgccgcgacgattataataagtgatagatatattaaattttgttttttctttctctttgccatactagttattgtaacgaataaatttgaattttgtaggaaaaaactaattatttataagtaaagttaaaaatcccttgccttcataaatactgaaagcaagggatcatttttatttactaattattaatcagcctcacagcaaacatgatatttacgtgattaacacctatgcaagtggtattgttaaataaaaatatttatgatattatacacttacaaaaaataagtatgaggaaggagcaactaattatgaatgtcgaattaggaatctcaacatttggtgaaacgaccccactcgaaaaaactggtaaggccattagccatgatgaacggattagaaatcttattgaagaagtagaattagccgaccaagtaggaatcgatgcatatgctatcggtgagcaccaccgcaaagactttgcagtttcggcacctgaaatcattatagcgatggcggccgcaaaaacaaaacaaattcatctttcaagcgccactactaatttaccaacgattgatccaattcgggtttttgagcaatatgccacaattgatgcaatggctcctggaagaattgaaattatggctggtcgcggatcatttactgaagcttttgacttatttggttacgatcttgataattatgatgaactatttaaagaaaaattggatatgctagttgaaattaaccggaacgaaattcttgattggccaaaaggaaagttcacgccaaaagttgaccacattggaatctatcctcggccaaagaagcccttgaaaatatcactagctactggcggcaatcctaactcgaccattagagcggccgaaatgggactaccaatcgtttatgcaattattggtggtcagatggatgcctttaagccattagtacagctctatcgtgttgtggctgaaaaaacaggtcacaaattaagtgaaatgccagtttcggctcactcgtggggatggctaagcgatgataaggaaaaggcaatcaaagaatatttctatccaactaaattacttgttgatacaattagtaaagagcggccacaatggactggcatgacatatgaacaataccttgaaagtattggcgaaaacggtgttatttttgttgggaatgccgatacggttgctgacaagattattaaaatgatggaagtgcttggcttgaagcgtttctacctccacttgccaattgcctcaatgccccataaagatgtattaaaagcaattgaaatttatgggaaagaggttgtaccaaaagttaaaaaatattttaaggataaaagtaaattgaatgacttttcaattaaatggaaagaataaaaagatagacgccgatgagaaaagatttttctcacctgcgtctttttattattagggcttaatattctcagttgaaagtctgtgccgttcaaatggaactagggatatgttgaaggaatatttcccaggaaataatcatttaacggcatctttaattggaagataattaggattaagattattctcttcagaccgatcaacaaattttgcttcagtgattccatattcatctgcttaaatttcaatctttcctaaaggcgacgagtaattaaaccttgcaatcattatgccgtttctatttagtcaaaatgcaaaatttcatttacaggacgacgctctgaatggtagctattaattgtcgtatcagccgaataaccaagcgagataccaacaataaaccgttcatcctctggcacatctaaagtttggtgaagaatcgctgggaaacgaacgctgttataggttggaatcgttcccaagccataagcagttgcagctaacataatattttcagcaaataagcccgcatcaaaaatcgaccaatctggtgaagctttaggaatagtaatataaagaattacaggcgaatcatataaagtattacaggcgaatcatataaagtattactagcatttgtcatcttttcatgagcttcatcaaaattagcaaaatgatgaacaattccatgccgccattgcttcatattatcttgggtttgcggtgcccaatcttcacggctcatcactgacaaatctgaatccccttggttacctgcaatatcttgatcacgataagcattcttaatttcttgtaatgtatcgcccatcgcacaatatacttgccaaggttgagagtttacccatgatggagcacgttgagctaattcaacaattttagtaatcattttcttttcaacgggtttgtccgtaaattgacgaattgaatggcgttgattaattgcatcttgtaattccattagatgactcctcctaaatcacatactcttactaaagtttagcatatttaggtttactttaataagatcttgtattggtcactttattttttcgccgcactgcttctctaatcttgggatagcgaaccattaagcaagcaccataagtaaaactagttgcgacatttaacacccagatgaaccaggcgttgtgactacggaaaaatgcgattgtggataagtctttaagaacctcttcaaacagttcatgtgatatttccgtagcattaatatgggccccataaaacacttcaacactgatgccaattgcaaatgaaacaagccagcccacaagatacggccaattccttttaatcttcagaatcggtcgttgatgggaatctagtttattagtgtctttaatctgcgttttacttgtctgtagaaagccaatcgtagctcctaagattagaagaataattgtaagtccagctgccgttaaagatcttacgttttctaagctcaagaccatcataattgcagaatacactgggataattattagctcaaatcgtgttaccttttcatattcaaatgttcctttaatgaatttatagattaatagaattacaaatatagtcattgataataccctaacttttaagtttgtatttgtattgtactatatgactaagatagtgaaacggccaatttcaggaataataatctgagatagctaatgttagcaccaacatgtcccgtaacaatagaccattttcgtgaataggttgtccgtaatttttaacaaaaaagttccttttaatctcagtaacgcgaaaacctattttctggtaaaggtataactgcttaaagctcgtactcccagtgccaatttgcaattgttgataatgatgtacctttgcaaagtgaacggcatcctgcaatagcctggttgctattccgtgattttcaagccgtggatcaacagcaatattctttatttctaatttatccgatgtaagttcttgcaaaaccattacagcaatgggatgaccatctttagactgtgcaaaaagtatccctgattgcagataattttgaactaatttcttacttggatcagcactgagaagcaaatcccaatgttcaggagttactgtcgttactaattctatccttgtatcgttattagtcatttgacaatccctcatccatactattgatagttagaaactgctgatgaagctgttttgaaaatttcattactcaaactcctttttctattaagactgtttgcacacactttcttattaaggagactaattcccacttacattacttaaggcaacaatccagcaaccttatcgcctaacgttggataaatcgccattactttttggcgatactcatccccattaatcttcaaaccaataattggcaagaagttattaatatcatcagccgcataatcgccaatttcacttgcccctaccaattgctgatccttaaagactaaagtaagggtactgatgtgatcgttttggcctgcgtaaaggctaccatattttagcgcaactgtcttaacctgatattgtgagtcaccagtgacatcatctggattaacaccggcacgggcaacctctgggaatgtaaaggctgcttgaccaattgtcgggtaaacaatatcttgatccgttttacctattaaataatcaaaaagatattgaccctcaaattcagcgaccggtgttaatttaggttgtttccgattaataacatccccaattgcatacacaccgtcaaccgttgtcatcaagtgaccgtcgacattaataccatgacgatcatattcaatatcagtattttcaagcgctaatttttcgatatttggatgacgaccggttgcatcaagcacatagtcagcctgtacttcaccatgattagttgtaacgagcaagccgtctttcccttgagttactttttgcgtatcagtattaaagctaaattttattccccgttgcttcatcgcattaactagcgcttcatcttccgccttggtaaattcacgaaggacgcggtcagaatgaacaacgattgttacttcagcgccagcagctgctacaagggttgctaactctaagcccacaaagccagcaccgattatcgtaatccgttgtggaagttcttttaacgagaggaggtcataactggtatgaagatactctttacccgaaatattcagaatatttggtgtttgccccgtcgcaatgataatacgatcggcctggtattgatgaccgtttacactaatagtatggttatctacaaaacttgcgtagccgtcttcaatatcatgacttttcttaataatatcgcgagtttcgcctggccatggatcaaaccgcttaagcttagtctgcattaatgcttcccaatctaattttgctggttgactaatgcctcgaccaagaagttgctgagattggagaacagtccgggcagctccttctagaaaaatttttggttcgcacccatagttagggcaagttcccccatattcgaaaccctcaactaccaatactttacggtcggttttagccaaaagattagccattttataggctgctggccctgatccgatcagaatatcatcatactttttcatgttcatccctccagattcttacattattgagtcaagtgtaacttaagtaatgaaaagagtacaaacgttttgtttcgtcgtataaaaatattaatcaaaagtcaattaatacttatcctctttcattatgaaagcgaattcaactaatgatttaacagtattttgtctaacctattgtatgatccattcaagaatgatagattagcctttaattattaggaggtggtctacatgttacaagttaatacattatttatcatgatcgccagtattctcgtgttattaatgacaccaggactggcttttttctatggtggtctagtcaatcggcgccatgctaataacatgttgctaactgtttttatgatgtgtggcttagccgtgattctttggattacagtaggctactctctttcattttccggcaaccattggggaatagtcggaaatttaaataatacattaatgattcatgtgccaatcgatgctatcactaaaactggcattccaattggcgattatgcaatgttcatgatgatgtttgcaattattaccccggcaatcttttgtggatcggtcgtcggccacggacgctttaattttttaataatgtttaccatttgctggtctatctttgtttactacccccttgtgcatatggtttgggcaccatatggactattggcaagattaggggcagttgactttgctggtggattagttgttcatgtaaatgcggggataacggccttaatcctttcagcctgggttggtcgacggaaagatgttcattctcaacgcaataatttatcgtgggtattaattggaacagcccttttatggattggttggtacggctttaatgctggttcggccctcgccgttaatgatacggccgtacaagccatgttaacaacgaccatctcatgttcaagtgcaatggtaacatggatgttattggatcgttatcagtttaatcatgttaccctagctggtgtctgtaatggtgcaattaccggtttagtagcaatcactcctggagcaggctacgttacactaggtggttcaatgattattggaatagtcggtgcaatcgttagccaatactttattactaagatcaaaccacaactgccaattgatgatgttgttgatgcattcggttgccatggggttagtggtatctggggaagtattgcaactggtatttttgctagccatcagatcagtcatctagtacctaatgggcttttatttggtggtggtttgcaccttttgcttgttcaaatcttcgttaccttattgacaattatatttattggtgtgatggatattatcttaataaaactgctctcaattgttttaccggtttcgattgataatgaaaaactggcggcgattcaaagtaagtgaacttaaatttttactgcaaaattagattatttacgtatatattccttttagaagcaaaaatacataaggagtaaatttatgaataatctatcacgagaagaacaaattgccttaatctatgacaaatggcaaaagatgacaattactagtgatccaatgtttggactagtaatgcaaaataaagaaatttgtttagagttaattaatagagccctgccaaacattaaagcaaaacagattatccagttagacacccaaaaagatattaatattgttagtgcccatcgtgttcgctttgacgtttatgttcgtgatgataaaaataatatcattgtcattgagatgcaagttaataatcaaaataacataccagcacgcttacgttattaccaagaacaggttaatcatgagctattaagacctgaaaataattactcagtactcaataattaccctacttatattattatgttttgtaattttgattattttaagcagggatgggcactatatgaatttaatcttacttgtactagagaccataacttgaaatttggtgataatcggacagtcgttatcttcaatgctcttgctaaaaaatttgataaaaatgatgaaccgattaagaacttccttgctttaatgtgcaatcaaggcgacaataagaatagatttattgcacagattcaagacgaaattgataaagtcaaacaagatccagaaaggagaaatggctttatgaagtacgaattaaacttgatggacgctaaaatggaagcacgagaagaaggaatggcaaaagcaaaaagggaagatattaaaaagttaattgactctctttatgaacttaatattaaaccagagatcattaaacaaaaagttatggaaaaatataatttaactgatgatgaatatgataagtttctcggttaataaagggagcgagacagaagtcactcgtgacttcgtttttcgacgcgaagctagcctctgggagcccccgcaagcaacaataggccttcagcgttcgactttgccggacgctgaaggccattgttgtactgcgctgttcgtattttatggaagtgacctaacttatgtcacagctcttttattgatgggtccgatatccagctgcctgagcatcagctaatgaatcaaaataaacgacattttcaggagcaatcccagaatatggatattgccccggtaagtagcaatacattgttgaacgatcaccaataattgaatttggttcatagttatccggatcaacccacggctctggttctttaccactcgcgggggctgtatttccatcattaggctgttgagttgttgaaggaatcgttggactactattatttgaatagctcttctcatcattcggttgctgagattgctggccgattatcgaagacccccgttgactttccttaccgctggaagatttgatgacagaactagttttttctttatttttagattcttttgtcgattttttcttcttatccgattctttagttgttttaactactgcatcctcttgagtctcctgtgcctgattacgactactaatgaaccatccgccaccaattaataataaaataactattatccataaccatggtcgacgataaaacggcttccgatgttgatttctgttcataactggcctcctttatctttgaactttcgatttttaacaaaaacgtttccaaattcattatataaaatcaccatagcgatagataggtaccttcaacgggattaattattttttagagaattggttataggatattcataaaagataaacattcttcttaaaattattaactataattaactaaatactgaccatcatcaagtaaaaattgcttaaataatggcagcgtaaattttagctttccatatcctgctggtgttatgagttgactatccattaaccgccgacgatacattccaatataaccaggctttttctttaattttgttcttaagcaactagttgaaacagggtactcagaagctttagccatagtaataacaaattgctgatccataatagataattcttcaagcatcttactataagcatttcgacttaattgggcttgatactctggctggatactatctatagttttcatcgtaatgtgtttatccggtgattcccataaaagataaccaagcaattgaaaggcatatgcatatccgtctgaaagaagagcggcgcgacgaaccacttctggcgaaatttccggatctcgtactttcaatgcttgttggtattgcgctctgatatcatagtaattcagtggagaaagacttattcttccactacgtaataagaaagttaatacatgattattttgcaattcttgaacatttttgggtaatccagtcatgattattgagattggtaacccctcactaatcatgacttgatatactgatgctaattcaaccattcccgttacctcttgagcttcatcaatcattaccaatactttctggttatttttgtctaatatttttaacattttttttaatacaagttgaaaatttgatgtttgtttatcattaagagtgaattttaagcctaatccgcctatttcaaaattaatatcggagagttggtcgaatacttttttgattttatttgttgattgttggtaaatcatttcagccaaacgtcccaccatattatctccaataattaagtgaatagttatccacgtcggatcttgatcaatctgctttccaacagaattcataaaaactgtttttccaactccacgatttccataaatcaaagtagttcgataaggagtatcaagcgctttaatgtctttaaccaattttgattgtacttcttcgcgatctaataacacagttggttgaataccaaaacttggattaaaaggatttttcatattcttttcctctattttatatttctaatttaattttatatctgtttatatctttgctcaagttttatatctgtttatatcttaaattttatatgtgtaaaaagccaggtaactcccttctctaaaaaagttagaaattacttggcttttttatcaatctaattttctactctaataaaagtgatacttatttcatcatatttgatatttagaactagtaatctttttagctaattcagtatttactaatcgaatagctgatgaattcttataagaatttcccccaaagtttaaatcaccataccaacaaattttttgatcaaaaacacaaatattattaccaatttgttcttttaacttaaaatcgactttatttgataaaagtttatagtcacaatttctctgctttttacccaaagtaagggaaatctgactaaattttaccatttcattcaacatttcaatttgtttttgattaatcctttttaaacaaataaaggctttcttagcattagctagatcttgtctccatacctgcaaatagtcatttttagtatagtaagcagttgaataactattccattgcttactatggacaaaactatatccttgttgcttatagactcttaccctcttccgatacatctttgcaaatgtctcatcagcaatatcaacataatcatatacacgtaattcgtcttttttatctaggcttcgttctaatcgaccaagatattgctttgtattacctttccaagaaaaggtaacgttaaaaataatgtatctaaacttggtaaatcaaatccttctcccacatatttgccagtcgacaaaagaatatatgggtctttaatttttgataacttaatggataatttttgtgttccagtagtcaaatatactttgctatttttctgctttagttttgcgtaaagttcattaagatgtttaattcgttcactcaacaataaaatatgtcttccttcagacaatgcttggagtgcgtcctttactatttgatcattacggtcattattttcagcaatcaaccttatcttttgcgcataagtatcacgttctaatttacttttagcttcaagaaaactattataacgcggatatatataacgagaaatcaaatattctttttcactatcttgagcttggtagataatatttccacaacgataatacataaaattttctaatccatcttttctttcgggcgttgctgttaaccccagaacatatcgtgtgtttgcttctactaaagttttttcaaaggttaccgcagaaatatgatggcattcatcaacaattatttgttcatagtcttgaaatagttttgtacgctcaatagctgataaatggattaatttacgaatattaatgatatcgactaattttgaaggatgattacgagttccagaaataatttcaatttgttttttcttaacgcatcgtccagtcttagttaattctttatatggcacatccttaattttcaaaaatcttaaagcagcatctcgccattgattagcgatgttaacggtagacacaataatcaatgttcttgctttacgccttgcaattagcgcacatccaacaactgtttttccaaatccagtatgagcacacagcatccccaatttatttttatcaattttatttactgcttcttcttgttgtggccgtagggtacctgtaaattcaacattcaacgctttggacagagtaaattgttcttttaaataactatgacaattatcttttaatgacgactctactcctcgtggcaatcgtaaatatttaccatcaatttttgctgctgttaaaattgatggaacatcccacacaggcatgcgcattctttgtctcttaatatattctggattactaaaagtagctaagtttaataatgataattgctcttgacgcgttaaattttgacgattaataaatatttccccagcaataaagccttcaacttttttaggaaaattttgcaaaaacgggataattaatctagagttttcgccctttagaattttcagatctttagtaatttgactaatgaaattttttacttcttcttcactatacttttttgtgttttctaattggtcaaataactgtgacagtgctaaaggctgaagattattatcagtaaaaatagactttttctcttttacatcactccattttaatggcaaagcaatcaaatttccaaatcctttttcaggtaatcgatcttgattaggaatcatacgatcaaatgatgacaaatcaagactttcactagtaatcatcgactctactaaaatcaatttaccaagaaacctagctgtacttgccgcaattggttgactaaaaaatatccacagatgataactattaccagatgatgatatttcaggaagacagttaagatcatatttttggcaagtcttaattactgccttagtcattttataaggttcagcggttgattgatgtttatcaaaatcaaaaactaataactttgttttatcatcttttaataaaggatagatcccgtaacgatgatatttatctgaagaagaaatctgctcataaattactttcctagaataaggaagatattgtttcttcaattttgacaatgcttctttattatttcgcaattgataaaagcttcgccaattttttaatgctggactatatcctttaccattactccacttttgagcaaatacatcaggacgacctgcaaaataatcagcatataatgctagtttttcaccagttgttcttttcttagctataagacttaataatttctgttcactaataatccaatccgtccctttatcagtggtaattgagtaaaatttttctttagtttcgtaatgccaatatgcttgagtaacggtaatgatatcaccgttatttaacgcgtattctttacctatttccatgtagtttaactccatttagctagctgctattattacccatcaagattctcgaaactttagattagccaaatcgtttaataacagtattaatatcatctcttaattctttactgaggccggttaaatcttcatctgtaattacattctctgataacagctgcaataaagtctgaaacatggatcttttcgatacttcaacaagcacctcgggcgattttcgatccgcctttatttgtttttccagcttccaaaatttattcgctgccgaaccatcaccatctaatattcttttgtattcctgattaaggcgattcatatatctttcttgccattttggaagcagcttgttgaataattgccaatcgcttttagagatatcattcatttcttcttacctcgtttttactttaattatacgataaatcgttttatgaaattcaacttcttttgcgccttataccaacaccaaagcctaatcctactctaacatgaatccacattcaaagatggtattaaagtttacatagcactcagctcttcgaatttgggtgttatttttagttaaccataattgcatttcatattcatatattaaccacttatctttctatcaatcacaaatattgtttttactgatatattcacactatcaaatatattaggaggcattttaatcatgttaattaaggcaaataatcttactaaaagatacggaacaaaattagctctagataacataaatttacagatcgatcgtggtcaattaattgcttatctaggtactaatggtgcagggaaatcaactactatcaatcttcttactggtttaatgacgccaacctccgggatgatcgcacgccgtcaaggaataaaaattggcgttgtcttccaagatagcattctcgataaagagctttcagttaaagataatcttaactttagatcaaacttatatcatgaagatcatactgaatgggttcaccagttaattagcctaatgggcctcacccattttctaaatcagcgctatggaacattatctggtggacagcgacgcagggttgatatcaatcgtgccttgattaccgacccagatattcttttccttgacgaaccgacaactggattggatttacaaacgcgacttgttatttggaacctccttcaaaagctacaaaaggaacatggtctaactatttttctaacaactcattacttagaagaagccgaaaatgccgatcaaatgtatatcttagaaaacggcaaaattttagtttctggctcagcaaccgatattaaacaacattatgcaccaactaaattagtggttacaacaaatggacataagctacaaactaactactctgagaaacaattaacacctcaaaaattttcttttgatggccttaattgttcagaagttattacattactacatagcaatcaagagtatatcattaacttctcatatacccccggttcaattaacgatgcttttgtcaaaattaccggaaaggagcttcaataatatgattgcgttaattaaaaaaaacttaaagatttactttgctaataagattggtgtcttgatgtcttgccttggtgctttaatttcattctttatttatattggttttttgcagcaaaacctgatatcttcatggcaatcattgcctcatacaaaggaaatgttaggtttatggatgattagtggaattgtcgccatcgccggcattaccacttcatttcaagctcttggacaattagtcaaagatcgagaaagccgaacatgggatgatttaagtctaactgatttgacaccgttccaaattaattgtagctatttaactgcaacaatatttattagcacattaatgcagattattacattcttcatcatggcagtttactttattttagtagatagtattactattccaactactgcattgcttctcggattattttttattgttttaggtgcaattggcgcaagtgctgttaatttaattattgttgacctaatccattcttctacgacttttagccgcctttctgccataattggcgcagcttccggatttatgatcgctacttatatgccctatggaacattatccaaatcagcacaatttgtagtaaaattatttccaagtagttatgaggctgctagcttgcgaagccttctgctaaataaactaagcaaaaaatttttaccgccatccagtcggtaccaaatgattgaatatctgggtatccacttcaagattcatggttatcagttaaataattatagtaatgcattaatgattgtgggaatgtctatagttttaatagatcttggagctgtttgggcaaatcgatatcagaggaagagttaattgtgcaaattcattttcagtcagatccattactaggtcctgacgatcttaatattactgtgaacgctgttactaaaaacgacaaagttattaacctgcttaattatttagataagtatgatcaaaaaagtagctctttaatcccaataaaaacagaagataggattttaactataaagcaaatagagcttatcaaggtagaggtaaccaaaaacatcctctctttttatacaaaaagcgatgtaattcaagcaaacggacgactatatcaagtattaacaaggcttaacgaaaattttgttcaagtatcaaaacacggcattattaatttaaatcatttactttccctagaagctggatttactggcaatatgattgctaaattaaattttgatcaacgtgccgatgtttcacggaaatatctaccagagttagaaagaagattgggactataaaatgataaatttaaaaaggggtatccgttactttattcgcgggatgggttatggatctattacttatctcgcaattattgcatttctcacacataatatgactgtttctactactagtgtcattacagtgttcattattagtggattgatcggggaattaagttttgtctttcaaacagaactaccgtattcgatcgctctcgttattcacctaatcgggacctttattctatattctgtaatgatgctaatcaatcactggcctcttaattggcaaaccattgtaattttcattatcgtctatatcgctatttggctttttattcgtttgttagaagagcaacatattaatcgaattaataagcaaattagaaacaggcaaaaataaattttgtatcgcaatcatcgcttcgttactaaaatgaggtgatgatttttgtataggttaatgtccatacaatcagatgtttgataacttcttagtttcacatttgcttgtcgatctgtcattttgctgcctcccttaacacttttcttttatataaaacgttaagtacacgattaccctacaaacgcctacttgactatcgaaatagaacatagaatactcgactagttagttcaaaatagaaagaatcaccatctttcaacgttacataaagttcacgttcaaagatggtgaagtggttaatttaactatttaaggttaagttttcaatgcaatgatcgccattattatctcattgaaggctgacaaagatttccgtatatctgttaccttacacctcttacaaaaatagtgaggcgaatcatttaattaactggtttaattcgttgatgtccacagtatcaaggtcaattggttctccacctaaccagtctaaaaagtcaggatcaacttgccctttttggtaatcatcataatactgctctaaagcaccgacaccaccaacatattcaataataccgtaaccacgggctttttgaacatgtggtagctcctcattagtaactggttgaattttttggacatgaagtttaaactcccagccgtccccatagtcataatgaatagttaatttatctttttcatttaataatgagaccgttgctagatcaagcttaacttttgtcatcccgcctggcacaaaatcttctgactgagtataaaattcctgagtctgttcattaattgcatcatacaagtgtcccaagttaccatgaaacatcaaaatcactgtttcagcgagttcctcaattgtactactacccttaatcacgaacgtacggcttgctagcggtttaaaatcagctaatttagcagtaattacatacgcttgaccatagttttgcgggttaatcaactgacggttgccaacattcgttggtatatctgcttgtgctggagctagttcgtcaagcaactgctgaataaatttatcttgatagtcatcttctggcgcagctaattccggttctccatagataatatcgtagcttgtatctagatagtctgcaacatccctagcagctgattgactcacgatccctgtgtgacttagacaaacataaaaattggataacgtaacagaaagaagatcctcatcaatttgatctaacgttccagcgaaaaagatgtttggcgcagctaggttagtagtgaccgtgcaaattttatttttaacatgaagtggttcaaaaattggtccaagatacgacgagcagtcttatcatctcccattaactgaccatcagcactggcgataaactggtcaatcatttgctggttgttttggctaatcgcttgaactgttgctggattatctgctgaggcttttccttcgtcatccgcccaaatacggggatctttaaattgtggcttgatcgtacaatattttgcccccggtcgtggagctttcacctttaccggatattcttcattaaccaattggcaaaatttcattaatacttcctgatcatttccagatagagctaacaataagtagacaagatcattgaaatcctcagttgatgaaaaatcatcattatcgttaagggtttccttaaattctgcttggtggctagcaattatctgcaaataatttttaagtttttcgttttcagcagatgagattggccggtataaattaaatgaaaaaacattctgcattaaccaagtacgttgtggatcaaccaaaaaaggcatttcatttagaaagttaatggcaacttgactaaacttaccctcgcctaatttgtcagtaaagactggcaaaccagtttcctcttctacataataggtagtatgttttattatcaatctttaccagactaagccgccaccgtcgtaaaggtttttggctaatcttaccagtattattataaggtagtcgatcagccaggtcaggactataaaataactgtgccatgatgattgctcctttatttttgaatgtgtgagaaatgaattttattcgcgctctataaaagaaagcgaagggaatatcatctatagtttacagttgtaagaatgtccaagcaagttatgatccctgaacattaatccacagttttagcaattttttgatagtattaaccattttacttaaatcgatattgggcaattttttgcaaataactttggcggcgttgcggggatgaccaggaaatcccgccaaagttaagccacttccgatgctcaaagccaagttgtttcaaggttgtattaacaaatactcgctgaatatcatccccacagaaaaaccgcaagtaccaagttggcgaagttgaagtagttaatacatagcaatgctggacattcgtcaatagccctttaattccggtcctggttaccgtatgggagagatcggggccctctttcatcaccttatcaataaccccttttaacattccgggaatactattccaccagcaaggagttataaaaatcactgtccgacatgattttaagagttctaaatatttgcgcaccaagggatcaactgtccctccttgatgatacaatgaaagttcttccgcagaataagtaggatcaaaatgttccgcataaaggtcaattaattgaaccaattagtcgaaaaaagttagaaattaacgtttgaccatcgagttcatgttggatttgagttatactttttattgtgcaagacccctttatactttgtttttggttatttaaagtatagtccaaaggggcttgcttttttaatttttcgtagaaaaaactgatagcctcgcctgtttgacatggttatcagctttcaagtttcagttataaatgaataatttggatcgttcgcaaatgacgcgtgagtttactatccgcttccaattgagcaagcgtccgcgataatgtttcgggggttgtcccaaggtatgaagaaaggtccttgagtttcaagggtagcttaactttcgaactctgttgatcaaccatcaattgtttcagataagtcactacccgttcttcaatgtttggcagtcccatcagccgtgtttgctgacgaagactttcaatcattgctgcctgtcctgccattagttttaaggtaatttcgctttggtggtgaatcaactggataaagtcttgccgattaagactacagatatcactgtctgtagtcatttctacataactactatggttggcaacccccaggagccaggtttcaccaacataatcacctgtcttcagcattcgttgcacccgttcttcaccatcttcacttagttggtacattcgaccatggccactttttacaatcactaaccggtcatccatgtctggactcacaacaattgttccgcgcttaatacgctggtgatgaaccagctgttccacttggcgctggcgttctaaactcaactgattaaagagcggaaccaggtgaacacaaagttcttctttcattagagtatcctccatcattcgggtgttagaagtcatcatcatcttcttcagtatacaaccccgtccgtaaatcatgccccaagaagcgctgggttaaagcaatttgctttttgatccatgacaataattccgttaaatctactgctaattcgggccactcttctttattgccaagagcaatggccttcgtgataaagagaatctgcgtgtcaaaatcctttaccaaggcaaataattggtcatcccctggcaaatacttatcagcacccctttcttctagcatggtaaattcacgaaactgatccgtcgtcgttggaatactctcaccattctgaactagcagctgattcaggtgattaaatgcttcctgttcatgcgcaatccaatcatcgccatattgggataaaaacaatgccgcattccctttcgtaaacagctttgcctgactaatctttagtgaatgaattaataagttggcaatgatatgacccgtcatcgcccctgccgttggtgtatggtgatcaatatcgctctgttttagttcctgttgatactgttcttcactagtcatctgatagctcctttaccttaattccctgaaccgtgtatcccattttttcaatatttgcttgaacatcatcgggtgaagctttggccaaatctagtgtaaatttaacctttcccgcattgaacagtaccttcacgtcatcggtcccgtcaatggtttcaacacttttttgaatcttagttaggcatgatggacaagttaaaccatcaagtttcatcattactttttccatggttatcactcctttgttattttcattgtaatttagccaccgtaaataaaaattgattatcatcaattttgagaaattcgtttcatcaaccgcatactgttcaaaataacaatcagaatactaagctcatgaatcagcattcctgatgccatttcgatataaccaacaaaaagtccaataaacaatagcactaccgtcagtaaggcaatcaagatgttttcattcatattggcgatggttcgccgtgccaagcgaaaactggtgactagactattcagatctgatttcacaagtactaggtcggctacatccattgcaacatcagtaccggaacccattgccactgcaacatcagctgcggagagtgccggactatcattaatcccgtcaccaataaatgcgatccgatgaccgtcagcctgttgttgtttgagatagtcagctttcccttgaggaagcatcgctgcgtgaacttcatcgattggcagtttagctgcgatctgatgagcggttccttcattatcgccagtcaacattatgagtcgtttgacccctaacgcttttaattgtcgtaacgccgattgtgcctgtgatcgtaactgatctttgataccaaagattgccaattcatggtgatccatgctggcaaaaataacaatcgaatttccatcactcgtcagttgatcaatgagttggtcgagagttgaactggtacctaataagtctttaatcagggttggattacctaataagtactcaccttcaccaatttgcgctcggattccctgtcccttaatcgtttgaatatcggttggctgataatcgtgcttcctatctagcttgccaattgcttgtgccaacgggtggtccgatcgttgttcaactgctaccgcttgatcaataatcgtctgtcggtctccgttcagaacattgacactagtaacaaccggcttcccgacggttaaggtacccgtcttatcaaaggcaatcgtgtcaatatgcttcatccggtccatgacatcggaacccttaaagagaatcccctgacgagcaccattaccgattccagcaacagtagatgcagggacaccaatcacaagcgcacctggacagccaagaaccattacggtaattgctaaccgcacgtctcgtgtaatcaagccaaccataattgctaccaatagcacaactggcgtgtaataacgggcgaagcgatcaataaagcgttgcgtcttcgtttgcgaatcctgagcttcttccactagttcaataattttaccgaacgtagtatcttcgcctgccgcggtagtattcaccgtcaccgtcccattctccaaaatggttcccgcaaaaactgcatctccaggatgtttcttaactaaccgagactccccagtaatactggcttcatttagaacggcagtcccagtcttgatcgtgccatcgactggaacctgatttccagtcttaattaagaccatgtccccggatcaatgaagtccacatcctcatcactggtattgccatcttcatcaatcaccaccgcggtttgaggagcaagttcggttagctgcttaattgccgaccgtgtcttccttaaagtagcgttttctaatacctcaccaaccataaaaagccaggtaacaatcgccgcttcgttatattcgccaatgataaaagcaccgatcaccgcaatactgacgagaacatcaatcgatatcagccgtacctctaatgatgaaatggctgtgaacaaaatcggcaatagaccgatgacccctgcaatggccattaggatctgatacattaagttatttgagctgataaagcgaaaagcttctgccagaattaataaaacggtcaagccgatcaccaatgcttgccgttgctcagtcaggaatcgttgtactttgaccatatcggcacctccttttactgtccttagtataagaaaagaagccagtaagttacttgaccgccatcaagtttggtaatttaaaaagcctcataattggattaaccaaatataaggcttgatacgtgtttctacttatttaatttgctaatgatttcattaattaaatatttgatttagtttgaatcagtccagcaagatatttaccatcatcaatactcattgtggatcgatgattcagccaaaagagaagtaacttgataatactgtccacatacagtgtttgaaaaaacttatagagagggaccttttgaatttctgctctagtcgtgttgaataagtacggagctcgttcaagaaattcatcgtttgccaagttaataatcgcatggtatagattaatatcgccattgtccgataataagacagccaatatatctttacgatcatcacaatatttaagggtcacattaaaagcagagttagctaattccataattttttgttctgatgcattatgagtatcttctagtgatgtccggtctttttgcagcgcatttttcaagctaatgaggatattcgtctctacccagtggataaaatccttcttatttttaaaataattataaaaggtcttcttactaacttcgacttgattaataatatcgatagttcgacattcacttaacttttgtgttgataaaaccttaattaatccattgaggattcggtttttagtattgattgtccgaacgtccatttatccttgccactcctattccatatgactaagcgttttcattatagacggtcggcaatattattacattaaatctcggttttcttacacgctcagtttacatttttactcatttattctgtaatagcgtccctaactttattaaacataagccaataacagccccgatgaaaagaactaattttaatattcaagtactggggttcttacttcatagcaggcagtcaaaattcattaaaccagcgtcgcacccagtgaattcttaaaatggtcaagcgcccactcctgaccatgcttggtaaaggtggcgacccccttaaccggaatcgtaatctggtagttcaaattataggcggcaattgcggtgtgcaggacacagatatcggtgcaaacacctgtaatccacaagttatcaatttttcgttctcgcaggtagttatcaagattagtattttgaaatgatgaatagcggttcttattaaactggtaaacccggtcactggcctgatgttgttcaaaccagtcattaaccttgccgtatagctgttgaccaggcgtaccgaccacgttatgtggcgggaagagtttagcttctggactaaaccggtccctacaatgggcatcagtcgggaaaattacgtagtcgccattttggtaaaaacggttggccagctgaaccaaataatcttctaattcctgcgctggcttgccacaagtaagcgcaccattgtcagcgacaaaatcgtttgtataatcaataattaataatgctttagtcattgctaactccttatttttgtgcctcatcaaccagcttttgttgcatgtcagctaaccgcttggttaaataaactgggaagcggtccggattaagcaaccgcttagtagccgccggcagctgtgctaattcggtctgcgcaaaatgctggatggcaaaagtgtcggtttcaattggcgccgcttttttcagtgtcaaaacttgcttaagcagtggcttagcaatgaagtcagttagaatcactttattccgggtgacgtgaatgtcagcattgattgccgcaatttcggttccaatctgctcgtcagccagggcaattacatcggcaatagcgtgttggggattatgcttatcgtagagccggtaaatctgcttattcccagggagcgtaatcttttcgcgactattactaatcttgatctttggcacccatttgccatcattttctagtgccgacattttataaacaacgcttaatactggactggatgaactggtaattagtcgctcaccgatcccaaagttatccagtggtgccccttcatcaagcaatgacttaacaatgtgggcatcaagggcgtttgaagcagtaatcttagcgttggtaaaaccagcctcgtccatcatcttccgagccttggctgccaactgggcaatatcaccagaatcgatgcggataccaaccggttcgtggccagctgcccgcaattccttaaagactttaattgcgttcggtactccagagttaaccacatcgtaagtatcaactaacagggcagcattgtcagggtaaattttggcccaggcacgaaaggccgttaattcatcaggaaagctttcaatccaggcgtgggccatcgtccccgccgccggaaggttaaacagcttggcagctagcacattggaggtactactgcacccaccaataatggcagcccgcgcaccatatattgcggcatcaggcccctgcgcccgtcgtgcaccaaattccattactgggcgtccgccagtaacgctggtaatctgccatgccttcgttgcaatcaatgattggtggttaatgatgtttaagatcagggtttcgagaagttggacatcaattagtgggccactaatactaaggattggttcctgtgggaagactggcgtgccttctgggattgccttaattgagcagcggttgtgagctgctgtcaggtaaaagagaaagtcgtcactaaagtggttaagggaccgcagataagcaatgtcaccagttgaaaagtgccagttcttaacttcatcaattacttgcatcaatccagcactaatcacaaaactgccatcatcgggcgccttacggtaaaagacatcgaagcgcgcctgcttatcgtggggaagcgtttgataataaccgttggccattgaaaactcatacatgtcggttaataattcatgtttcattattaaataactcctaacaagtttaggtaaaaaatactttaactactgcaaaaaataaaagtatattgaacttttattatcactaattgtagcacttttatttttagacgcaaggtagtaccagtttaaataactttggtggccggcctgaccgctttgttgcggcggtaccaacttccttaaacagcttttggtgggtctttttaaaattagaattatcaatttgatcgaccgttgtttggcggaaagtagcataaacttcgcgggcttgccgaagggtaaaagtcggtcctaagatctgtaaaatggttggctggtagtccagtttatttttaattcgtacaatggccgtattaataatttggtggtggtcaaatgcaagcgccggtcctgcagccaaactcaaaactaagtcaccattttgcaagataaacttcccgtggtcaaagttaagactaaaccacccgacttcggttgctccgtacccggccctcagttgcggcattgtcggtaagaaagtcatgtaggcaatcgccaaggcccgcccacggcttacccggtcgggatcggtgaaggttgccaactgttcggtagcactgtttgatagacgaacaccaattttatccttaatcaggcggatacaggcagcgtcagcactttcatcccgccacaatagggtttctggtaaagcccagtggccctcaaatggcggataagcccgtttgaccagcaggacttgtggtaaatgggtcaagggattaaaactccaaataatatttgcaatcgtaattagcggatgcgcaacaactttgtcagccatctctttcacctcacaaaatattatagcgcaatcaagaatcacaataataaaaaatcgacaactaaggacggccttagttattgatttaacctaaattaacttctttaattcagcaattgctttttcgtagtctggttcatcagttaattcagttacaatttgccggtaaacaaccttcccatccggatcaagaatccagactgaccgcgcaaggattccttcatctggtattaacagctttgattcgtaaccaaaggattcttccttgtcagaaaccaattccatgtttttgacaccttcagcagcacaccacttctgttgatcttcagtcgtgttagttgaaatggtcaggaaattaacctctgggaattggtccattgttgagttaaaccgctgtgtttgaatgctacaaaccggggtgttaatatctggaacaacgcttaagagagttattttgccaagcaattgccgggtcttaaccttgtcaccattcttatcaaaaaccttgaagtgtgggaattcgtcaccaacagctggtggattgcctactaattgccgcttttcaccattaattgtgatttccattcttagcaactccttttctaattttggttaggtacagtatatcaaaaacgcaattaaaaagcattgattatactcattgttttagaaaatttatgagctgtgtagctaggcaaggtatcttttaacctcgcggtttgtaaaattaagttagaaaaataaaaagccatttgtggtagacttttgaatacccatacatcaaaagaaaggacaccacaaatgacctaccatcatcttaccatagacgaactaacgatgatcgctaattttcgtgaccaaggagtaaaagcctaccgggccgccaaacttttgcaccggagcttagaaaccgtctaccgagtttatcgctttctggccgccggccacacgctccaagaatattaccaacactatcgtgaaaacaaggctcattgcggtcggaaggctattcaattgcccactgatgaggtaacttatatcaaagccaaagtggctcaaggctggacgccagacacaattatgggacgcgctgaacggccactcagctgtagtatgcggacactttaccgccttttcgaacggggcaattttgatgtgcggaccttgccgatgaaaggcaagcgtcgccccaatggttacgtagaacggcgggggaaggccggtcaacttggccaaagcattcaccaacgggctatcgactttcccaactttaaccgtgaattcggccaccttgaagccgacaccgtccagggcaaaggacatcagggcgccgttatgactttggtagaacggacttccaaagtcgaagtgattcttaacgtccatagtaagacggccaccagtgtgatccagcacttacaggaatggttggcaaagtttccaccccacttcttcaagtcgattaccttcgacaatgggaaggagttcgctgactggcgagcaattgccaaccaatttgacctccagacctactttgccgaggtgggggcacctaaccaacgggggttaaacgagaacaacaacggccttctgcggcgcgatgggctccacaaaggccgcgatctccgccacctagctgatgaagaggttgctcaaataatgagttaccggaacaacattcctcgcaagtcattgggctatcaaacaccttacgaggtattcatgaagtatgtcactgatgagcaactactttttttctaacttaaattgacatttcgggcctaaaataggcagcgttaccttctaaaaggacttaatgtgttaactaactgcctttatatttcaatacatcatactaaggtaaattctcctaaattttataaattatgcaactgcaaacacatagaaacaatgcctataaatattgatataccagtcatttgaagtataacagaaaaattagacaaagttaaatagttaaactcgtaaggcatggttccggtattcaaccggtgtcatgccttttgtttttaaagagattcgttggttgttgaaacgatatacatagtttaaggaaagctttttgaactctccaaaatctttacatggcgtaaatccattaaacagttccgttttgtataggtgaaagaaactctcaatgggcgcattgtcatggcaattgcccttacgggacatgctttgaacaaaatgaagattagctagtgttttggcatagtaaacctgctgatattgccatccttgatctgaatgaataataggatgggcattatcaggtaatttttgcagtaattcatcaatagtacttttgaccagttgtagattgggatgataacttacttgaaaagccagtacttccttactagcttcatcaaccatagctgaaacataagcccactgttgattagctagtcatatctgagtgatatcgatgtggatgacttggtatggtttcgttgctgtaaaggattgttggagaacattctgtgcaatttttctaacagtaccgcgatatgatgaatatttaccattacggtgttggttatacatacttacttggacgcctagctgacgcatgatgcgggtagctgtggcgtcggctaagtgaatcccgtcttgatcaagtaaagctttcacgcgacgataaccgtaggttcgtcgtccgcgataaagcccctgcttgctaatcgccaacactcgttgtttaacttgagcgtatttatcgtaagggttagcgatgcgcttccgctcatcgtaataagttactctcgataatgagattctttggaggagcttaccaaccgagtgacgctgtttcttaggaagcttagcttgatgagccctgatctgatccactatttgtgttttttgtcgagctttgagggtccgaacagggccaacgatttttttagaatatcccgatccattttgacgtcatacaattcttgtttggtttgcgccaattcttccttaagtcgttcaatctcatttttattgacttgtttctttagcgctttccggtttttctttttcactttaggtggcctacctttaggatgaggctttaatgcctggtaaccgccttgatgaaaatctcgtttccaatgactaatttgattaggcaagagatcatatttggctgctaccatcgccattgattcctcatgagtttgatagtagtttatcacgctcaatttgaaatcagcactaaaggttcgcttcacgcgacgatgttgaaggctggtgattccttgaagtctggcttgttcaatccaatactgaatataatggtgactaagatgatattttttagctaactggtatgaaattaagccatctgttgcccattcacgaacaagctttaccttgaattcagaactatatttagtcacgcggtttttcaagttccataatttttcctcaaaatcatcataaattctatttcgagtatactactgtccagataatttataatttttgaatctaatatttaatatttaatgagtagtattatactaatcaactcaatcgtttcacctaaaatccaccatttcttcatctgtcataattccgctcatatcaactgttccaactcttttcactaccctaatcaacacgacctgccaaaatggacattcgtacacaccactatcgaaataggacattgaacactcgacctgccagctccaaatagaaaagtgtactaatcccaatcttcaaaatcagaatttgtacactttcaatcagctatagatgccgtcatgccggcgtttatcggctatttttctgtacgttccaggacagtaacagattcaacatgcgtcgtctgtgggaactggtctactggctggattggctttgttacatggtagccttggtcagcaaaacgcttgatatcgcgaactaaggtagcaggattacaggaaacataaatcactttctttggtgccatcttaccagtagcttcgatcagactttcagcaagccccttccgtggtggatcaacgataataacatctggtttgagcccttctgcttgccacttagcaaattgatcttccgccttaccaacaacaaatttggcattcttaataccattccgtttagcattatgtttggcgtcttcaatggcggcgggaacaatttctactccataaacttgcttagcgtgcttagctactgccagggagatcgtgccaattccacaataggcatcgatgaccgtttgattgccgtccaagccagcattatcaatggccgtttggtaaaggcgttcagtctgttgcggattaacctggtagaaggacagtggtgagattgcaaaatcaatcccaaggagctgatcatgaatttcatcagcaccccataacgttttattcttatcaccaagcaagcggttcgttcgcttatcattgatgttttgcacaatactttttacttctggcactctggcaacgatcccgtcgacgatttgcttttccattggtaaccgcttcgtattcgtgactaagactaccatcatttcatggctgtaatatcctcgccgaaccattactgtgcgaatcacgcccttaccagtttgttcatcatatggcgtaatgtggtattgccgtaataagtcacgaacaaccgcaatggctttatcaatttctggatcctggatatagaaatcttcaattgatactaaattgtggctcccccgcttataaaaaccggtttctaattgaccgtggaccattttgactggtacttgggccttgttgcggtaatgataaggcttttccatccccatcgttggcaaaacttcaatctcatctaagtgtgctttggccaataattcttgaatttggtgttgcttgaatttcaactgggcatcatatttcaaatgaccaagcggcgcgattcccgtttgaatgtattttttatccttaacatcaacgcggtctggactcttcgtctgccagtccattacccgtccccaagcaaagtggctggttaccttggtgatctttaccgtaatctcttcaccaggaagggcattaggaacaaagacgggaaaatcatcaatcttaacgaccccattgccctcgtaagataaatccactaccttcgctggatattcttcatttttatgtactggaatgtttaatttcaaagttattcctccattaatttcaacgttacaaacttctcctattataacaaaacaaacggccaacttcctctttgcgaagctgaccgtttatttattctatttctttttgcgatctttataatcgtcaatgccattcataaagtcttcttcgacccgcttaaaatcagctgaggttgtaatcgcatcttctggaatctcatccaagttagcaattacttctaggtgctgcttaaggttatgaaatttcattggcgcgtcgccaccatattccccgtccaggttaaccatcaagcggtcatccttgtttagcggaataacttcaatatcggttgctttagcataaataatacgcggatcatcaaggtgctttccttgaagcgccttcgccattaagctgagcatatcgatcacactgctcttcttaacgataatcatcgtaaactttccatcatcaagtgatgcatccggcacaatctgttcaaaaccgccgaccgaattagtcaaggcaatcataaacatggaagcaccgccccggtattcctgattatcatacttgattagcatgtcgactggcttaatccgcggcattaactctgctcccttggcgaagtatgctgcgtaaccaaagagggacttcatttgcgaagggacctcataggttaattcagtcatcgttccaccagcagcaatattcatgaagtagttttcaccagcccgaccaatatcaatcttaaatttcttattcttctttaagattaacttagccgcggcgatcggatcatcacgaggaatccgtaatgcccgtgcatagtcattagtcgtccctgctggaataatcgctaatgttggccgatgttctaacccagcaattccattaaccacttcattcagagtaccatctccaccagcagctacaatcaaatcaaaaccgtcttcagcagcacgagtggcttcgttcttagccgagttaggcgcaggagtagtcgcaaaagcactagtttcatatccagctttctcataaattgcgagaatatcaactaaatcacttcgcaatgtttcacggcctgaggtaggattataaattatccgagcacgttttcgcacggtcatccctccctactctatttagccttcaaagacttcatcaataattgagtaacaacttgtgggttagccttaccacgcgtttgcttcatgatttgacccattaagtagccgacagcccggtctttaccattcttaaagtcttcaattgattgttcgttgttatcaagaacttcatcaacgattggctgtagttgcgcaggatcagataactgaacaagaccgtgttcctttgcgtaagcatttggttcttcaccatctaagattcccttgaagaccttcttagccatcttagaagaaattgttccgtcttcaatcaacttcaccataccggcaaggttagctggagtaagcttggtatcttgtaagtcaacttgcttatcgttcaagtatgagtttacatcgttcattaagtagttggctacccgcttaggatcgccaccgttcttaacagcttcttcaaagaaatcagacatttccttagtctgggtaagaaccatcgcatcgtaatcagttaagccaagatccttaacatagtgctcacgacgctcaccaggcatttctggcatttcgctttcaatttcgctaatccattcatcgctaacgtttactggtggcaagtctggttctgggaagtaacggtaatcatcagaaccttcctttgtccgcatcagaatagtctcaccagtcgcttcatcataacgacgtgtttcctgaccaatgtgtccaccagccatcaatactttttgatgccgtttttcttcaaatgcgagggccttccgaacatagttaaaggagttgatgttcttcatctctgtcttggtcccaaacttatcagaaccgattggccgaattgagatgttggtatcaacccgcatggacccttcttccatcttcacgtcagagatccccgtaaattgaatccgttgacgcaatgcttccaagtaagccactgcttcttcaggcgaggcaatatctggcttagaaacaatttcaattagcggtgttccttgccggttcaagtcaacgtatgaatacttgctggtgtgagtgttcttaccagcatcttcttcaatgtgcatttctttgataccgatctttttctttttaccatttatttcaatttcaatccaaccgtcatgagcaattggagtatctgattgagtaatctggtaggctttcgggttatcaggatagaagtagttcttccgatcaaagtgcatgtgatgggcaatttgagcatgaagagcaagtccagccatgattccgtcacgaacgacacccttgtttaagcttggcaatacaccagggtacccccagtcaatgacattggtgtttgcgttaggctggtcaccgtattcaacgggggatggactgtaaatctttgaattagtctttaattcaacgtggacttctagaccgattgttgtttgaaagttcatcttagttttgacctcctaactttggtgtcttcttgtggaaatcagttgtctgttcaaagacatatccagtgttataaactgtttgttcgtcaaatgcttttccgatgatttgcagaccaactggcatgccatttttagcagagaaaccagcaggaatagacattgcaggaaggccggccatattaacgggaacagttaatacatcgttcatgtacatggtttgtggatcatcaatttctgcaccaatcttaaatgccgttgaagcaccagtagcaccaacgattacatcatgatccttaaatacgtcttcaaaatcttgggcgataagacggcgaactttagcggccttattaaagtaagcatcatagaaaccagcagagagagagaaggtccctaacataatccgtcgcttaacttcttcaccaaaaccttccgaacgagaacgaacataaacgtcttccaggttcttaacatcagcagctcggaagccataacgaataccatcgtaacgttggaggttagaagatgcttcagatgaggctaaaatgtagtaagcaggaaccccatacttggtatgtggcaaacttacttcatcaacaattgcgccgagggattctaagtggtccaaagcagccttaattacttcttgaacatcttcgtctaagccatcaaagtattcctttggcacagcaatccgtaagcctttaacattcgtattttcgtttaattgggctgcccagtctggaacttctttaagtgaggatgtcatatcccgttcatcatttccactgatgagggcggtcaacaaggcattatccttaacattttgagtcaaccagccgacttggtcaaaacttgaaccaaaagcaatgatcccccaccgtgatacacgaccgtatgtaggcttcatcccaacgacaccgttaaaggaagcaggcatccgaatagaaccaccagtatcagtaccaagtgcacctaaaacatccccggccgcaacagcagcagcagaaccaccggaagaaccaccaggaacccgggtaagatcccatgggttatgagtcgtaaagaatgctgaattttcagtagatgaccccatagcaaattcatcaaggttagtcttaccaacgttgatgtaatcagcggcatttaacttttcaaccactgtcgcgtcatatacagggttaaagttttcaagcatcttagaagcagccgtcgttgtgaggcctttagttaagatattatccttaactgcaagcggaacccctgcagttaattgatcagcactaatgccctttgcatcaatctcagctgcccgcttcagtgcttgatcttcatttaagctgatgaaagctttaacttgatcttcattacccttaatgtggtcaaaagtttcctttgttaattcagttgcactgattttcttatttaccaagtcatcgtgcaattgactcaagcttgtttggtaaaaatccattattcgccgtcctcactttcgtcaagaattgctggaaccttgatgtagccaccatcagtttcaggagcattgttaagcaaggcttcttgttcgtctttagaactcttaattgccttatcttcacgcattacatttacccgatcggttgctgatgtcattggttcaacgccatcggtatcaaccgcttcgaggtcttcaaacatatcaataatgtttcctagttgagtggtaaacttaccaagttcatccttagggaactcaagcttagcaagttcagcaacgtgttctacttgttgctcagtgattttactggccattctctctacctcttttccagtaatttaaaatctacatatacatttaacaattttagcacagaataggttcctatttcatccatgtagaaataaaaaaaggagttatcggttcgcattttctagtaacgaatcgatattctccttttttcatctttaataagaatcaaaaatatgcgactggaagttatcagaaccagcattccggtaaacaaccgcttgaatttcggaatcagattgaatcttaatatcaatcggaatcccattaggtaggtacttctttgctgcccgggtaatatattgggtaaaactagtaatttcactttgactatagaactgagtagtaacagtaatgtgcatccccgataaagtcccattttcatattgagcttgtgctgtaactccactcaagttagggaagaaactttgaatctggctcttaaagtttgagaaactatcatcatcagtttgatcagaactattagttgttgatgcactagcctttggaaggactacattcttgtaatttaacttccgccagctactaattgtattaccactattcttactataagcaaagaatgtaccaccaactaaactatcatccggtgcttgtttgtatagtgcaatcacgattggaacatttccaacgcctgattttttccgtactcgttgaagaaccttttgtgccgcgatttcaccttgacgacgaacctcactatcactaatcttcttagttaaagttggtcctcctgtcttagtttggtagttgtattcggaatttattccaatcccaatcgtaatcccccgcaatttcatggaattaccactttcttgcatataatcttgctcttcaatttgttgaatatagactgggttaggattgctcttctttccttgagcagggtttagcccttcaggattactctttgtttttcgaccaagccagttttcaatcgtcccactactaaggtattgaccttcttggaaaatatagctttttgttgaaaagactcgttttgaaacctgggtcaaaccactttcaaagcttttaaggttatattggttatcattttgtgagacatttataccccgagctttacttgttcggtaacgaccatttttaatcacaccttgataagtaccattacttgaaccagtcgttgaatagtttttcgatgacgactttcctccaaaaccacatgatgcaagcaagacagtacacatcaaaacggcagcactaacggctattttttttgcctttcgcttcacgatttactgttcctccttcattgcttggctgaattgctgttcattccatacgtcaatacccaagtcttgagcttttgttagcttactaccagcatcagccccagcaatgacaatatctgttttctttgagacgcttccggttaccttagccccgtggttttcaagccatgattttgcttccccacgagtcatttcagttagcttaccagtcagtactactcgccgaccattccattcactatcaggattagcatttgaccgtgagccaagataagcaaagtttaccccaacttctcgtaattcgtcaattaatttaataacctgttgattagcaaaataagttacgatactttcgccaattgttggaccaattccactaatcgcagaaatttcatcggcatcggccttcattaagctatcaaggtcaccgaaatgttccatgataattcgagcagcctttgcacctacatgacgaattccaagaccaaataataagcgctcgacagaattattacgactattatcgatcgatgtcaataggttagaggtcgatttctcgccaaatttatctaaagttaataattggtcatgattaagtcgatataaaccggcaacatcatgaatcaattctttatcccatagctgttcaatgattctaggaccaagtccatcaatattcatggcattccgggaagcgaaatgtgctaagccttctttaatttgcgctggacacattggattaatacagcgtaacgcaacttcaccatcaagatgaactaattctgagccacagaccggacacttcgttggaatctcatattcaactgaatctgcagaacgtttagttggatctacttttgaaatttcaggaataatgtcacccgctttatgcaggtaaacagtatcaccaatccgaatatctttttcacgcaagtaatcaggattatgcaaagaagctcgactaactgttgtacccgccaattgaactgggtccataactgctgttggcgttacattgccggtccgaccgacagtccagacaatatcacggacaatcgttgcttgctcttcgggagggaatttataagcaatttcccagcgtggcaccttaactgtattcccaagggcaacttccgtatcaaggtcgtttactttttcaacaattccatcgatcccgtaagtgagcttgtctcgttgagctgtatattcttcaatatacttctcaatctcttcacggttatgaacaactcgattattaggattaacattaaaccctaattctcgcatacgatcaagtgcttccgcttgggtcttcacccccaacttttgatattcaggaacataatatataaatgtatctagttcacgttgcgccgttactttcggatctaattgccgcaaacttccggctgctgcattccggggattagcaaaaaccggcaatccttctgcttcgcgtttagcatttaactttgcaaaagccgctttgggcatataacattcgccccgaacctcgatcgataatggttctggcaattctgcgggaactgacttgatagttcggacattagcagtaacatcttcaccaatcgttccattgccacgcgtagaaccttgaactaactttccattctcgtaaacaagtgaaagagaaagaccatcgatttttagttcgagattatattcgggttcaacttcaacatcccgattttcctgttgtcgttggttaaagtccatcaattcttcaatcgaaaagacatcccccatcgataacatcggaatttcgtgccgaacttttgttaattggctttctgttgctcctcctactcgttgggttggcgaatcggcagagagcaattgtggaaattgttcttccagctgtactaatcgctgataagcacgatcatatacatgatcctctacagttggattgtcttgttcataatattcttttccccacttaatcaattttgctcgtaatggcttaatctcatcttgagcttcttgaagggttaattcttttactggcgtctgtttttcactcatctcatccgcctcatttcattattttcgtactttcgtaattggggcaaaacttgccaataaccgctttacaccctgacttggaaaggcaatatctaattccatatcattaccactaccgttaactttgaccactgttccttggccccactttttgtgttcaaccttatcgccagttttccagccaaccttatcggccccagttccggtgttagtaattggtttaacccgcttgccagcactgcgatatgttcgcttttgctgatcacggtaggtagtagcggttgcggcagcacgatcaaatggcagtttactatctttaatgctattacctgatgggctattttcaaactgtaacaactcagaatcaatttcttctacaaatcgtgatggttggttacgttggatacgaccataaagcaagcgtgaaaaggcattagtaagataaagctttttctttgcccgtgtaattccaacataggctaagcgacgttcttcttccaattcatcatcttccattaaagctcgcgataatgggaaaataccttcttccattcccacaaggaaaacaactggaaattcaagtcccttagctgcatgtaatgtcattaaagttacagctggtgcttgttcatcaacatcatcttgatctgagacaagggccaaatcagctaaaaagttaataattttttgcaagttaggatcatcatcgtctttatgctgctcatcatattcttgtgtaaccgacttaaattcatcaaggttttcacgacgagcttgtgcttcaaggcttcgatcatcacttagcattttgttgtagccacttaactctaaaatctgttcagttaaatcagttaatgtgagatattctgcttgtttagtcaagttagccattaattgaccaaattcatcaattttatttcgtgttcgtgcagtaatttcactagcagtatcaacattttgagctgcctttaataatgtccagccattttcattagcgaaattgcgaagatgttccacactagttaaaccaattcctcgtttgggcgtattaacaacgcgttcaaagctcattgaatcggcaggattaacgattaaggtcaaatatgctaaaatatcacgaatttcacgccggtcatagaatttatggccaccaaccatcgtatagggaatactactcttcaagaaagtttcttcaaccatccgtgattgtgcattagtccgataaagaattgcaaagtcattaaagtgatagccatgcttttcttgttcttctttaatcttcgaaacaataaactgcgcttcatcatgttcattttgcgcgcggtaatacgaaattttgtccccttgaccattttctgtccacagattcttcttttttcgataaaggttattagcaataacttcatttgccgcatttaaaattgtttgcgttgatcgatagttttgctcaagcattaccgtcttagcttggggataatcatgttcaaaattcaaaatattgttcatattagctccacgccaaccataaatactctgatctgcatcccctaccacacacaaattttggtacttttgcgctaatagattaactaaccggtattgggcatcattcgtatcctggtattcgtcaacatggatgtagtggaacttatcttgataaaattcaagcgtctcttgatcactttccaataactcaatggtcttcataatcagatcatcaaaatctaatgcttgattagtttctagctcttgttggtaaagcttatatgctcgcgcgaccatgttttcaaacatactattagcttctttgctatagtcatctggcgtcaacaaagcatttttagcattagaaatcgcacttaaaatactgcggggatcaaattttttagtatcaatatttaattctgcacaaatccgcttcattaacgtccgttgctcacttgtatcagcaatcgtaaaggcgcgattatagccaattttttcaatatcacgacggaggattcgaacacataatgcgtgaaaagtcgatacccaaatctcattagcactttcaccaagtaatttaccgacccgctctttcatttcgcgcgcagccttgttggtaaaagtaatcgctaaaatattccatggtaatacaccattttcttcaattaagtaagcaacccggtgtgtaagaacccgtgtctttcctgatccagcaccggccattactaataatggtccctctgtagttaatactgcttcggattgcttatcattcattccttctaataatgcttgcccgttattcacgctgttccatcctctctaaattttcatcggctaatattataccaaattaggatctcatttggtgctaaaatcgaacgtatgttaggaaaaataaagagactgcgatttcatccccagtccctcgtaatcttgtacgcttaatttataatttcgtgatcaagcttgttcgttccaaacttcagtatcgtcaacctgattctttaaggctgccaagttatcgccgccagttacccagacaaagcctagaattgcctgatcgtcatccccaacatcattaaagaacctaaattgccagttattctttagcaaccattgccgttgaattgctcgtgattgataattgcgaacgaccatcaataagccaatttgtaatggtgtaataacatgtaggggcattccaacagtgcttcttaattgttcttcatactggtcaacatttgctgtgacatcataaatattagcaatcgacgttaaccctggttcaatattctttacataaagagtaccagtagaagtaacataaaagttaaccgaaaataccccccgatattcaagagatgccgcaacactttttacaatccgttgcatctcttttaacatatcatcgtgaatatttgctggtgtcgcaacagaaatcaattggcgcttgtcattgtaatgaagctgagcaagtgggaaaatctctgtatcttttccatcagttgccgctgtcatagtatattcatttgtatgttcaatccacgattctagtaaatatgtacccgtatcaataaaatcagcggcgcgagtaatatcagattggcgctcaatcagcattgaattttccccaattcctcgttgaatgggttttaacaacgcaggatagccaatggaatcgattgattggtaaacatcatctaaactaaccaccgtcatatatggagcaatattaatatttacctgatctaagaaagcacgttccattaatcggtcttgaacaatctcaagagcattaatcccctgaggaatcactgcatattgactcaaaaagtgcatgacgcgagaatcgacattaggggtttgataaataattgcatcacatgcttcaccaaactgagttagttttgtccgatcgttcattgcccctacaatggtaaagtcagccattttagttactaatggctgagaacgatccacatacacaccaacgttaaagcctgccttcttcgctgttgcaataagtgctgccccattgcgattaattccaataattcctaaagtactacctgggtaaatagcatctctgcccattttatcacttcccttattagtcttttacgaattcaactttattatcactcaatgattgaattcgtgccaatgattcgacacgaattccacgttcttttagttcaccagctccaggttgaaaactcttttcaataactattcctgcacccgctacttgaacccctgcttgatcggcaatttctaataatccctctactgcttgaccattagccaagaaatcatcaatcattaaaatcttatcattagcatctacatactttttagaaattgaaatccgattggttgttttcttagtatacgaatatacatcagcagtatacatattttggttaagagtaagactcttatgcttacgagcgaaaataactgggagattcatttccaacccagtcattacagctggagcaattccggatgattcgactgtccaaatcttagtaatgccttcattagcgaaaagcttggcaaattcttgaccgatatgcaacattaattgaggatcaacttgatggtttaaaaaagcatctacttttaaaacattacccggtaaaacagtcccgtattccttaatcttttcttctaactctttcatttttgtccccctctacattactcattacttatcataattatataatttatacgccttaatcaccgaaattaatttttgtgcataatcaggatcagtcgcataacctgcttcttgcaatccccgagctgcttcttgataattagtcgcatggacaactcgatcataattttgctgattggtgtctgttccatttaacatcaagcgcgtatggtctttaatagaatcactccaactatcataaacgcggaatcgtcccttagtaacgatccacttaccattaatatattctttagttgtcattactcgtgaatttgctcccgttcccttaattccaaataaattatgatattgtgacgctaactgactcgttccccattgagattcaagaatcgcttgggcaatcgtaattgatgcatagatatgataggtattttgcattgcctgggcttcaggagcaacttgctgaataaataattgcttcgctcggcgatccttttcacgtgcctcttgttcaattcgttgctgattccagattcggtaaaaatggtgcccaacgtaaacacccaaaaagataacaataacagcaagaatgctaataatccaatttctacccgtatggcggtttttgtttctccgcttccgttttgccacaagcttagcctcctcttttctactagttattaattgtagcaaaatccatctcgtttgggttaatttatcgtaatatttttagaagaagttaaaaaagcacaactgaaaaattttttccagttgcgcttgctgctactagccttaagtattaatggaattgcattccaccatcaacaataattgtttgtccagtaacgtaatttgaatcaggaccagctaagaaacttaccacattagcaacatcctctggttcagaaagacgcttcattgcaatgttcttggcaaaggtttccattccccattcatcacttttaccagcattttgaccaacttgatgtgcaatatcatacatcatcggtgtcttaacgattcctggtgcaaaagcatttaccgtaatatcttcagttgccaaatcttgagctacgacctgcgtaatgcctcgaatagcaaattttgttccagaataaagtgcaagattaggattaccaacaacaccagcttgagatgtagcattgataattttaccaccatggccaagctccttaaatgccttgtgggcagcttgaattccccataaaaccccagcaacatttacaccatatactttttcaaattgttcaggtgtaattgaatcaattggggtagtaggacctaatccagcattattaacgattacattaagatctccaaaatgttcgactgtcttctcaacagctgcaaacacttcttctctatttgctacatcggctacaagtggtaatgcttccccaccattattagtcagttcatcaacaacttgttggagctttacctcgtttaatgctacaagagcaactgcaaagccatccttaaccaatctttctacaattgccttaccaattccttggcttgctccagttactaatgctacctttttagtcattagtaatccctcctttatattagttatcatttattataccgtatattaaattccgtttaaatataaaaaagacaccagcaaaatactgatgtctctggaagcgataatcgaaatattaacgcttactgaattgagcagccttacgagctttcttaagacctggcttacgacgttccttcatacgagggtcacgagttaagagaccagccttctttaaagcgtcacggaagtctggatcaacagcgagaagtgcacgggcgataccgtgacgtactgcacctgcttgaccagagaatccaccaccattaacgttagctaaaacgtcgtattgaccttctgttttagtaacagcaaatggttggttaacgatagcacgtaagttggcaaatggaatgtagtcttcaattgccttgccgttcatcgtaatcttacctgaacctggtactaagcgaacacgtgcggttgcatccttacgccgaccagtaccactgtattgtacttgttgagccaattccattccctccttagattaagttagtaatgtctaaaacttctgggttttgtgcagcatgtttgtggtcttcaccagcataaacatgtaacttcaaaccttgcttgtgaccaagagagttgtgtggaagcatacccttgatagcagtttccaataacttctctggttcctttgcaaggaagtcaccagcagtccgttgcttcaaaccaccagggtagtttgaatgacggtagtacatcttttgagatgctttcttaccagttaacttaacttgcgcagcgttgataacgataacgtaatcaccagtatcaacgtgtggagtaaatgttggtttgttcttaccgcgcaaaattgatgctactgcagatgctaaacgacccattgggacattcttagcatcgacaacgtaccatttgcgttcaacttcaccaggttttgcgatgtatgtcgttctcacgattaagtcctccaattttgtttttctttacatataatagtgtaccgagttattagatggaaaagaaataccaatggctagtataccttcttctagtactttcgtcaatccttttcatcatttgttccataatctacattaactaaatataaaccacttgctggagccgtcatccgtgccaatgtccgatcctttgcctcaaggactctagacacgtcatctactggccgctgattgctcccgatttctaaaagaaaagccaccattattcggacttggttatagagaaaaccattaccagtaaaatcaaagacgacttcatttcttaattcatctcgtttaatcgtgatactctcaatcgtccgaacattgctttttgcttgactccccgacgcaacaaaacttgtaaagtcatgagttccaactaaatcattagctgcttttctcatcttttctaagttaagaggatatttaaaatgagaagtatagttgcgtttaaatgggttcacaaattccccctgatcaacccggtaacgataagtcttacgatgagcactgtatcgcgcatggaaatcattatccactaattcggccttcttaattaaaatatccagtggcaaaatactattgagggcttttctcatagattcattacttaaatgatagggaatatcaaagtgcgcaacctgattaagagcatgcacccctgcgtctgttcttcctgagccgataacaggaatagcaggatttgggtgcttagcaattttatttactgcattctttaatgtttgttctactgtccgcttatttggttgaatttgaaaaccggaaaaattggttccatcataagcaaaggttattttataacgatacattgtttacttccttattaatttagaaaaatattcgaatacaaactagaccaactgtcacaatcaatagcgccaagccagcccaagcatcatttttatgccaaactaattgacgataatgagtccgtggtgcattaggatcataccctcgtgcttccattgccgttgctaattcttcagcacgcttaaacgagttgacaaacaatgggataagaatcggaactaaatgtttaatccgtgtcaaaagatttccagcgttaaaattaatcccgcgggcccgctgagctttcataattttattagtttcatccataatagttggaacaaagcgtaatgcaatggaaagcattaacgtaatctggttgacaggaactttaatcacttgtaatggtttcattaaccatgccaaggcatctgcaatttgaaaagtttgcgtagtggcagttaagacagttgaggcagtaataatcaaaataaaccgataaaaaataattaatgaattaataaggccgtcacgggttattgccataattccccaatgccaatacgtctttccgccactactaaataaaatttgaaacgctactgttatcaaaataattaaaaataacggcttaatcccttgccaatattgtcttaaaccaacattacttaacttaattgccgcaaggagcgctaataaaagccatatagcagctaaaaaattattcacgaagaaaattaaaataacgtaaataatacacatgattagttttattcgtggatcaagacgatggaggatcgattttactggtacataactaccaaatacgattttactattcattttctttttctcctcatcgcttctgctatttcatctgctaacacatcaagcgtaagcggttctgtattttttaaggttatcccatctttactaaggaattgcgcaacctcgacggaaacaggcaaagtcaatgatagtttttttaatcgttgagcatccctaaataattgctgaggagtagtatccgcaacaatctgcccattgctcattgcaattacgtggttagcataataggccacctgctccatttggtgagtaaccattataatcgttgttcccttctcgttaagatctttaataagtttaagtaaatcattagttgcttgagtatccagtcctgctgttggttcatcaagaattaaaatttggggatccattgctaaaacgccagcaatcgctactcgcctcatttgtcctccagaaagtgcgaaaggggagtgtgactttaattctaagggcaaatccaccatttttaatgcttcatcaactgctttttcaattttttttgcaggccaccctaaattatgaggcccaaaagcaatatcctccgcaactgtttctgcaaatagttgctgttcaggaaattggaatacaaaaccgacttgatggtggattttacttaaatattcagtttttgtcgttgcattaatttctaaacctgctacattaagttccccactactgggctttattaatccatcaattaatgaaaccaatgtcgactttccacttccggtttgtccaataatagcaacaaattcttgctctttaattgttaatgagacattatgtaaggcttcattagtagaattaggatatgtatagtggagtttttttactgtaattgctgctttagccaattttttagctcctctaaatttaaatatctatttggaacattaattcctcgttcaaccaataatttctgcagttgctggcttgcgggaattcctactccaatttcaagtaataattctttatctttaaggatttccgatggagcaccttgttttacaacttgcgaatcatttaatacaactattttgtctgctaattcaatttctttaagatcatgtgtaattgaaataattgaaagattatattctttttttaatttttgtaataaagctaaaatttcttgtcgtgctaaaggatcaagcatactagtggcctcatcaaggattattatcttaggcattaatgcaaggattcctgcaagtgctacccgttgcttttgtcctcctgagagattaataggagctgtgtttttataatcactcattcctaccatctttaaggctttatcaatcttttcctccattttatttcgatctacttgtcggttttcaagtccgaatgcaacatcgtcagcaacggttgctcctacaaactgattttcagggttttgaaaaacgaatccaatatgctggtgaatcttgcctaaagaactttcgttaacttgtatttcgtcaacttcaatcgatcctgcagtaggactaagcaatccatcaattaatcgggctaatgtactctttccactaccattatgaccaataatcgctgtccaagaaactggttcaaaatccagattgatattttttaaaacggggtatttactgtctggatatgtaaatacaagttttcgaatctttattccagtcacagtatttcctcttttcaatattagttaataagtatattttagcaaagtccacagaattatctatcaaaattaaatttaaaataaaaaatcacttaccattgaagtgcacgagggtttcccgcattcaagctagactagggtttccccaccatcgtaacgctctatactatcaatgatagtgattctttattacgtatttaatttatgtgaacaaatcaattagtccactaattcaagaataaccattggtgcaccgtcaccacgacgaggcatagtcttcaagatgcgtgtgtaaccaccgttacgatctgcatactttggagcaagttcttcaaaaaggttttgaagagcagattgtacacgaatatcatcgccatcttccttaacatcagcaacaacattacgtacaaaagcggcagccttacgacgagaagctaaatcaccatgcttagcaagtgtaatcatcttatcagcggtcttacgaacttccttagcacgtgcttcagtagtggtaatacgaccattaacgattaaatctgtggttaaatcacgtaataaagccttacgttgtgaacttgtacgtcctaatttacggtaactcataaagtggttccctcctttgcaattggtatactaattagtcgtcttggcgaaatgaaacaccaagatcatttaatttaagtttaatttcttctaacgacttttgtcctaagttccgaaccttcatcatatcagacactgttctatcagttaattccttaacagtattgataccagctcgcttcaaacaattgtaagaacgtacagagagatcaagctcttcaatagtcatttcaagcatcttctctttgtgtgtttcttctttttcaaccatcacttgagcattttgagccgtttctgttaaatcaacaaacatagctaagtgttcagtcaaaatcttcgcacctagactaactgcttcagttggtgttaatgaaccatcagtccaaacatccagcgtcaacttatcataatcgttacgttgaccaacccgtgcattttcaacagtgtaatttacacgttcaattggggtatagatggaatcaatcggtaaaacaccaattgctaaatcatccatccgggccttattatcgttagcagaaaggtaaccgcgacccttatcagcagttaacttgatgtgtaattctgcgccatcagcaacagttgcaatatgcagatcaggatttaagattgtaacttcattatcaccctggatatcacttgcagttacttcagcaggtcctttaacatctaattcaagattcttttgatcctcagaatcaagcttcaaagaaactttcttaagatttaggataatctgcgtaacatcctcagttacaccttcaacagtgctaaattcatgtaaaacaccatcaatttgcatactcgtaatcgctgcacctggtaaagatgcaattaatacacgccttaacgagttaccgagagtggttccataaccgcgctcaagtggttctacgacaaacttaccgtagttatctgtttcttcaactttgtgaatatttggcttttcaaattcgatcattctatccttgtacccctttcaaaacgtggttcgtatttgagacaaaaaggcaattgatggaaataattgtctccagcaatgtcaattaaacacgacgacgctttggaggacgagaaccattgtgaggaacaggtgttacatcacgaatagcagtaacttccaatccagttgcttgaagtgcacggatagcagcttcacgacctgaacctggacccttaacttcaacttcaacagtcttcataccatgttccatagcttgcttagcagcagcttctgatgccatttgagcagcaaatggagtggacttccgacttcccttaaagcctaaaacaccagctgaagaccatgctacagcgttaccttgaacgtcagtaatcatgatcaatgtgttgttaaatgttgagtgaatgtgcgcaacaccagtttcaacattcttttttgcacgacgcttacgcgtaccttttttggttgccatatctagtactaacctccttttttataaagttaaactacttcttcttattagcgatagctacagccttacccttacgagtacgagcattgttcttagtgtgttgaccacgaacaggtaggccacgacggtgacgcataccacggtatgatccaatttcttgaagacgcttgatattcattgaaacttcacgccgtaaatcaccttcaacttgaatttgatctacttgtgcacgaatcttttcttcttgatctggagttaaatcacgaacacggatgtcttctgatacaccagcattttcaagaatcttcttagcagtagaatcaccaataccaaaaatatatgttaagccgactacgattcgcttgtcacgaggtaaatcgacacctgcaatacgagccatgagctacacctccatttctctataaaataaattacttaccttgacgttgcttatgctttgggttagcagagcaaataaccataacacgaccgttacgcttaacgatcttgcagtgctcacacatctttttaacagatggtcttactttcattctaaaatcctcctattgagagtaattgatcaataactacttgaaccggaaagtaatccgaccctttgtaaggtcatatggagacatttctactttaacacgatcccccggtaaaattttaatgtagtgcatccgaattttaccagaaacatgtgctaaaatttctgctccgttttccaattcaactttaaacattgcattaggcaaagtttcagttactttaccttctacttcaattacatcggcttttgccacgaaatagtacctccttgcctattctagatattacgtaaaaatggtggaaagtataaaacttcccactactcagatagataaaccttgcatagtttagcatatgtttacaaacttcgcaagagataactattatctagtttaggtttgttaatactttcttgatatcttcgtaaactttatcgatatcttgttcaccattaatttcgtgcaaaacacctttcttttggtaatagtctaccagtggtgtgttcaacttaatattaacatctagacgattcttaaccgtttcaggcttatcatcatcacgctgataaaattcatgatgaccacaaacgtcacatgtgccttcaactttaggaacattgtaaagcttatgatacgttgttccacagttacggcaaataaaacgtccacttaaacgttctaccaatacatccggttcgacgtgaatattgatcacagcatcaagatgccgattactctctgctaacatcttatccaaagctgctgcttggttaagattacgaggaaatccatccagcataaagccatctttagtatcatcttgagctaaccgttccttaacgataccgttagtaacttcgtccggaacaagttcacctttatcaatatatttcttagcttcaattcccatgggagtttcattttttatggctgcccgaaaaatatctccagttgagatatgaggaattggaaaatcttcaacgatcttttgagcttgagtacctttaccggcacctggaagacccattaatacaagattcatactcattagtcatttcctcctttaggttctcgaataaatccaatatattcgcgcttcattgttagtccgtttaactgccgaacaacatctaaagcaatttgtacgataatcagtaagcttgtaccacctaaaccaattgactgacttaggttccatacgttacttgcaattaacggaattaaggagatcaatcctaagaataatgaacctactgtactcaatcgcattaacaatgaagaaatatagtcttgtgtaccctttccaggacgcactccagaaatataacttccttgcttttgcaaattctcagcaagtttttctgggttaacctgaacaaaggcatagaaaaaggtaaatacaacaatcaaaaatacatacagtgcgatcccaggaccagattgcatgttaaaaatggtcgtcatgatttgataccaactatccccaccatggttttgctggaaagccataagaatagtttgcggggttgagataaaagaaccagcaaaaataacaggaataacacctgatacgttaatcttcaagggaagataactactggatggtgaagtagtggttcgtcttgtgtattgaattggtagacgtctttctgcctgttgtacccatgtcacaaacgctacaataattaaaattgcaacaataacaagagtaacaaatccaattcccatccacaaagcagaaccagattcaccagcaatttggtcatcccataactgacgaattccacctggcatttgcgcaacaataccagcaaaaattaacatggaaacaccattacccaagccacgttcagtaatcatgtctcccatccaagtagcaaacattgtacctgcagttaaaattaaaccgattgttaaatacgtttgaacaccaggatgattaaccaaacgaatagtactcaatgcattaaacccggcggtaataccgattgattggataaatccaagtacaatcgttaaccatcgggttgcttgattaagttttcgccgtcctacttctccttgtttactccattcaacaaaacgcggaacaatatccatttgtaatagttgaacaacaatttgcgcagtaatatatggagaaactcccattgcaaataaagagtaattctccaatccaccaccactaaaggtattgaggattgatgctaaaccggttgaggagatttcctgcaaagcagcagcgttaactccaggaacggtaatcgctgccccaatccgatagacaatcaatacaaacaatgtaaagaaaatctttttacggatatcttttaccttgaatgtatttttgacggctgtgaacaaactacatcacctcagttttaccaccagcagcttcaattgcagaaactgcagaagcagaaaacttattagccttaacagttaatttcttttcaagcttaccgttaccaagaatcttgatgccgctcttcaagttcttaactaagccactttccatcaataattgtggagtaacttctgtaccatcatcaaacttgtttaatgatgccaagttaacaattgcgtattctttccggttaatgttggtaaatccgcgctttggaatttgccggtaaagtggcatttgacccccttcaaatcctaaacgggtctttccatgagccttttgccctttagtaccacgtccagatgtaaaaccgtgtcctgatgaaagtccacgacccttacgaagacgcttagaacgagaaccagcagctggcttcaattcgtttaacttcattagtaggcacctccttattatttaattttaattacttaacttcttcaacagaaaccaagtgagcgatcttaaaaatttgaccgcgtgttgccgcattatctggtaagataactgagctattgatcttacctaatcccaatgccttaacagtacgacgttgagtaggttgtcggtgggcaacactgtgaattaaggtaacttttacttgagccataatttagtgccctccttattctgctaagtggtctactgaaacaccacgtaactttgcaacttcttcagcgttctttaattgcttcaaaccttcaaatgttgcacgaacaacattaacaggtgtgttagagccaaggcgtttagaagtaacgtccgcaacaccggcaaggtccataacattacgaaccgcaccaccggcagcaactccagaaccttcaacagctggctttaacatgatctttccaccgccgtatacaccaataacttcgtgtggaatagtagttccaacgataggaacagtaatcaagttcttttcagcagctgcttgagctttacgaatagcttctggaacttcttgagccttaccagtaccaaaaccaacatgacctttacggtcaccaacaattactaaagcagcgaaacgcatacgacgcccaccttttacaaccttagtaatccggttgatggctacaacttgatcgtctaaatccaactttgttggatcaatgaattctgatgatgccattgcaggttattcctcctttttttagaatttaagtccgttttcacgagcagcttcagccaaggcttgaacacgtccatggtaaaggtatccaccacgatcaaacacaacttcagtaatgttcttttcgttagcgcgtttagcaattaatgctcctacaccactagcttgttcagtcttagtctttccacttacttcactatcatttgtggaggcacttgcgagcgtcacaccctttacgtcatcaattaattgagcgtaaatgtttttgtttgaacggtaaacacttaagcgtgggcgctccgcagtaccagaaatcttaccgcgaacgcgtaaatgacgacgttgacggatcttgttcttgtctggtttagaaatcacaacagtcacctcttattatattaattatattaaataaaagaatgttaaataatcttctcagattacttaccagtcttaccttccttacggataatgtgttcgttttcgtaacgaatacccttacctttgtatggttcaggtgaacgtacagcacgaacttcagcagcaaaattaccaaggtgttccttgttaattgagcttaattcgatagtagtattgtcaggtacgttaatttcaacatcttctggcttatccatttcaactgggtttgagtaaccaacagttaaaatcaacttgttacctttgagttgagcacggtaaccaacaccaacaagcttaagaaccttcttgtaaccattaacaacaccttcaaccatgttgttaacattagcacgagtagttccgtgtaacatctttaacttattagtatcagcatcacgatcaaactttacaacgttaccatcaatagtcattttgattaatggtgaaatttcacgagataaagtacctttaggacctttaacagtaactacattaccatcttgagaaatttcaacaccacttggcaaatcaatttctttgtaaccaatacgactcatctttgcacctcctatctaatattcgttttttaccaaacgtaagcgataacttcgccaccaattttcttggcacgagcaactttatcagtaacaacaccttcagatgttgaaatgatagcaatacctaatccattaagaaccttaggcacagcatctgacttaacgtatgtacgtaaaccaggcttagaaatgcgctttaagccagaaataacacgttgaccgtcattaccgtactttaagaacacacggatgatgccttgcttgttatcatcaacgtattcaacatcgcgaatgaaaccttcgttttttaagatttcagcgatgtccttcttcatctttgatgcaggtgcttctactgattcgtgttgagccatgttagcattacgaatacgagttaagaaatctgcaattggatcactcatagacatcgatgttttcctccttttgtcggtttttttgtttaccagctagccttcttcaaaccaggaatttgtcctttgtgggcaagttctcgtaagcaaatccggcataggtggaatttacggtaaacagagtgcggacgtccacaacgtgcacaacgcgtgtattcacgacttgagaacttagctggacggttgcacttagcaatcattgattttttagccaatttgtggaacctcctttatttagcaaacggcataccgagttgagcaagtaattcgcgggattcttcgtcagtttgtgcagttgttacaataacaacatctaaaccacgaactcggttaactttatcataatcaatttctgggaaaattaattgttcatggataccaagagtgtaattaccacgaccatcaaatgccttgttacttacaccatggaaatcacgaactcgtggcaatgccacattaactaatttatctaagaaatcatacatacgttcaccacgcaaggttaccttagcaccaattgacataccttcacgaagacggaaaccagcaattgatttcttagccttagtaattaaaggcttttgaccagaaatcaagccaagttcttcaacagcttcatcaagattcttggagttagtagttgcatcaccaacacccatgtttaaaacgattttgtcaatctttggtgcttgcataactgaagagtagttaaacttttcaattaatgctggacgaatttcattttcgtatttagctttcaaacggttttccattagaagttattcctcccttccttaaaaattagtcaagtgtcttacctgacttcttcgcaacacgaaccttcttaccatcaacgaacttgtaacctacacgagttggttcatttgttgaaggatcaatcagcattacgtttgaagcattaattgcagcttctgtatcaataacgccaccattagggtttgagttgcttggtttttggtgtttcttaacgatatttacaccttcaacgataacgcggttttgagaagcaagtacctttttaatagtaccttctttgcctttatccttaccagcgattacgcgaaccttatcacctgttttaatgaacatgttgattgtgcacctccttattttcggtaaaatctttagagaacttctggagctaatgaaacgatcttcatgaagtcgtctccacgaagctcacgagcgattgggccaaaaatacgggtacccttagggctcttgtcgttgttaattaaaacagcggcattttcatcaaacttaatgtatgaaccatccttacggtgaataccatgtttagtccgtacaacaacggccttaacaacgtcaccctttttgacaacgccacctggtgttgcctgctttacagtagcaacaatgatgtcaccaatattacctgttttaactcgggaaccacctaaaatcttaataactaagatttcacgagcaccggagttatcagcgaccttcaaccgactttcttgttgaatcacggttaatgtcctccttccatttacaaataagaattagaatacgaataatttttagagttatctgctaaattaaagggtagcagctttttcgacaatctttacaagacggaaacgcttcttagctgataatggccgagtttccataatttgtacagtgtcgccggtcttagcttcgttgttttcatcgtgagcatagtacttctttgagtacttaacacgcttaccatagataggcgcactcttgtaagtatcaattacaacagtgatagtcttatccattttatcagaaacaacgtggccttggtaaaccttacgtgcattacgttcttcactcatgcgctaatcctccttttcgtattcttatttgtttaattcttgttgacgaagaactgtcttaacccgtgcaatatctttgcgtacttgcttaagacttgcagtattttccaactggccggttgctaattggaaacgtaagttaaacaattgttccttcagttccttttcacggtcaagtagcttatcagtggttaatccattcagttcttgtacataatctttacttttcattagattgtccacctacttcctcacgttgtacgatcttagtgcgaactggcaacttgtgaccggcaagacgtaaagcttcacgagcgacttcttcagaaacgccccctacttcaaacattaccttgccacgttttactggagcaacccatccttcaggagcacctttaccgttacccatccggaccccaacacctttactagtgtatgagagttgtgggaagattttaatccaaactttcccaccacgcttcatgtaacgcgtcatagcgatacgagcagcttcaatttgacggttgctaatccaatgtgaatcaagagcttgtaaaccaaattcaccaaaagtaacagttttaccacccttagcttcaccgcgcatatgaccacgttgaaccttacggtgctttacacgttttggtactaacatgtgttacttccctccttgttcatcattgtttgagttcttcttagtaggaagtacttcaccacggtaaatccaagtctttacaccaagaacaccgtatgtagtgttagcttcgtcccaagaataatcgatatcagcacggagtgtatgcaatggaacagtaccatctgagtatgattcgatccgtgacatatctgcaccgttcaaacgaccagcaacttgagtcttaatacccttagccccagcacgcatagcacgttgcatagccccacgcatagcacgacggaaagcaatacgagcttctaattgccgtgcaatactctcaccaacaaggtgagcatctaaatctggcttcttgatttccacaatgttaatgtgaacacgtttaccagttaatttgttaagttctttacgaagtgcttcaacttctgaaccacctttaccaataaccattcctggcttggcagtatgaattgatacgtttacgcggttagctgcacgttcaatttcaacggttgatacagaggcatcagcaagtcgcttttcaatatacttacggattcgaaggtcttcgttaaggtaatcagcaaagtccttgtcagcgtaccactttgcagtccaatcacgaatgaccccaacacgaaaaccattaggattgatcttttgacccactattcattcctcctatcgttctgtaacaaccactgtaatatgactagtccgcttgttaattggagaagcagaaccctttgcacgaggacggaaccgtttaagagttggtccttcgttagcaaaggcttcacttacaaccaatgaagcacgatctaagtcgaaattgttttcagcgtttgcaacagcagattttaatactttttcaacatctgaagcggcaccacgaggggtgaacttcaaaatagcaaatgcttcggcaacactcttgccacgaatggcatctaatacaagacgaaccttacgagcagaaacccgtaccatcttggcagtagccttagctgacgtaatgttttcagccatatgttatttcaccctccttacttacctgtcttcttgtcatcagaagcatgaccatggaaagtccgagtaggaacaaattcacctaacttgtgaccaaccatgtcttcttgtacgtaaactggcacgtgcttccgaccatcatatactgcaaatgtgtaaccaataaaacttgggaaaatggtagaacgacgtgaccatgtcttgatgacagtcttcttttcagaaccttcttgctccttaaccttcttcagtaatgaagcatcagcgaaaggtccttttttcaaactacgacccatttagtgtacctcctctcgggtattagaacgtatataaatattaacgagtatgtggaccgcgcttccgaccacgaacaatgaacttgtttgaacgagctttgtgtgaacgggtcttcttaccaacagtcttcttaccccatggagaaagaggagatggtaaaccaactggttgcttaccttcaccaccaccatgtgggtgatcgttagggttcataacagaaccacgaacgtgtggacgttgaccagcataacgagtacgaccagccttacctttaataatcaaggcgtgttcatcattaccaacagtaccgatagtagcacggcaagtagcaaggaccatacgaacttcaccagaagaaagacgtactaatacgtatttttcttccttaccaagtaattgagctgaggcaccagctgaacgagcaagttgaccacctttacctggttttaattcaatattgtgaataacagtaccaactggaatgttctttaaaggaagagcattaccaaccttgatatcagcatcaggaccagattgaacggtcatgccaaccttcaagcccttaggtgcaatgatgtatgatttagtaccatcagcgtaaacaagtaaagcaatatttgcagtacgatttggatcgtattcaattgccttaacagttgctggaacatcatctttaattcgcttaaagtcaataatacggtattgacgctttgtaccaccaccacggtgacgaacagtaatatgaccatagctgttacgaccagcagtgtgctttaacggagccaataatgacttttcaggtgttgtcttcgtgatttcagcgaagtcgtaaccgttcatattacggcgaccgttagtggttgctttatatttacgaattcccactgttttttcctcctttttttaatgattagttttcgttgttgtcgttaaacaacttaatttcatttgagtcggcagataaagtaacaatagccttacgacgacgcttagtgtatccttcgtaacgaccttggcgctttaacttaccttttacattcataatgttaacttttacaactttaacgccaaaaatttcttcaacagcatttttaacttgtgtcttagttgctcgtaaatcaacatcaaaagtgtaacgcttgttgtccataccagccattgaagcttcagtaactactggacgtaaaataatgtcgcgtgcttccattatgcgagcacctcctctacttgagaaagagctgacttagtgataacaatcttttggttatcaacaacgttcaagatgttaacacctgctggagtaacaactgtagcattagctaagttacgtgctgataaagcagcattcttgtcgtcatcagtaacaacaactaatgtcttttcagcaacgtttaagttacccataacatcagcgaattcctttgtctttggtgcatcaaagtttaatgcatcaactactacaaagctgttatcaagaaccttttgggaaagggcagacttgattgcaagttgacgaaccttacgaggaaggctgtacttatatgaacgtggagtaggtccaaaaacaataccaccaccacggaattgtggagaacggatagaaccttgacgagcacgaccagtacccttttgacgccatggcttcttaccaccaccgctaactgcagaacgattctttacagcatgtgtaccttgacgtaatgaagcacgttgacgcaaaattgcatcaaatacaacattttcatttggttcaacaccaaatactgcatcgtttaattcaacagtaccgttttggctaccatcttgtttatataaattaacgctagtcattatttacttcctcctttcttcttatttattgtgttgtttgctaagactcttcttagtattagccttaactgagttcttaatagttacgtaagacttgtttgcaccaggaacattacccttgatgagtaatacgttgttgtcaagatcaaccttaacaacttgtaagtgttgcatggtaacagtcttgccacccatacgaccagggagcttcatacctttgaaaacccggttgataatggcacccaatgaaccaggacgacggtggtaacgagaaccgtgtgccataggtccacgagattggttatccttatggatgttaccttggtaaccatgacccttggtagtacccgtaacgtcgacagtttcaccttctgcgaaaacgtcagccttaacttcgtctccgactttaatgtcccctaattcagcgtcgcggatttcaccgatgaagcgcttaggggtcgtgtttgcttttgctgcatgaccttgttcaggcttgttgctcaaaacttcccgcttgtcatcaaaaccaagttgtacagcactgtaaccatcgttttcaacggtcttaatttgcattacaacgtttggtgtaacatcgataacagtaactggaactaattcaccattgtcagtgaatacttgagtcattccaacctttttacctaagattcctttggtcatgagtacacctccaattttatgttttatgtattattcttattctaataattaaagcttaatttcaatatcaacaccactaggaagatcgagcttcattaatgaatcaacggtcttaggtgttgggtcaacaatatcgattaaacgcttgtgtgtgcgcatttcgaactgctcccgtgacttcttaaatttgtgtggtgaacggataacagtatagatagtccgttcagttggtaatggaataggacctgaaatttgagcacctgtccgcttagcggtttcaacaatcttatcagcagattgatctaaaatacggtgttcataagcctttaaccgaatacgaatcttttgttttgccattatgttccctccttcgtcagatttgaaatttgactagctccgcggaaattaccgccacatcctgtggcaaagcggccgggtgtgtcgcaaccttccgcatcaacgcttcgcagctttcacttaatagggggtaaggcaaatctacctccaaagctcaagcacttatccataatactaaagaaacgtaattagatcaagggaaattttcgaatattttcaattgaaatatttttgtaaaattttcttcctaagttagttaaaaattagcgatactaaaataccattaatttttctgatgtattaaaaagtaatttatttgttttgacgaaattcattaaaatgctttttgaatttttatcatcaaacaaaaaagaactacagtaatcaaactgtagctctttgatggacttgagatcacaatgtcaataattagttattgccaccgtttttcttaataatatcttcttgaacagacttaggaacagctgagtagtgatcgaaagtcatagtgaaggtaccacgaccttgtgttgctgaacgcaatgcagtagcgtatccaaacatttcagaaagtggaacaaatgagtggattaattgagcattaccacgttcttccataccatcaatggtaccacgacgagctgttacttgacccataacatcacccatgttgtcttgtggtacaacaatgtcaaccttcataattggttcaaggataacaggatctgctttcttagcagcattcttaagtgctaatgatgcagcaaccttaaaggcggcttcactagagtcgacttcgtggtaactaccatcataaagtttagcatgcatgtcaacaagtgggtaacctgcaagaacaccattttgcatagcttcctttaatccttgttcaacagcagggataaattcacgaggaacaacaccaccaacgatggcatcttcaaattcgaatccttccccttctttaagtggtgtaaattcgatccatacatcaccgtattgacctttaccaccagattgacgaacaaacttaccttgagcacttgcagtcttagtaaatgcttcacggtatgaaacttgtggcttaccaacagtaacttcagcgtggaattcccgacgaagacgttcaacaataatgtccaagtgaagctcacccataccagcaattaaagtttcaccagtttcaggattagtttcagccttgaatgttgggtcttcttcagcaagcttttgaagacccttgtccatcttatcttggtccgccttagacttaggttctacagaaacttggataacaggttctgggaagtccattgattcaagttgaagtggatggtcaggatcagttaatgaatcaccagtagtagtgttcttcaaaccaatagcagcagcaatatcaccagagaatacttctggaatttcttgttgttggttagagtgcatttgaagcaaacgaccgatacgttcacgcttgtccttagtagcattaagaacgtatgaacctgattgaagtgaaccagtgtaaacacgtaagaatgtcaaacgaccaacgaatgggtcagtagcaatcttaaatgctaaggcagcaaatggcttatcatcaccagctgttaattcaatttcatttccatcagcatcatgagcaacgaatggcttaacatcaagtggtgatggaagataatcaataacagcatcaagcatcatttgaatacctttatccttgtaagctgaaccagctaatacagggaaaatttgttcttccaaagtacctttacgaatagctgctttgatttcatcaacagaaatttcttcaccttcaaggtacttttccattaagttatcgtcaatatcagctaatgtttcaaccatttcgtcatgacgcttttgagcttcttccttcatatcatcaggaatctcaacagtatcccagttagtaccgagcttatcttcgtcataaacataggcaaccatcttaacaaggtcaactaaaccgataaagtcatcttcagcaccaattggcatttgaataggaagaggagtaacattcaaacggtctttaatagtttgaactgagtaatcaaagttagccccaatcttatccatcttgttcgcaaaaacgatccgtggaacgttaaattggtcagcttgacgccaaacagtttctgtttgtggttcaacaccagcttgagcatcaagaactgttacagcaccatcaagaacacgtaatgcacgttcaacttcgacagtaaagtccacgtgtcctggagtatcaatgatgttgatccggttatctttccaaacagcagtagtagctgctgacgtgatagtaataccacgttccttttcttcatccatccagtccatttgtgaagcaccatcatgggtttcaccaattttgtgaatcttaccagtgtaatatagaatccgctcagttgcagtcgtcttaccggcatcaatatgtgccatgataccgatgttacgagtcttagcaagtgggtattcacgtttattagccatcttaaaagagtatctccttccgaaatatggttatccttattttaccattattttcaaaaaggggtgacgtaatcgatgtttgaacgtcacccccttcactgaaactagttaaataaccagaatcaaatgacagtgattattaccagcggtagtgtgcgaatgcacggttggcttctgccatacggtgcgtatcttcacgctttttaactgaagctccagtattgtttgaagcatcgatgatttcacgtgcaagacgttcaaccattgtatgttcaccgcgcaaacgtgcgtattgaacaatccaacgaagacctaatgtagtacgacggtctggacgaacttcaatcggaacttggtagttagaaccaccaacacgacgagccttaacttccaagacaggcataacattttccattgcttgttggaatacttcaactggatcattaccagtttcgttcttaatttcatcaaaagcagcgtataaaatcttagtagcagttccacgcttaccatcaatcattaagtgatcaattaagctagtaaccaactttgagttgtacattggatctggtaaaatttcacgcttttgtacatgtcctttacgtggcattacttaactcctccttaaaattacttcttatccttaggcttcttagcaccgtacttagaacgtgattgcatacggccttcaacaccagcagtatctagagtaccacggatgatgtggtaacgaaccccaggtaaatccttaacacgaccaccacgaattaaaacaactgagtgttcttggaggttgtgtccaataccaggaatgtaagcagtaacttcgattaagtttgaaagacgtacacgggcgtacttccgtaaagctgagttaggcttcttaggagtcatagtacccacacgagtagcaactccacgcttttgtggtgatggagtcttaatttcttctttcttgaaagtgttgtaaacataaccaagagctggtgactttgacttgcccttgtggctcttacggcctttacgtaccaattggttaatggttggcattattttttccccttccttaatttaagtccacacatccaggcggttcttttttatggataaaaaaagtcctgtatgtatttatacaatttttgtgccttcgttgacgcatctgcccaacgacagacactccgttgctaaaaaagcaccttaaatagactatcatgctcacaaatgaatgtcaacgtatccttatcgatttcttttaaatcgttaatttaaaagtgaatttcattaaaaattacgtatttatttattgggaggtttttcatgttagttttattatttttatttggtgcttctgtcgcttcatttattacttcttgttgctatcgtctaggcaataattgctctttaatcattcctcagcggtcatattgtgacaattgccattctattttgcgatggtggcatctcatccctatttttagttttatcatccttcgcggtcaatgcttttattgtaaacaaaaaattagtttatatctgcctgtaattgaattcttatccgggattgcttttatcactttcatcagctatgaacctattcatgacttaatcattcttctctttctcactagcttaatcttcttaacttctactgatttttttagtcatgtaatctattcctattcactattgggactatttcctatttccttattatccattccacaaaattatttttacaatttgatttttgcctgtattctagcagtcagtttactattgttcactatttttactaagacactaggaattggtgatattgaatttttatttgtaatatgtctgatatggggatggtaccaaacactcataattatccaatggagttctttaatcatgctattcatctttttgtttacaagaaaaaagaaactaccatttatccccgcactagctttcactactattctgtgtcttcttatacaaggctgttaaaaaataaaagaccaggataccctagtcttttacaatatttaattagtatcatcttttactggtttgagttttactacaaataagttttgcccaaattgagcgaggttttcaatattttgtagtaataagagcaaccaagaaaaagctaagccaaattcaaataattcgaatgcagttaaagaaagataatcagttaacttaaaaacaatatattcgatactcattgcggctccaatcgtataagaaatcaccaaaaattgtttagtgacttcgggtagaacccacctaataactacaatcagaattagcataatataaacaagccacattgaaattctgtcatgtaaaacgtgaaattctggattattgggaaaaagaccaatagaagcaatacagatagctagcataattaacagccaccgcaatacttgaattttataaccatgataccgacgttgaatatttacaaacaagtaatcaactaaagcaatcattagtaatccagtaaaaatcaaagttatattaaattgcaaactggtggaattttttgccgttcctaaaaaactaaaattataacgccaccaatctcgtttagaattcgtcagcattgaaaaaagcattccaccaatgatcattattgttaataaattggtgataactcccgatgataatgttaaagccaagttaatcataatataatttattgccgcaataattacaaatacaaaagcagttgctgtataaatatcaaaccgtgcatccttaaacatctggccaaataaccaaaaaattgccgatagtgagaatgcaatgattagtccacatgcaatcgtaattgttggcaaactccgccaatgaaaatccttgctgggcccttttccgagaattttagtaataataaaagttatcaaaaacgataggattccactacatactcctaagattaatgcaccattagcaatggaataatcatcacctgttatcgggaccgtgttaatttttctggcgctaaaaaaagctaaaaatattgcagctaaaataattgaaggaatcacataccagaaaatgttaattttaggtagttgatcactcacatttattggacggatgttaatttgtttatgattaacactaagagagagctcttcgttcgtagagaagtctgtctttttaaatgctgagtcaggaatttctatctgatatttttttgccaagtaatcacctcattttaaactaaaaaggcaatggccccttcacaggttaaccattgccttttttataaattagttttgcttatcttcttcttttaacttagcctcaatatctttaattgagtaagcagctacactaacttcttttggcttgatgttccggtaagcactcataccagtacctgcaggaataatcttaccaataataacattttctttcaatccaaccaacggatcgttcttaccacgaatagcagcatcggttaatacacgtgtagtttcttggaatgaagcagcggacaagaaactgtttgtctctaaggcagccttagtaataccaagaataacaggacgagctgttgcaggaatatttccagcaactaaggtatccttgttagcgtcacggaattgactgatatccatcaattgacccggtagaaggtcggtatcacctggatccatgacacgaactttccgcatcatttgacgaatcataatttcaacgtgcttatctaacaagtcaataccctgcatccggtaaacaccttgaacttgcgataagaggtaagtttcagtagaaagaacatcacaaacctggattaattccttaggatcaatcgaaccttcatttagcggtgcccacggtgaatgaaatcaccttcagcaactttcatccgtgctgtaattggaagggtgtaagttcgggtatcagtctcacccttaatcgtaatatccttcgtccattcagcaggattttcttcgatagacacaacttcaccagtaacctctgtaattgttgcccgacctttaggattacgtgcttcaacaatttcttggatacgtggaagaccttgagtaatatcatcgttaccagcaaccccaccagtgtggaagttacgaagggttaactgagtacctggttcaccaattgattgagcggcaacagttccgacagcttcaccagcttctacacggtcaccagtagctgcatttcgtccataacaacgttcacatacaccatgttcagtgttacaagtaaatgctgaccgaatagttactttctttacgccggcatcaacaatcttttgagccatttcttcgtcgataaggacattcttaccaacaatcttttcaccagtcttaggatcaaagacagacttcatagtgtaacggcccatgattcgatcataaagtggttcaatcatttcgttaccgtttgtaatagcagtaacttcaagtccgcgatcagtaccacagtctttttcacgaacaaccacatcttgcgcaacatcaaccagacgacgagttaagtaacctgagttggcagtcttcaaggctgtatcagtcatacctttacgagcaccgtgtgatgaaataaacatttccaacactgaaagtccttcatagaagtttgacttaacaggtaattccataatcttaccgtttggtgatgccatcaatccacgcattccggctaactgagtaaagtttgaaatgttacccgcgcaccagagtcggacatcatgttaattgggttatggatatccatgtgttcaattaacttgttttgaacttcatccttagcatcgttccatgcaccgattactcgttcataacgttcatcgtctgtaattaaacctcgacggaattgcttagtaattaaagcaacttgcttttgtgccttatcaagaatttctggtttttctggtaaatcatgaatatcagacatagcagtcgttagaccagaaatagttgattcgtagtaacctaagtccttaatacgatccaagaattgagaagtcttcgtaactttgtaacgcttgtatacttcagcgatcaagtcagataagaagcccttcttaaatggtggaactaatggtgcattttcaaggtattcatgaatatcttgaccaggttcaaggaagaaacgatcatcaacaccattttgaatatttgcatctgttggttcgttaatgtaagcaaaatcttttggcataattcggttgaaaagaagcttaccaacagttgtcaccatgatcttgcctcgttgttcatcagtaaatggcttttcagggaatgcagatacttgaactccaacacgggtttgtaatgaaacatagtcattgcggtaagcaagttcagcttcatcagtatctttgaagatcattccttcaccttcacgacccttatcttcagtagtcatgtagtagttaccaataaccatatcctgtgatggtgaaacaataggttctccgtcacgaggactaagaatatggtgagcagcaagcattaacaaacgtgcctccgcttgagcttcatcagataatggaacgtgaatagccatctgatccccatcaaagtcagcgttatatgctgaacatactaatgggtgaagacgcattgacttaccagaaaccaagattggttcaaacgcttggatacctaaccggtgaagagtaggtgcccggtttaatagaactgggtgttccttaataacgtcttccaatacatcaaagacatcatcatcactgcgatcaatcttacgcttagcagctttaacgttagcggaaaggccacgttttaccaattcatgcataataaatggcttaaataattcaagtgccattggaactggtaatcccatttggttcaacttcaatgatggaccaacatcaataacggaacgaccagagtagtcaacacgcttaccaagtaagttttgacggaaacgtccttgcttacccttaagtaagtgagaaagtgacttcaatggacgattacctggtccagctactggacgtccacggcgaccattatcaattaatgcatcaacagcttcttgtagcatccgtttttcattttgaacaataattccaggtgcttgtaatttaagaagtcgctttaaccggttattacggttaataacccgccgatataaatcgttcaaatcggaggtagcaaaacgtcccccttcaagttgaaccattggccgcaagtcaggtggcataactggaattacatccataaccatccattcaggcttatttcctgacttaatgaaagcttcaagaatatcaagacgacgaatagcacgagtccgtttttgaccagtagcttctttcaattcttcttttaattcagcagcttccttttctaagtcaacatcggctaaaagtttttgaatagcagcagctcccatttcagctttgaaacggtcaccatattctgcttttttatcacgatattcagcttcagttaaaagttgtttcttttcaagtggagtatcacctgggtcaagaacaacatatgaagcaaagtaaataacttcttcaagtgaacgtgggctcatatctaatacaagtcccattcgacttggaattcctttaaagtaccaaatgtgagatacaggagcagctaattcaatgtgccccatccgttcacgacgaacttttgcactagtaacctcaacaccacaacggtcacaaacacgacctttgtaacggatacgcttgtactttccacacgcacattcgtaatccttggttgggccaaagattcgttcgtcaaacagaccttgcttttctggctttaatgtccggtagttaatagtctcgggctttttaacttcccatatgaccaactacggatcttatctggagatgccagaccgatctgcatactttcaaatttattgacatcaatcaaaggatgttcctccttctttcagtaaaccgtagcaacctaaatattaattttgattagttttgtcatcggtagttgttgaagttgcttcagacttgttttcttcttcgttcttcttatcgtctgttttatgttcttctgcatatttagctaatgcatcaacatttacaacttcatcatcatcttcgtccatgttctttaactgaatttccttgttgttaccatcaagaaccttcatatcaagacctaatgcttgtaattccttaacaagaacacggaatgattctggaacacctggcttaggaattggttgaccattgatgattgcatcataagtccgaacacgaccaacagtatcatctgacttgtaagtaaggatttcttgaagagtgtaagcagcaccataagcttcaagagcccaaacttccatttcaccgaaacgctgtccaccaaattgtgccttaccacctaatggctgttgagtaacaagtgagtaaggaccagttgaacgagcgtgaatcttatcatcagccatgtgagctaacttaaggtagtgcattgaaccaacagcaatccgattttcaaatggttcaccggtacgaccgtcataaagaattgtcttaccgtcttctgggaatccagattcacgaacagcatcccaaacatctttatcagatgcaccatcgaatactggagtagccatatgaattccaagacgacgagcagccattcctaggtgcaattcaagaagctgaccaatgttcatacgacttggcacacccattggactaagcataatatcaatcggagttccatctggcatgtatggcatatcttcttctggtacaacgatagaaacagtacccttgttaccatgacgtccagacatcttatccccaacctggatcttccgcttttgtgcaatgtaaacacgaaccattgtatttacacctggtgataattcatccccattttcacgagtaaagactttaacatcttggatgattccgccaccaccgtgaggaacacgtaatgaagtatcacgaacttcacgtgacttttcaccaaagatagcgtgaagaagacgttcttcggcagataattcagtcattccctttggagtaaccttacctactaaaatatctccatcatgaacttcggcaccgacacgaacaattccgttttcatcaagatctttcaaagcatcgtcaccaacgtttggaatttcccgcgtcatttcttcaggtccaagcttggtttcacgtgcttcagattcgtatgattcgatgtgaatagaagtataaacatcgtctttaactaatcgttcattaatggcgatggcatcttcgaagttatatccttgccaagtcatgaaggcaattaatgggttttgtccaagagctaattcaccttgttccattgatggaccatcagctaacacgtcatcagcatcaacatgttcgccaaccttaacaattgggcgttggttgtagttcttaccaccgtttgaacgacggaacttcattaacttgtaagtatcaagtgttccatcttcctcacgaacccgtacttcacgagcatctacatattcaaccgttcctggcttcttagcaatcatcgcaaccccagagtcatgggcagccttgtagtcaataccagtacttaccaatggagcatgaggattgatcaaaggaacagcctgtcgttgcatgttagcacccatcaatgcacggttggagtcatcgttttcaaggaatgggatacatgcagaggcaacagaaacaacttgcttaggagaaacatccatgtagtcaatgttttcaacactggtttcgatgtagtcatctttatcacgagccattacttgatcgtcaacaaatgaaccatcatcatttaatggcgtgttagcctgagcaatgatgaagttatcttcttcgtcagcagttaagtaatcaatcttatcagttaccttgtgatccttccaggaaacacgacggtatggagtttcgatgaatccatatttatttacccgtgcgtaagatgaaagactgttaataagaccaatgttaggaccttctggtgtttcaatagggcacatccggccatagtgagtatagtgaacgtcccgcacttcatatccagcccggtcacgagttaaaccaccaggaccaagagctgaaagacgacgcttatgagttaattcacctaatgggttagtttggtccatgaactgggaaagttgggatgaaccaaagaattctttaatagaagcaaccactggacgaatattgattaattgctgtggagtaacagtgtcaggatcttgaattgacatccgttcacgaacaactcgttccatccgtgcaagaccaatccggaattggttttgaagtaattcaccaactgaacgaatacgacggttacctaagtggtcgatatcgtctgtactaccaataccttcttgtaagttaaagaagtagtttaaggaagcaagaatatcagctggttcaatgtgcttgtattctaatgggatatgaccgttaccaataataggtacaactcgatcaggatcagtcttagaatatactaaaatcttttgtaacttaactggttcagttacaaccgcttcatctgatggagtgtaagtaatagtcttaaagtcatcacggtctaagtaaggttcaagcttattaagcaattccttagttaccgtatcacctttttgtgctaatacttcaccagtatcaggatcagctaaagtttcagctaaagtttgtccaagtaaacggtacttaagcattaacttcttatttgtcttataacgaccaactggtgccatatcataacgttttggatcaaagaaacgagctgttaataagctccgtgctgaatcagcagtctttggttcaccaggacgaagccgttcataaatgtcctttaaggcttcttcaacccgagaatcttcagcgttcttgtgaacatctttatccaaggttaatgataatgtctcactatcgccaccgaacatgtcaataatttcatcgtcagagccaaagcccaatgcacgaatcaattcagtcattggtaacttacgggtccggtcgattcgaacatatgaaacatttttagcatcagtttcgtattctaaccatgcgccacggtttggaataaaggtagcaccgtagtttggccgaccatttttatcattttcttcactatagtagacacctggtgaacgaactaattgtgaaacaataactcgttcggcaccattaataatgaatgtaccttggtcagtcattaatgggaagtcaccaaagaatacatcttgagacttaatctcaccagtttcatggttagttaaccgtaaagtaacatgaagtggtgctgagtaattagcatcgtgttcacgagcttcgtcaacagtatacttaggttctaaaagttgatagtcaacgaattccaaagaaagttttccttgaaaatcatcaattggcataatatcatcaaacatttcccgcaaacctttttccatgaaccaattgtaagaatcggtttggatttcaataaggtttggcaattcgagaacttctttaattcgcgagtagctacgacgggtacggtgtttaccgtatttaactaaatgtccagccaaactgttcacctctctaatttattccgcgagctcatttaaatgttacaatttgattacaatttgcctaaaatacgacttttgggcaaaaaaaatccaaaaacagttcaacgactgtctttggcttttatgcagaatctgatggacaatagatcaccaggttcaaatgaactcacaattacatactatttaagtatacaagttctattaaatttcgtcaacaattatttttatattttttaattttttccgccccaatttgataaaccgttaataatgcagtctaggattaattggtcacgttgttctggtgtaattgaatggccaccaattaattgcgaagtgccaaaaattggagttagtcctgcaataaataattcagcagcttctttaggaagaatatcaggacgtaaccctacatctggttgacggaaaaatgctgcaattggttctagataatccattgtaaagatcatattaagcttttgctgtgcactcttcgataataggcgcattgcctgattgtattggtcataaatacttaatggatgatgtttttttaatgccttggtgatttgccataattgttcattcggtgacaaatcatgtttacgcattactttattaatatcttggcgaacttttccacataaatttgtcattacatccagatataaaacctctttatcgctgaagtggtggtataaagccggttgcgtaattccaatctgtttggcaatatcccgtgttgaagtttcaccaaatcccttttgtaaaaataactttgtagcggtttttaagattgcttgtcttgtcttttctaattgttctgctcgcttcatttattgttcatcccctatttttaatcattaattatctgataaacacattataaggctataacttatcttttgacaaccgttttagaaaaataatcatcaaatgtgataaatgaatgcaatttggtagctttttcttctattatcattagatatcattagagaacaaaagttacaattataacatttttataatacataaaactcaaatattcggtttgtgtatttcaaatttaatgaaaccagaatacaaaacggtaaattactctgcactttcagaataatttaccgttctttttatctattcaattttaattcaacagctttatcttcatctggcttttttactttaaaagtaattttaccgtgatgcgcacctactgttacgtcatctccaacattgatttcaccactaagtagtccagtactcaaatcatcttcaacatgatcttgtaaggcacgacgaagcggacgagctccataagcaggattgtaaccaagctttgcaattacatcaattgcagcaggcgtaactttcaagttaatgccttgctcacttacccgtttatttaaatcattaaccatgagtttaacaatttgatgaagctctttcttttgtaatgaatggaagataatcgtttcatcaatccgattaaggaattctgggcggaagtataacctcatttgttgcttaatcgccgctgccatcgcattatagtcttgtgacatatcttttgccccaaaaccaacttctttttcatcctgaagctgagttgctccaaggttagaagtcataataataatggtatttctaaaatcaacgcgccgaccttttgcatcagttaagtaaccatcatctaaaacttgaagtaataaattaaatacatccggatgtgccttttcagcttcatctaataagacaactgaatatggatgttgccgtactttttcagttagttggccaccctcgtcataaccgacatatcctggagcggcaccaatcaagcgactagtactatatttttccatatattcggacatatcaatccggatcatattatcttccgagccaaacattgcagcagctaatgccttggcaagctctgtttttcctaccccggtcggtcctaaaaacataaaagaaccaatcggccgactaggatccttaagaccgcttcgtgcacgccgaattgccttagcgactacggtaactgcttcatcttgaccaattactcgttgatgcagaaccttttccaagttaaccaatcgttcactttcactcttcttcaattgagttaaaggaactcctgtccattcagcaacaacttgtgcaatgttttcaccagttactttcaatttgtagttatgagaatctttttgttgagtgcgttgttttttacggtcaatcttatcttttagtgctaactcctgttgacgaagagtagctgcacgatcaaagtcttgattatcaattgcttcttctttttgggttcgcaaatcttctaactgactttctagtgaaggctgatgatttttcttatcttcagcatcaattcgaaccatagctgccgattcatcaataagatcaattgctttatctggcaagaatcgatccgaaatataacgatctgacaatttaactgcttcttctagcgcttcatcagtaattttagcatgatggtgctcctcatactttggtcgtagtcctcgcaggatttgtagagtttggtcagtagtcggctcatcaacttgaacagtggcaaagcgtcgttcaagtgctgcatccgattctatatatttctgatattcatcaagcgtagtagcaccaattgtttgcaactcgcctcgcgctaaggccggtttcaaaatattggaggcatcaattgcaccttcagcaccaccagcaccaattaaggtatggagttcatcaataaaaagaatcacatgcccgtcgttttgaatctcatcaattacttttttaagacgatcttcaaattctcctcgatacttggtacctgcaactaatgatcccatatcaagcatcatcaaacgtttattagccaattcagctggaaccttaccatcaaccatccgctgagcaagtccttcagcaattgccgtcttccctactcccggttctccaatcaaaactgggttattcttggtacgacgactaagaatctgttccacacgtttaacttccttatttcgaccaattacaggatcaagctgaccattccgagcaagttctgtcatatcacgagctagtttatctaatgttggtgtaccagtttgctgaatccgtcgacgagatgattgacgattaggattgcgttgctgactatcagcaatccctaaccgccgtaaaattacttttctcatctgtcgtggcacaacatctagactatataaaatccgtgaagatagaacactttcatcagcgattaaggctaataataagtgttcagtgccaatcttcaatgcatgcatttgttgggcttctttacctgctaacgataatacttgctttgcttttggtgagtatgggagataatctgaagctcccagattttccatcgttccatagccaattaagcgttcaatttcttcacgaatatcatcgttcgtaatagaaaattgttcaaatattttgttagcaatcccatctttatccattgagagggcaagcagaaggtgttcagtccctactgcttggtgtttaaagtattttgcttgttcttgtgcaattgctagaacatgctttgcacttggcgtgaacatattatccatgtacaatctcccttttaactttcatagcgaagtcgattcaagaatgatactaatatacgggcgcgaagttgatcttcaatcttactatcattaactgctagtgcttgtttagataatgcaactagcattaagtctccttcacgtctcgtaatcacgtcttcttcatataacgttcgaacaatatcaaaagcatcacgttcacgaaccgagtcgccaattgcttgaataagtgagtttagcacatttacgtcatcaagtaaattaactcgctcgattcgaatatatccgccgcctccacgcttactctttactaaataaccattttgaatggtaaacctcgttttaataacataattaatttgtgacggtaccacatcaaactggttggcaatctcagaacgacgaatttcgacctgagctgagtcaccaagtatttcttttaagtatgcttcgataatatctgaaatacttttattctccattatatcacctcggctcttttgactaatcttgaccattattttaacacacttttagagtcagcgcctacttgtatgatcattcagttacacatttaagaaaataataaagactagcgaagcattcaagcgcaacactagtcttttagagaattaaatatgaactacttttttaattagtcgttatcgttgtgaacaaaatcaacaacattccgaccaacaaccttgttatccttaagttcttggatcatatcattaatttcgcttaacttacgagtcttaacaattgggtgaaccttaccttctgcaccaaattggaaacattcagctaagtcttgacgtgtaccaactaatgaaccagcaacaatgataccatcaagaacagtcttagcaatgttaagcttcatgtcaccttgtggaagcgcaacggcaacaagcttaccatctgggcgaagtgaatcaactgcttgatcgaatgcagagggagaaacagctgttactacagcagcgtgaacaccgccaaccttttcttgaatttgcttatcaacatcaccgtcatgacggttaattaaaatttcagcaccattcttcttagcggcttcaagcttatcaggattaccatcaacagcgataacatgagcaccaaatacgttgtgagcaaattgaatacccaagttacctaaaccaccagcaccaacgattgatacccattgacctggcttgatgtcagcaacctttaatgccttgtacatcgtaacaccagcacaagttaatgaagtagcttcaacaggatcaagaccttctggaaccttaacagcgtagtcagctggtacgatacattgttcagccattgcaccgtcagcagtgtaacccgcattaagaacattccgacaaagagtttcacgacctgttaaacaatattcacagtgtccacagcccttgaagaaccatgcaattgatacacgatcgccaacttttaatgaagtaaccccaggggcaaccttagatacacgaccaaccccttcatgaccgataatacgacctggcttcttaccaaagtctccagcagcaacgtgtaaatcagtgtgacaaaggccacaatattccatgtcaactaaagcttcaccgggctttaaatcccgaagttgaacatctttaacagtaacaaaaccgtctactggatcgttaataacagcagctttcataaggtaagatctcctttattaataaacaaattactttttacaatgcttatagtaccacaactcctagacaaatttaaagtgaaaatttgcacatttaacgaaattaataattttattttttatttaaaacactgatataacaatgataacgcccggaaaatcaattcttttaatattgtatagtaaatcacttactaattatcactaaaactttactgttacaattttagacgctctctattaatatggatgttacaatttaatcaattagacaaaggagtggtagctaagtgaaaatgtagagcggcaatatattcgttacaataatcgttatggaacggcaattgctgctgatatctacacccctaagaatctagaagaagacaaattgttatcagccatcgtaatcggggcaccttatggaagcacaaaagaacaggcagcagcaatttatgcaaatacgtttgctcaattaggttttgttacccttgcatttgatcaagtatacatgggtgaatcagctggcgaacctcgtcatgttgcttctccagacttatatgcggaatcttttagtgccgcagttgattatccaggtacaaaagcaaagcatgtcaatcgcggacaaataagtgttatcggtatcagtggaggggcaggctttgctcttagcgctgcggctgttgatacacgaattaaatctgttgtaacaatttcaatgtatgatatgacagatattcgtgagatggctaatcttgctcctgaacaattattccagcttaaagatcaattatcaaagcaacgttgggacgattttgaaaatgggcagcctgactatcatccttccttcccagaagaaccatatgatagtattgacgatttaccaaatcatgatgagttaacaaatgagtggcttcgtttttacgctcttaaacgtggcttccatccaaatacacgtggaactgcaacaaccacttctaatttagcaatgcttgaattttctgcgttagactatattaaagaaatttcaccacgaccaatcctatttatttatggagacaatgctcactcccgttcttattccgagagagcttattaccttgctaaccaaccaaagcaaagattgatcgtaaaaaactgcgaacatattgatttttatgataatatggaaaaaattccagtagatcaaattgcaaagtttataaaagacagtttcaacgcataatcaaacgacaaaatgccaatcagtgcctcaattatggaagcctggttggcattttccttttaaatattttcggaaattaataaaaaactgctatctcttctactatagaagtgataacagttttttaacttatcggaattacaagatttgaacttgcgacctctgcgtcccgaacgcagcgctctaccaagctgagctaaattccgaaaaaataagcgtaacagttaaactgtcacgcttactataattagtgcacccagaaggagtcgaaccttcaaccttctgattcgtagtcagacactctatccaattgcgctatgggtgcatataagcggaagacgggattcgaacccgcgacccccaccatggcaaggtgatgttctaccactgaactacttccgcatgtctctgataagttattccctatcaacgattattaatattacacgaaaatctcatcaatgtcaacaagaattttcaaaaaatattaaatgcggatgaagggacttgaacccttacatcaaaatgatacaagatcctaaatcttgcgcgtctgccaattccgccacatccgcaaactaatggaggatacagggctcgaacctgtgaccccctgcttgtaaggcagatgctctcccaactgagctaatcctccataaataggcttgctatataaatcagcctatttaatatatcatctatatgattttttgtcaaatcctatttaagatttaattcaattaatttttcatcaatcatggctaagaccttcttagcagcagccggatcttcaacaaaatcatatttatcaccatcaataaccatcttaggactttcattataatcctcataccattgaacataacgttcgtttaagtttttataatatgaatataatgaagaatcattagcaatttgttcaaatgaacgtccccgtttcttaatccgttcaagcattgtctcaaacgaaaccctaattgtaattaaaaggttgggggctttttggtgtggttgctctggtaattcttccatcatgttacttaataatgaagaataaatatttgactccgtttccgtagctcgacccatatctgcgtttaacttgaataataaggcatcttcaaaaattgaacggtccaaaacatttaaatcatttgagtatgaatctttaatctcatcaagccgcttgtttaaaaagtaaatctgtaataagaaaccatattttttaggatctttataaaaaagcggcaaaattttattgtcatcaacagattcatagaaggcctggctattaagatggtctgccaacagctttgtcaaactggtctttcctgcaccgattgtcccagctatagcaatcattagttatttccccctgtttcaaattcaaaaagtaacgaaaacaattctaacatttaaaataaaaaggagcgagtattttctcgttccctttttattttattaatcatcttccggttcgtacgattcaccctttgttcgccttgataaatcaaccttatcaagcggaatcaagtgcgtcttgtaacgaatcttgtagtagaagaaaagaattaagaataatggaattcccatgtaagtaattaaaatgttttgccagtccatttttacaaaagcatcaatgttttgaccacaaataacgacaatacatagagtaagcgcgaatactgggccaaatgggaaccctgttgcatgatacttcaattcagacagtgtatggccttgcttaagaaatgccttcctaaagcggtagtgggaaattgcaattcctaaccatgcaataaatccacacaatccagatgcaccaattaagtagttataagcttcgggaccaatgaattgggttgcataggctgctaatgaaacaaccatcgttcccagcaaagcataaatcggaataccatgccggtttacataaccaaaaatccgccatgcatatccttcacgcgcttgtgaataaagcatccgggttgaagcatataaaccagagttagcagcagaaatgacggcagttaagataaccgcattcattgcactagccgcaaatgctaatcctgcccgcttaaacacaatcgtaaatggactcattgtaatatttgaaacgtcttgattcaataagttcttatctgtgtaaggaaggatgcaggcaataacaaaaatagcaaaaatataaaaaagtaaaattcgccagaaagttgaatggattgcctttgagacagacttttctggtgtagcagcttcaccagcagtaattccaactaattctgttccttggaatgagaacccagcaaccaagaaaacactaataattgctggcacacctccaacaaacggtgcctgcttatagtggaagttgcttaatccaactggcttaccacccataattccaaaaataattgcaacaccgacaattaaaaatacgataactgtgacaactttgattaaagcaagccaaaattcagtttcaccataagatcgtactgataaataattgattaagaaaattaatgccatcactgttacactaaaaatccagcctggaacattaggaagccaataattcattacaattcccgcagttgtaacatctacggggattgtaatcgcccagttaaaccaataattccaaccaagagcaaaacctagtgctggatcaacaaattttgttgaataagctgaaaatgacccagttaatggcatatatgttgccatttcccctagactcgtcattaggaaataaaccataattcccataattccatatgcaactaacgctccgccaggtcccgcagttgaaatagcggatccactggcaataaaaagtcccgtaccgattgttccaccaagagcaatcatggacaagtgacgtgtctgtaatgtccgttccatatgacccgtcgacttagattcatctgccataaatatatttcctccaaatttgtgtgccttaacgtcaacattttcgaagaggataaattaaaagggtcttctgatcggtaaccccaccagaagacccaacttaatacctataattaatcgttgaatcaatttaggaagcgccccgcaattattgcgacagtctatagcctattgtgactatagcccaacatctaccagaaataagctaagtagtgtttcggcatattttccttttactaatactccggtgcttattcacctaatactagttactgataaaatatgcaacctcttcatcgaatgaaattataccccactcaaataaaaatgcaagtccgattatttaataatgcattgccataagtcatccttgtcataagtaaaaccacatttaacaagtactcgctgagaacgataattgctttgtttgcactccgcatgaatcgtaattttagatggcaaaatagaaataaatttttgaagtgcagttgtcattatgcctttattccattggttttgctgcaaaagataacctaattcataatgatgagcaattctttttccttcatccccataccaagcacttaatacaatcatccccactacatcttcatttagtttcactaccattacatgattctggcgaacaaacatcttaatagcttgcacacgtttttctctttgaagtggtaaaagcagtcccactgcttgtgttaagttttcattatccaacaatttaactattgctcctaaattgttattagtttttgctgattcaattataatttcactcatttttctcctatttcccgggaaataaaaaagagaagcaaccaaaaagattgccctccatcaatttcgattattaaatttcaatactacggaagaacggaatccgttgcaatcgtggtgcccaagcgacatagagccattcagctacttgtaaccatgcataagctaataacattgcaccaatagtatcaaaaggccagtgagcataaagatatacccgcgataccgccaaaaagaagactgcaaatattaataaaatttgcaaaattgtgcggacagatgctttttgaataagcggaattacaattaagaataaaattgctactaccaagaagaatcctaaagtgtgaccactagggaaactatagccatcatctgctgccaagtgttgtgcaggacggacccgcttaacgatgtgtttaataattgttccaagcacatcaccaccaaaaatcgttcctaatgaccataaagccgggatgcgatagcccttcaaccataaaacacctgcaataataaatacccatactaaatctaagaccggtttaactaaaaatgaaagtaagctcatcaaagcatgaaaccaaccaattccttccaggcgctgactagtaaataacgactgcagaacagcatcaatcattgttagcactgacgaattaaacataattaatagcatcaatgcgataaagaaaccaccgcttaaggcaaagcgccaccaccgatgatcatcacgttcaataaacataatcaaggattctcctaacttaaattaattaatcaaaaataagtataccacagtgtcaaaaattccatcgtgactttttgattaaatatttatgaagatagttcaaaacacgatttaaaagctctcccaaaccaaagccaagcgtaattgcaccaacaatgacaactacctggtagaaataaacattaacaagatggtaattaccaatagcaaaattacgaaccattttataagcctgtcctccaggcacaaatggaactagcgcgggcacattaaaaacaataattggcattcgttttcgacgagctgctgcctggcttaataccgaaattaagattgcagcaactaaattactaaacgcaaggccaatgccactgcaataatacattatccagtagactacccatacgcctccaccaatcatccccgcagtatgataggcacgtttaggaatatttaagaggataccaaaacaaactgtcgaaacatagcataagaaaaattgtaataataggttaccccaattcatctcctaccctcctaattaaagtgcagaacaattacaattgcactaccaatcgaaacggcagttagaatcgcctcaatccctcttgtaggtccactaattaagtttccggaaactaaatcccgtgccgcattagttaagggcaccccaggaaccagaggcataaccgcaccaataataatatcattaatattattagcaaggtgcattttaacaaagatcaccgccaaaatacctataattaaggaagaacaaaactctcctaaatattgaatcttaaactttcgtaaaaggtatgaaaatgctccgtaacctacgccacctgcaagaaagccagcccaagaatcagaaacattacctgtaaagacaatcattaatgcaccacttaaaatcgcagcagcaaatgattcataccagttttgccatcttgacatcttttggtgatcaatcctttttaatttagcaaatgcttgtggaacatcaattttgcgccgtgctagttcacgagaaacttcattgacatccgcaattttacttaaattgtttttgcgatgacgaatagtaattacttgggcatcaggttcattaatcgtcccaactacaattccagttacggttgtaaaagcctgaaagccatgaagtcctgcactttttgccattcgggataaggtgtcgttaactcgttccatatttgatccattttcaattaaaagtctcccagctagcaaacaagtctttagtgctagtgcttgtcgtcgtttcgttaacatcttttcgccttctctgttcaaagatatttattattatcctctgtttagataaggagctcaatacaaaaaaacggccggaaaaatccagtcgttttttgtatttagtctttaactacatttgcagcttgaaggccacgttcgccttcttcaacttcaaacgtaacatgttgtccttcgctcaatgacttaaagccatccccttgaatagcagaaaaatgaacaaacacgtcatcgccgctttcacgagtaatgaagccataccccttatcgtcattaaaccatttaacagttccttgttccatgttggaaatcctcctgtgcattaagcactaatataatttgtaattcgtctcaggtgaagagatccatttgcaatgaaacaatcgaaccaaccgcacttaaaaaaactacaaaaaccattgtatcacataagcaatcatttacataattaacctttattttcttgagctgtgtccggttcaataaaaatattatgtgaggccttatatgaaacattaatttcttggtcgttatcctctttttgaatcacaattggtccttcaaaaggctcatggcgaattacagttacttgttcctgaggtcgtaatcctaactcttctaagtaagtgagaagttcatgattatctaagaatcgttctagttcaactttttccccatcatcagcatctgctaataaacgatgtgttacatctgggaacttgccattagctgatggaattactccaccatgcggacaatgatcagggtgttgaagaaaagcatctaaggccgttgctagtcgatcacttgtctgatgttcaagaatttccgcttctgaatggacgtcggcaaaattgtagtgaagcttatccactaaaaatgtttcccataaacgatgctttcgaactaattctgcagcatacttttgtcccttttcagttaaagaaataccagcatatggttcatgaacaactagcccttcgtcagccaacttagaaatcatctcggttactgatccagcggcaattcctagtccaagggaaatctctttattagaaacttttttatgactaccacctaattcaaaaataatttttagatagtcttccttcattggagtcaaattgtttcacctctgggtattaaaatttggcctacgatcggtcattatgtgtttttatatattaacattgaacccaaattgattatagcatattattaaaagtgtagtttggaaagcctaacttttttgttataagctttttataaacccgcaatcgatctttacggaggagtaggtaaatcatggacgaaaaagtaacagggaaacgctttttagcagttaccctcctaaatgtattaattacaattgttgaaatcttcggaggtattctttcaggaagtttagccttactatcagatgcttttcataatttaggggattcgctttccattgtactaggctactttgcccagcatattggcgggcaaccagagaatcagcaacgaacttatggctaccgtcgagctgaaatcctctcagcattaactaatagtatttttttaattgttatctctgtctttttaattattgaagctattaagcggttagagcatccccagcatattaacgggggcattatgttaactgtagccgtgattggtctgcttgccaactttatttctgcagccctcttacatgccggaagcgaagacagcttaaatgtcaaagcaacttatctccacattctaagtgatgcactttcatcagttgccgttatcattggaggaatcattcttacctttgttaatgttccatggcttgatcccgccttgacaattggggttgccctctatattgcttatgaggcttggccaattattaatcaaaccattaaaattctcatgcagtcctccccagatcttgattataattccatcgaaaatgatttaaagcaaatcgacggagttgcggcagttcatcacgtccatgcatggatgatggatgaacaccgaatcattttctctgcccatcttaattgtgatgacttgccactaagccaggttgagcgaatctatagtcaagtagaaaaaatcttgcatgaaaaatatgggatctgtcacgttactattcaagcagaatatcaccgtgggaaagatgaaaaattattcaacactcctgttgatgaaaagaacgttattaataacgatttcaaagaggactaaaattaaaaggaagcaaaaagttgagcgaaaactcagcctcttgcttcctatttttttacatcgattaaaataattttccgactccatagtgaatcgtaatcgtaatcaaaccaataataatatttcgaataactgcaatttttacaagcccgttcccgagtttagaactgatataaccggttagagcgctcgtaaaggcaactgccaaaatcacggcataccacttatatgcttcgggagcaaaagtcatcgccatcaacggaattaatcctccggcagctgctgaaaaaagagaagaaaatgcagcatcccaagggttaagatagtgaccaagctcaacatcatacttaatccgaacaactgtctcgaggggctttttattaaggagatccttagcaattttgattgatgtttcaggagtaactcctttatttacataatagtcttttactgccgcaagttccccttcataatcgtcctttaagagttgctcttctttagcaacggccgctttttctgtatccttttgagtagatacagaggcatattcgccagaagccattgaaaatgcacaggcaagcaaatcagataagccagcaatgaagatagtaaaacggtcacttgtcgctgctgccaccgataccaaaacaccgacaacagtcaaaatcccatcatttgaacctagtacccctgctcgtaacgtattcagtttttcttccattgtttgcttctgatgctttttcaccttaatactcatttaatctcatctccctaccgcgcaaataattgtccaatcaggtacgtaacccccattgttaataatccagcagctgcattcctgatcatcgatttaatccggttagattttcctaaaaccgccgcaaaataaccagtaattaacaaggcaattaaaactgcaattgcggttgctaagattcgaacatttacgggagaaacggtaaccgccaccattggtaaaattgaaccagttggaaaggatataaaggaagcaatcgccgcagcatatggacttgtaaactcattgggattaaagccatagcgctcttgaacagctgtccctaaagcatctttttccattaattctttcgtcgcttgtttagctaattgcgaatcaatgtcttgagcttcatatttcttttgaacatagtcaaattcatgctggtattgattctgaagccgctgcttttcactaatcaaagccattttttgtgagtccttttgggtcgaaactgagacgtactcccccatacacattgagatcataccggcaagtgttccggacaaacccgcgattaagatggaacgggcattactcgttgccgctgccaccccgataacaattccggcaattgaaataatcccatcattagcccccatcacacttgcacgcagaacgtttaccttttgtgctagtgacatctttttcttggacacatttatcccttccctctttcagtttagaatcattataacatagagataagtaaaaacaaccaaataatcttcaaatgatattctatcttagaatcattaaaaaatatactttcatgtaaaaagcgatagtcctaatcagaactatcgcaataatcttaaaaattaaattatttattcataagcctgaacagtgtttgtccgaataacaaatactgacgttccagcatgacgagccatgtatgatgcctgagaaccaaccgccttacgattacccttcttaccaattgaaccaacaactaataaatctggctgaaaagcggggataacatgattacaaatccgctcagctggccgctccccacgatcaacaatcgccgtaatcttttctggatcaacgccgtaatcaattgctgcttggacatattcatttacccgttgacgtaattcgtcttcactgctatgaacataatccttatctaagatttgatatacatttacccggtcagtttctagaattgatacaattcctagctctgaaccatcacgtttcgccttatcaaccgcgtatgagaaagcggcacgggcatctggtgcatcgtcaacaccaacgaggatcttcttgaacttctttggctttatttcgaacattagtattctcctccctatgttctacactttaacggtgaagcattactcgctcctcttcgttaaatcatattcttcactccttatgttactacttatctcgattttgtaaataattattttggccttcctaaaataaaagtgatttattaaagaattttataattattttttcaaattcacttctacacaattctcattttgacgacttatagaacaatcgatataataaaagttacttacttcttgataatatcaacgaaatggggttaattatttcatgtcaatgattgaatttcataatgtacaaaaatattatggcaagtttcatgcattaaaagatattaatttaacaatcgatgatggtgaaacagttgttttaattgggccatctggctcgggaaaaagtagtttaatccggaccgttaatggtttagatcctattagagacggtcaattaatcgttaatgggtttgaccttgccgataagaaaaccaatgtaaatttaattcgaaaagatgtcggaatggtctttcaacactttaacttatacaacaataagagtgttatcgaaaacataatgctcgcaccacgaattgtattaaagcgtccggaagaagaaaaccgtgagttagcaatgaaactgcttgataaagttggccttgcaaataaagctgaaagtatgcctgctcagctatctggagggcaaaaacaacgaattgcgattgcccgcagtctggctatgaagcctaaatgcctcctattcgatgaaccaacaagtgctctcgatcctgaaatgattgatgatgttttagacgttatgaaagatatcgctaaaaactccaacatgacaatgttagtagtgacccacgaaatgggctttgcacgggcagttgctgaccgggttatttttatggcagatggtcggatcttagaagacgattcaaccgaaaaattctttggcgaccagccttctacagagcgtgctcgcgaatttatgagtaagatcagtggtcactaaggaggaattataatgaaaaagtattggcgattgattagtcttagcgccctcctctttgttgctctccttactctttctgcctgcggtacctcaattgcaaaaaaagatgttctgaccgaagatatgcgtagtcaacgaattacctggggagttaaagcagatactcgtctctttgggctggaaaatatccggacaggaaagctagaaggatttgaaattgatcttgcaacagctattacaaaaaagatcctcggcccacagggaaaaccaatttttgttcctgtaaccagcggaacccgggtgcccctattaaaaaatggtaatattgatgcgattatggcaaccatgacgatcactcctgagcgagaaaagcaagttgactttacccattcttactttgatgctggtcaatctctcctagttaaaaagggaagtccaatcaaaaacatcagcgatttaaatcgacgaggtgctgtaattcttggggtttctggatcaaattcagttaaaaacgttgcgaagtttgctcctgaagcacgtgtccttcaattatctgactatgctcaagcgatgacggcccttaaatctaaacagggggatgcccttaccactgataatgggattctctatgggatgcagctgaaaacccaggctatgaagttgtcggcggtaactttactaaagaaccttatggaatcgccgttaacaaaaatcaaacacgttttcgcaataaattaaactgggcgttaagagaagttgaaaaggatggaacctacaaccgtcttcttcttaaatggtttggcaatgttaaaggatttaattatcaggagatgaagcgctaatgttaaatttaattataaatgagtggcatccccttttaaccggcctctggaatactattctatgtagccttattgcactaatcgggagccttattattggaaccttttttgcccttctcgagatttcgcagcatcgggttttaaaaatcatcggtcatgtctatgtggaggtctttcgtaatatcccactattggtaattacaatggcttttttcctgattatcccaatgtatgtagtgaaaattaatggatttactgcgggaacaattggcttaactctttatacgtctgcatttattgctgaaactgtgcgtgctggaattaattcaattgatcctggtcaaatggaaggagcccttgccaatggacttacttatggacaagcgatgcgctacattgttttaccacaagcatttcgcgttgttattccaccacttggcaatcaatttatcaatttggttaaaaactcatcggtccttgcctttgtcgctggctttgatcttatgtaccaaggaaatctaattgcaaacgataccttagcaactatgcccacgtatttcattgtcgggatcatgtacctcatcatcacgcttccgttgagttattatatgcgacaccttgaaaagaaattagcctaggagggatgatcaatgcaaaactttattgacgcttattcatggattaatatccgtttcctcctagaaggactttggattacgattgaagtttccgtaatttcaattataatcagttttattttgggaacttttctcggaattattcgttacgctaacatcaaatacttatcagcaattgtaggattcattatcgatattatccgtaatcttcctctcctgctaataattttcttcacctactttggcctccccaatatcggaattaaaccagaaattattcctgccgcaattatggcgctttcaattttcgaatcggcaatggttgctgaaatcgttcgctcagggataaattcgattgattacggtcaaacggaaggggcattagctaatggattaactaagtggcaagcattacgaattattgtcttaccacaagcaattaagaatatgatgccggctctcgttagtcagttcatttcattagttaaggatacatcactagcaacaatcattgtcttgccagagttaatgtaccacgcccagatcatctatggtcaaaacacaaattatattattccgatgttcgttgcgttagcagtcctctactttattgtctgctactcattatcattggttgcacgttatttgcataaacacattgcataagtataaacagaggctgagaaaaaactgttgtttttctcagcctcgttttatatgaatattgttacgatatcgcggaaattaaccacaaggcggttaatttccactcacttatttaatactgaatcataaagtcaaaccgttgatgctctccggtcaagcgattaacatgccgttccatcacttgacgtcgttgtccaaacatcatccaaacggcgattccaataaatactactaattctattcccgtcccaatccaattttgaactgttactttgccagtcatcaacgttgaatcagaagcaataaatgccgtccaatctaataggaagtgcattaccattgctagccataattgaccagtataaacataaacggttgcaaaaaatagtccaatcccagctgcgctaactgcttgtaaaacagtcattgaccattcttgagggccatagttggtaagatgaacaattccgaataaaattgaactcgttgccaatgccaacggaaggcgttgcttaacattgcgccaagcatagaataagatgccaagaatagcaaaacggaataaggtctcttccattaccgcagcctcaaacgccgaaagggtaaaatcccaattagcacggtggagccttggcatttctcccgtatttaaggccataaagataatatcaacaacaactaatccagcaaatatccccaattaaaatcaccgctccagtgtggttttaatcctggccatgataaatgccacgtccgcataacagttgtcgtaagaataaagaaagcaactgcgccaactgcaccagtcgataatgctaataataagaagtgattatcaaccaagtctgttggtaaggcaatcaatggcgtaaaaaccacctgagctaaccaggcaataaagattagccgttcgatgctccaatgcatgaactcaccaattacgcttgcaaatggtgcaaacataataaagtaataaaaaatcatcattgtcacaacgccccgggatggtaaatgtaatagaacaataatttctcgaaccattacatcccaagcaaacactaaaattatcggctgggcaattacctgcagccatgcattcaactttttaactaacaaggatacattaggtaagagttcaaagactaaaccaattcctaaaataataaccatgatcaataatgctaatgcaacagtctgacgattaaattcgtaattacgaatcatcatcattgccaaaatgaccagggtcgccccaatttgaacccggtaccagatcctaagataatcgtttccggtcatttttcctcatcctctctgggaaatctaaaataattgctaaatatgatcataccaaacaatctccttagttttaagaacaaatcttctttttttagtttaaaccacaaaagaacctgcaggcaaaaaaaccgcaagttcttttatcgtttattttgtgtttccagttgcaactggttgcttctctttactattcttctttttagaatgttgctgagagttccggtgggaatgattattttgtcgttcgtttttatgtgtttgattatttttattgtttggtcgacgatagtgttggttttcggaacgattattaccgttcaaaattgtcaccatcggaataatcactggacgacgaccggtgcgatcatagagtaatttttgtaaacggctgataattgtccggtttaatacccgttgatcaatgtgtttgtgattcttaaatgtattaaggattgcccagaatacttcatgattggctgccttaatcagctcttgtgattcatgcatataaacaaagccacgagaaacaatatcaggccccgcaacaatttgataatcctttaagtcgacaaccgcaatcgctgttacgacaccttcttctgaaagcaagcgtcgttcgcgaatttctggatttccaaccgtatctcccgcatcacgaccatcaatataaacatcactaacactatcaatatggtccgccactcgacaagagtctttcgtaagagctaaaacatccccatttgcaaggacaaagctattttcctttggtacaccagtcatttcagctaacttagtgtgaattttttgcatccggtattcaccgtgaaccggcgcaaagaatttcggcttcatcaagcggagcataaactcttcatcaacttgaccaccgtgcccggatgtatggatattgttaacataaccgtgaataacattagcaccgtcttcttcaagcttattgatcaaggcattaacgctagtcgtgttacccggaattgggttacttgagaaaacaacggtatcctcaggctgaatggtaatctggcggtgagttccgttagcaatccgactaagcgccgccattggttcaccctgcgatccagtacacatgatcaatactttttctggtggatagttattaatttcgttctggtcaatcaatgagtctttagggatattcagataaccgagttcttgaccagccgtaatcgcattctccatactacgaccaaaaacagcaattttacgcccttgagcaatggctgcatcagaagcttcacgtaaacgatagacgttagaagcaaaggatgcgaaaataatccgtcccttgatccgttcaaaaatacgccgaatgtgaatatcaacccatcgttcagacttagtaaattccggtcgttctgcgtttgtactatctgaagtcaatagcagaacaccatcatcgcctagtttggccatttgttgaagatttggaccaggtaaattaccaaccggtgtcaaatcaaacttaaagtccccggtttgaacaattgtcccttgcggagtatgaactgcaatccctaatgtatcaggaattgagtgggttgtccggaagaaactaacccataatttcttaaagtgaacctcatcaaattcattgatttcatgcaattcggcatttcttagtaagtgtttttcttccagttttcctttaattaatgacattgcaaatggtccagcataaataggtgcattgaccttttgtaagaagaatggtaatcctccaatgtggtcttcgtgaccgtgagtaataaagattcccttaatcttatctttattttcaatgaggtaatcataattttgaattacgtaatccactcctagtaattcatcttcggggaataaaactccacagtcaataacaataatttcatcttggaattgtacacaatacatatttttaccaatctcaccaagaccacccatggcgtaaaaggcaacttcattgtttttaatctttaattttgtcataatacctttccttctatagatttttatcatgttaattaacggaatttaagtaagccaaaagaaccgctttgttctgacaaggtcggttattgatattcattttattattggcacttaatcttaattatttaatccgtacgtaaaactaactactattttaccacatctacaaaattgaaggtagtaattgcctaattctttgattaaaaaagaaggtgggagaaagtatttatctttactccaccttcctttttaaatcccactagttgcttgcctaatcttcttctggtaactgttcctctttttgttcccaagccttcatccaatcaacaaccggttccccatcttcatgaaatttaacattagtcaatgcggttaaaattttttgataagctggcttacttagccgcgtgcttacattaactaattcctgatgacccataaaagcattatcgcacaagatttgattaattgtagccattaattcattagatacttgtgagctaaggatctctaaactgcccctacgatattgatcaacataaaaattaataaaggaattaagggcaacttctttagcatcctcgcttaactcactataacttaaacctgttgtagccaattgttattcttcctttctcaaattaatttactttggttatcctctacattttaaccttaacacaaagtttattatccgttaattttccttccgatcccgaatacgaagactagtattttcaccatcaatcactgcatatacttcttttgtggaatcttcagctaatgcacccagcttaacttctccactatcttctccagtttgttctacctctttgataccgtccgtaataaaacgggtaaaaatcttatgaagttcgcgccgtttacgttccttttttacagccatcgctaaagtaaagccttgatccaaaaatactttaatcgttaatacctgaaaaattgttggaaaactaaaatagtgatttttattctgctcatcttgttcagatttaatataaccctttttctcccaatatcttagttgactagtagagacaccagttacacgtgctacttcactcatattaatctttaattgtttactagcgatcatttttctaattttttcagaaagcggatccattatttcctccaaagtgtatatttcaatcataaattaccaaaaattcgatatctttgtcaaataatttgacaaagatatcgaatagtattatatttttcacattgttaaaaacgtagaggaggattctattagtgaatcaagagcaacaacctgttgatattaatggtcaaacttataatcgttccttaatgatcttcgtcctattaattggagctttttgtaccattttaaaccaaactattctttcaacagcctttcccgcattaatggatgcttttaatattagtactgccaccgttcagtggttaactactggtttcttaatggttaatgggattatgatccccgtaagtgcctatttaaccagtcgttttaatactaagagtctttttatcattgctatgtcaacctttgaagttgggacaatcttagcatggattgctccatcgtttgccgttttattagccggtcgtcttatccaagcggtcggagtaggaattaacatgcccctaatgcagaatattatgctgactgtttatcctcctgagaaacgtggcgctgcgatgggagtaaacggcctagttattggattagccccagcaatcgggcctgctctatctggatgggttatcgatagttatagctggcggtggcttttcggaatgatcgcccccattactgctttagttatcattgttagtttttttgcagttaaaaatgttattcctaataaaaagccgcatcttgactggctttctgttgttatttcaacattaggatttgggagcatgctttacggattctcaagtgtcggtgataaggggtggacagatccggttgtcctttcaaccattatcattggggtgattttagttggaattctaatcatgcgtcaaaacaagctagacgatccgttccttgaattcaaggtatttgaaagcaaagaattctcccttgcgaccattcttagttcaattgtaatgatggcaatggttggggtagaattcgtcatccctctttaccttcaaatcattcatggaatgtccgccttccattcaggtcttacccttttatttggagcccttttcatgggaattatgagtccaattactgggaacttatttgaccgtcatggtgctaaacgcttagcctttacgggaatgtttatcttaactgttggaacaattccttttgcctttattactcgtgataccccaactatttatattgtcttcttatatgcagtccggatgtttggtatttcaatggtaatgatgccagttactacagcgggaatgaattctcttccttacaatctaatttcgcacggtacagctgttaacaataccattcgtcaagtcgctacttctgtgggaacagcgatcatgatctctgttttgacaaatattaccaatagcaatcgacctgctcattcactgctgacacaatccccattacaatataaagcaaagatgtttgatgctactttgatggggtaccatgcagcattctggtttgcaatcgccttctcactcattggtttattccttacattctttgttacaagtggtaatggaattcacctccgccttgatagcgaagacattgcagaaccaactgataaaggagggatgaagtaatggttattattttaacttttctaggagcactcgccttttttgcttgcatgatgtttattcggcaaaaaagcctgcgaattattttagctacactcacgggaattatctttgtgggctcaactcttttgatgacactaaattacagtcaccattttggaatgcaaaaagttacgacaacaaccaccaagcggatttactctgcttcaaattcctcaatgcccctggcaatttatcaaccggttggtaaaagcggccgcgatgatgtttatatttataacaccaaagttaaacaaaaaacgccttaccatacccaagcaaacgaatacaccactagtcgaattaaatggactaatggttctacccctcagctcgtaacaactgagacgcgctggcaatatcgtaataatttttataaagtcctatatgcatggtcaggaatgaacaatgcattagttaagcgaactaacgtgttagaatatccacgaatgtatgttaaactcacaacgagtcaggcagataaacttgccagagttgctaaatctgctacgggtgccaaattacaagcacaagcagcagaacaaggacgcgcttttgttacatcaaaggttcaagcagcaatggctaagaatcctaacatgactgctaaacaaattcaagaagtatcagcacaagcagaacaagaatttcaggcccaaagcgttcaacaaattttaaaacaagttaagtaaaaaatagagactaagagaaaaagcaatctctcctagtctctattttatatttaatctaattcaaaaatactggtggcaattctgaggtaaatgtcctttgtttaagggtaaagggatcgttaaaactaattttacttgcatgaagcaactgatgatcatacttactagtatcgccgccataaagatggtcaccaattaggggatgaccaatagcagcaaagtgaaccctgatctggtgtgtgcgtccagtgtgaagtcttacccgtactcgtgtccattttgcgcctcgttcttcaacccaatactcggtcaaagctcgttgcccattctcgtcaattacccgtgcagcctgcccatcctttcttccaatcggcttgttaatctcgccatgctcgtccataacctgtccttctactaaagcggtatattccttcagcatttgatgttgctgcacttgctgactgatcatactggaagcgatatgatgcttagcgataagaagtaatccccccgtaaagcgatccagtcgtgtaattaaatgagggcggagatctgcagaattatttgcgattaagtatccctttacccgatttaaaaccgtatcattttgaacggttggtcctgggatagaagtcacccctgctggcttatctactaccaaccaattatcatcttcataaacaacatttaagggctcattactactttcaacagtatcatcagctaattctggttgagccttaatggttaaaggttgattaggaagaatctgggttgttggccgtaccttccgatgatcaacaaggaattccccttcaccgtttttaagatcgttaaataaacgatgccccatccccaatgactgaagatacttctttattttaatcggttcggttcctcggtatatccacgtattttccatcttaatttcctccatcaacattgaaaaagatacaaaaaaagagctgatgacctaaatcacagctccttaatattgaacggtccgtacgagactcgaactcgtgatctcatccgtgacagggatgcgtcctaaaccaactagaccaacggaccaacttgacaacaaataaaagtatacgagatttatcgaaattagtcaacaaaaatttgtgatttatttttgatttttcgtttttcctatctataccgtaaaaattatcaatagtttataatgaaagtactagctattattaaggaggagtttttaatgcagcagttgggcaagcgcctattaaactggtggtctaagtattcaaaaatcataaaagtagtgtttgtaacctcagtcctagtctttgttattctcgcgttaggtaacttttttaaaacagttaaatggcatgaagtaggagttggtttagcaaacctgtcttgggaaagtatcatcctgctactaattacgggatgcatcgcagtcatccctatgttggggtatgattttgcaatcactcatttattacccgggaaatttaagaaatcatatattatccgctgtggatggattactaatactttaacaaatattgccggatttggcggaattcttggttctactttacgagcatacttctatcgaaagaacgcaactaagaaagagattctacttgctatctctaaaatcgctgttttcttactctctggtttatctgttctttgttgggtagctttgatcatcatgtttgtgtttcacgatggcggccacttcaaccaatacgcactttggcttgtggggggcggattatattttccaatcgttttttattttactgttattcataatagtaaaatatttaagaatatcacgcccaaagtagggacctttttagtcaccagttcaacttgtgaatggctatttgtagcactttttttcttactagtcggttggtgcttaggcgttcggcatagccttattagcgttctgccattatacgttgttgcccaagttctcggggttctttcaatgattccgggggcacttggttcgtttgaccttttaatgatgttagaactgtcattacttggcgtttcccaaactacctctgttatttggttattactattccgaattttttactacatcgttcccttaattattgccggattcatgttcttgcactctcttgcatcccaagttaaccagtttttcgacggattaccattgctaatggtccgcaaacttgcttactatttaattacaacgtttatgtatgtttctgggattctgatgcttattactgcctcaattccagacatcacagcacaaaataagattatcgcgaacctttatccctataccttcttcttcctccaccaattgacaaccatcttatttgcactggctatgcttgcctgtgctcgcggtcttcaatcaaaggtgaaaaaggcataccttcctactttaatattattggtaattggaattgctaataccatttggaacctgggaacattgagcttaacaatttacctcgtcattgttttgatacttgttttactctctcgccatgtgttataccggaagaaattggaatattcaattggaaaattcgcaattgatagtcttatctttgctggagcatgtatcctctatgtaattgtcggggttattaatgctcctcaatattccagtaagcaccacatccctgattttctatttttccctggtgaaaagatttggatttccggacttttcggattaatcctcggcctcttattaattttcgttattctgcgctactttatggccgggactgatcctttcaatattccaaacgtatttgatgctgaacggatccgcaatgttattaaagaatatggaggaaatgaaactagtcacctcgccttcttaaaagataaaagtatctattattacagtgttgacgatcatgataagctctttttcatgtatcgccgtaaatatgatcgcttggtcgtaatgggcgatccagttggagataaggatagttggcgaccagctcttcgacaatttgtcttagaagctgataagtatggctatcagcttgtcttttatgaagtctccagcgatatgacaatgcttcttcatgaatttggcttcgactttattaaaaccggtgaaactggccttgttaagctggcagactttacgcttgctggtaagcgacaacgatcacaacgagcattgatgcataaatttgatcgtgaaggctataccttctctgttgaaaagccaccatttagtaaagaattaatgcaagagatgaaacaagtctccgatagctggttaggaaacgaaacagaaaaaggattctctctcggtttctttgactcctactacattaatcaagcacctgttggcattatccgtgataaagacggcaaaatggtcgcctttgcaacgtttatgccgacagggggtaaaaagattttaacaattgacctcatgcgtcatagtaaagatgccccttctggaatcatggataaaattttcattagtatgttccagtacgggcaggaaaacggttatacctactttgatctcggaatggcacctctttcgaatgttggcgaatatcaatttagctttattgaagaaaaagctgcacacttcatctatgaatatggatatcatttgtatggctttcaaggattacggcgatacaaagataaatatgcgacagtttggtattcacgttatactgccttccgcaagaagaattcaatcattgccacaatgatgattctagttagtgtcgttaaccaacgtgttgatcagcaaaaccaccgttcaatcttctggtggttgattaaataatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactgtgtgcagttcgccagtagcccttgcgggtactagcgaagacatatgcatcacgctgggacagccccagcttctgtaagttagttaccttagttttaagcttcttccattgcttccagatatactgtcttattcggaccctcaaccacttgtcaaggcgttgaataaagtcagttagttttccaattgagtagtactgaagccatccacgcatttttcgctgaatttcttcaaacattcttgtcagggatattccacgattacgtttagttaataacctcaatgctttctttactcgttgttgcgattgtttagctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttgtccaactcatttagatagatgttcgccagtagtggtgacaatggccctccttgtggggttccttttccactcttagcgaaaagcccatggtctaagactccgctagttagaaacttacgaatgagtcttagtgtccatgggtcatcaatatattgttggagatacttaatcatcaagtcatgattaacgttatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaactccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcacagtggacacccttgtcctcagctcatggttccgactactacggcccatagcggactctcaccgcctagctaatacccatgccgggcgcacatgttaagagggtgaggaaaaacttttccgtttttcctcaccctctttacttttatcgcctatttttgatccattaaataatcatatagcatctcatgcttaatcttatcagtgttgtatcctaatacctctgcaatctgataagcaaaggctaaggcagttgcaggtccacgactggtaatgatttttccatcattatcaacaaccgtaatatcctctttaaaatttgctgttggggcaaccttagcaatttcctcgttaattcccgggaagcaagtatagttatgattatcaagcaacccataccgagccaaggcaatcggagcagcacacattgcggcatcccacttattttctgcattgcgtttttgcatcaatttcatcaacttatcattatcgcgaagcttttgggcaccccgcgaccaccaggaaaggccaccacatcataattgaggagccgatcactcattacctcatcacaagttaattcaattccatgagcgccaggaacatgaagatcctctaatccgaccattgtggtttcaatcctcattcgccggagaacgtccacaattgtaagtccttcaacttcttcacaacctggtgcaaacactacagcaactttagccaaaatatcaccccatcaattattaattgttgcaactacccgtttcattacaccctttgcttctggaatttgataaagcgggtaaatatgaaacagtccacgaccagtatatgagtttacagtgatcccagcgttacgcaatttttgaacaaacaaggtcacatcaggatatagtatttcccttgtccctacaaaaacagtcacatcgcgcaactgatcaagattcccatataagggacttaagcgatagtcttgatgatctgtatcaccggcccacatcgtaccaatttttcgtaaaccgttcactgctagtgtaacatctttatcctcatatttgctaatgaggggatttgtgaggtcaaggtcaagccaaggagaaaatagaatgaggtgaccaggctgtggaagcccctttttaccaagatattcacaaaagccagctgctaatcctccgccagctgaatcgcccataatagttactttactagcaggcataagggtataaattttactataaagactagcaatttcttgataggcggtacggaaagtagcatgcggaactaacgaataaatcgggacataaatcttcgcatccgtggcgattgccaaccgatttaaatattgccaatgagtcttatcgggacgctgaatataggctcccccggttagatacatgattactcgttgattatctccgtgatcatttaagacatatgttgttacttcctgttcttgacgctgaacatcaaccgtcatctcagcagcaggtaagtagtaatcagcttcattgtcaatccatgcattacccactaaggcattaaatttattattttctgcaagatcatttttaaacccgcttaattgaattcccatttcagtaaaggttgctttactagaacgatgagcaccacatcgccgtaactctcgcaaactattctcaagattattagccaaatgactagcaatttgagtattaaatttttttattttctccactgaaacgatcgctcctcatttaaaatcttactattatcctatcatgatttaagattttgtgtctttaagattacctaaagccattagctcgcgttgatgacaatggttttgccagcctaaaactacaactaaaattaaggcaataacgattaaaattactgccgcaatgataatgtcgcgatacccattataaagaatcatacgcagggttggtaaaagcttatctggaagactactagcagtttgggcatttgataatttatttagcattcttaaggtaattccgtggtgcgtttgaacaccctggaatagctcttggttaagaataactccatacaccgcggacataagggtctgactcaaaattcgcaataagtatcctagcgaagtagcaattggtacatcccgtaattcagcatctgtttgaacattaatctgtaaaatattaaagacaagaccaacaccgaatccttcaaaagcacccatgaataaaataagccagaatggtgttttttgccccccaatcattattcctaaataagcaataaaaattgaggctgccccacaggtaacaatccagtattttccccatcgctcctgcaataccggtactaattctgaaccaataaagttagtaaccgcacctggaatttgcgtcattccgccaagcagcgcacttaaacctaaaattccctgagcccacattggaatataagtgacaaatgcaataaatgaaccccagattataacgaataaagtaaaatcaattaccaattcgcgatttttaaacagacggctaggaacgattgggtcgaccgccttactgtcaacttttatcattccgccaagcaataagagaccaacaactaataaacagcccactactaagccagaagctgaaccaatcaattgaacagctactaaaattattactaaactgactaccagtaaagttgctccaagataatcaactggcttacctgcagcttgctttttcacattcttatagaacaagctaatgatcgtaatcgcaattaaggcaatcggtacattaacatagaaaacccagtgccaactcaacgcgtcaacaatccatccaccgagtagaggaccaataatcgaagcagttccaaaacaagcactggcaattcctaatacttgggctcgtttttttaggttgtcgtacaattcagcaaaaacgataaacgggattgtattcattccgccagcaccaattcccattacagttcgcgcaataataaaccataaaatattaggggctaatccttgaaagatggctccgactaaaaacatggaggtagcagtaatataggcttgcttatttcccttatgctcaccaaacttactccataatggggttgcaacagccattcccaaaagaaaagttgcgatgatccaccccatatattgcaacccatgaaggtcactggtaatagctggcaaggccgtatttacaatcgtaccatccatccccgccatgatgttagatagtaacaacgcaccagtaacaattgttcgtcgttgttgtaattccactttttcatctcccttaattctctacgtactaaagaggatggaacagagcatcaaagtgcgttgtcccatcctcttgaattacaaactgtttcccattatacgacctttgtcacaaaaagtataatggttattttttcattttcttaatgtcctgccctaactgttgccagtcagctttaatagtaggctccaatcggcgggcatagagtactgcggccggatgatacatcggcataatccaatgcttatcagtcgtcaactcataaccatcatgcgcatcattagtccgttgaatcttttcgtggagaagttgcccatgaagcttaccaatattggcctgactaccaagcagccgttgtaaagccgtattgccaagcgtaacaataattttcggcttaacttgagccagttcccaatcaaacaaaggagcaaatgctaagacttcttttttagttggcgtccggttaggccgtttttcaattacttcacctgtcttcttatcaattgccttcttaatactataaggccgttgacgaactacactagtaatataaacggttgaacgcgagtatccaattgattcaatcaatttcatcagttcctgaccggaagcaccagaaaaaggaatatttaccttttcttcgtaacgaccaggagcctctcctactaacatcaaatctggattaagcggtccttgacctggagtaaaacctgttaattgccgatccttcgtttttccttttacctctgccagtagcgttggcggatattctgcaatcatgttcgtaatctcctatccattatgtcgccacttagaatctgtaagaatacgagcagcgatcaatcccattggcaagaatacaacaatcataagcgccttggtcatccaaagcgttcctacactaatcgaagttaaaccgatattatacattgcccgatacatatagagtcccgggaccataataacaatcgacggaaccgtgattgaaatttgtggatattggattttacgtttaacaatcgatgccaataacccggcaactaacgcccctaaaaatgcggctgcccctgccggtattccggtcaagtccgttaattctaagcgtaaagtattagcaatcgccccaatacaaccggcaatagccgccattttaggcgtactgttaaacattattgagaagccaaacaccccacaaaagctggctggcaaccggagtaaaaagagcattaatgcagatagcggcaatgcttgaaaattctcaggacgcaggttaaccattaatgctacaatccacccgaccaaggtagcaactgtaataattgcgattgcataggtcatccgttcaagcccggaccgcatatcaagttttgaaatatcaaggccactagtaataaatggaaatcctggaataataaacagcattgcgccgatataccctgcttcatgacgcgaactcacattaaacgttaattgcatcaaacttaaagccaacaggtaagaaaggcacgcaactgcaaccgcaaccgctactcccgcaaataaggtaatgtgatggtcaatcatcttacgacggacatagtttccgaggccagccccgataaaactacaaaacatttcaactggtccaccaccgagtaaaaagacgaaggcgctacatgccagagcggctgctaatcctacttggtaaggagcgtaattcccttttgagtgggcaatttcctccaaacgggagtgaatttctccaattgtcatctcactcccatgctggtcaaattctttaataaatcgttccatctgcgaaagttttgtcgtatttacacttgtgcttggcaaagatattgcctgcgtatagctatgatgggcatccatacaggtatactcgagggaaactaacccaatatcgaccgaacaagtcatttttagcgtccgggcaactgtattcattgaatcacggactcgccatgcccctgttccataagaaagcatcattaatccaattcgcccgacaatcgctgctcgttctactaaattagcctcatacgcaggggtgaaattatcatttgtaaaaaagtcatgccatggaatcgccatatgatgcttatcagacaaatgttcagtcggctcaaaatcattcgctgagatctctttatccttactcaaaacccatcaagctcctcttatcaattctcttaactatttaattatacggcgactgtcaagcgacgggagtaatttcttttaatttagtgattagttgctgctcatcatcgcttaaaatgtaatcctcccgtgtagcaagcgaaataaaaaatttttccggaattgggtctttaatatcgagggcgacaattcctggttcatcctttaccgcatctttaaccatcaaactaattcccttattttgccgtaccaactctttaatccaggaaacatttggcaccttataaattgccgtttgtggattaatttgggcataggtagaataggtctgaaaggcagctttatgcacatattgttggtcataattaataaagatttcgttagttaagtcttgaaaactaaccgcctttttctttgcaagcggatgatcagcacttacgatgatactaaatggtcgcgtagttattaattccgcaaaaatacctgcttgatcaattggtgcaattgagcccaacattgcaatatcgatctttcccgcttgtaattcacttagcaattcatgagatcccacagaaacgatttttattcgttggagaagctgcttagaaagattgccaataatgtgtgaaatatacatttttccaatgattggcggaagaccgaattttatttggcgttgatcggaccgtgctatttcttgatgagcaatgtctatttttttgtttatcgccaacgctttttcatataataactgcccactgcgcgtaatcatttcatccctatgaacacgatctttgcgcactaattttgtgtcaaattcttgctcaaggcgacgaattgcctgggtaatactaggttgagaaacattaaaatactttgctacttgcgtataattttttaatttaactagcatggcaaagtattgtaaatcacgagtattcatcgtcttaaccctttctatgtcgaaataatatctttatcttacgtcaatttatacttgaatacaaaagaatgttcgcaaaagaaatcaatcttttcaacaagacggtcggctaaactatcttcatgttatcttgttatttaaaataataaggctggggaatttttcatttctcccagcttccgcactaatcttaagctattcaagtaaatattaaattattgatgttcttttaagtaattgtccattattttattaaatttgtttgcctgttctgccattattacatgaccactttgatcaacagcttgatgcgagataaactgtggattagcttgtctcataacatccgcaaatttaccattaaaatatggactttgatttgcggtaactaataatgttggaatattaattttttcaagtgttaatcgccaatcccgtttagcgtgatcatagagtaagggaagattttcggccctaataaatggaaacatttctttttctggctctaattttgatattacttgagatggtaccccatttaatgtctctctaacattaccatgctctttcaattttaatttatacgatgcccttgtgatatccatatatccataaggccattgaaccgtattaaacatctttggagattgatcaattgctattacaccacttaacggaaaatcagtataatatgataaaaatccatatattacagatgctcccatagaatgccctattagaaaaggttttgttacattcaaatgatttaatagttcatacaaatcctttattaaaggctcaatagaatctaactgctcatctctagttgatgctccatgatttcgctgatcatacgtaattacttgataaccttgctgaattaagtttttaatttgtaaacaccatatttgttgatagccgccaaagccatgaattaaaacaactggtttcccagtaccataaacatagtaattaattcttatcccatcacttgttttgaagtccatcaggtaaaccttccttcactaaagctaaaaagatagtaactattaataaatcagcagtacctccaaggcttaaattttgctgagtaaatttttcttcaatttcagttaatttttgttgcccagctttagtccttattccaccaagatttaaacactctttaatttctttatttttccattcttgaatagccggatcccccgctcttttaattaaggtcgaatcttcaatatgtaaagctaattctaaaaaagttattaaaattcgactattccaatcatagtttgatgttaataaggtcggtaacccatacttaaaaaccgtcgggtatccagcgtgtgcttctcctcgaataccagaaaggccgtattttaaatattgtttctcacccgcagttagaatttttttcgatgaaagatgttttagatcatcattaatcaaattttttaacatctttttaatcacgtttttaatatcatttgcatcaaatcgttttagatgctgtaagctgtaggctgttgctgtaacaaatactcccaatgaaaaaactgctcctttatgagtattaacattatttgtagcaacaaacattgttttctcagcttttttaccatattcacgtaacttttcaaatatcaatgataaattagcagaacgactcattattcccagtaatgctgcttgatgaagatagttacgcaaactaatagaactattaataaacgtaaatatgtccatatctaagtgtgctccatgttcaactggatccactaatccgggcttaggccaagcagatacttcatataaaagagctcgctgtgcaagttgagttaaccaatttgcaatgttttctttttcttgatataccaattctacgcaaactagctgactaactttttcttgtaactcttcaaccgaatgtcgacgggagcgaccacattctttagctgggcgaccacaaattaaacactttctagcaggttgatttacatctgaccttgatagtgattttattgttccactatcattagccagcacatctaagtcaaataaacgataacttggcttcaattcttcaaaatgacttgtaatctcttttactaaaattgctcctgtatcaacaagatagaagcgttctggaccggttttcttatccagccactctttttttgaaataaaaacaattccagcatctaataacattttttcaaattcattgagaccagctataaaaaatgactctatctttttattattctttattggaccaggaatatttaatttagctgctacaacagtcattgatggattagttttcaataactggttttgtatttttacacgctcatccttattttttaaaacggcaagaatgtcttggtattcaccgtgatcaaaaatagtttgcatactaactcctcaaatcaaactttaacattaattatagcaataatgggtataaaaaacggtactagaaaattccagtaccgcaatttctattcgtaattagtccttaatttgtttaatttcatcaattaaagtaccatcacgatattcaacaagtgcaactgttcgatcagtatattcaatcttttctggcttaccaacaatcttttctgcacgttgttgtaattcttcaattgaaatcaatggaatacttggcacattcttgaatgcttcaattaaatctttacgtgcaggatttacagcaacccctacttcagtaacaacaacatcaattgatgaacctggggtagttactgaattaacagctggtacaattgttgcaatccgaccacgagttaatggtgcagaaataattgtcatctttgcagtaccagcatcttggtgtccaccaacagcaccacgaatttcaccattagatccagttaaaacattaacattgaaatcagtatcgatttccaaagcagaaagaattgcaatgtccagttgatcaaccattgctcccttgttatcaggatcagcataccatgatccgtcaatttcaatttgaccaggattactcttcatacttgaagcagcacccttgtcaaaatcttgaacatccataactttctttactaatccctcttctaaaagtttaacgattggcgaagtagttcccccacaagtaaaggaagcagtaatgttgttatcaatcattgcttgacgaaggaaacgggtaacagctaaagcagctccaccagtaccagtttggaatgagaaaccttctttaaagtatggagaatttacaattacatcattaaccatctttgcaatcttcaattctttaggatccttagtgaaacgtgttgcaccactaccaatacggtctggatccccaactttatcaacttttacaacgtaatctacttgtgtttgttggattgatgcaggcgtattaggataatcagcaattgtatctgttacaagaacaactttatctgcgtacttggcatcaactaatgcataacctaatgatcccaaagctgattcaccattcataccattagcatttcccattcgatctgagttaggaacaccaataaaggccacatcaattttaatgtttccattttcaattgaacgtgcacgattaccatgtgaacggaaaataaccggattctttaataaaccgtgagaaacggcttctccaagacttccacgcataccagaactagtaatgttagtaattgtaccagccttaatagcttcgattaccttatcattcattaccccagttaacgatgatggagccaaggttaagtctttgtaacccatcttgatgattttatccataaccatgttaaatacaaagtcaccattacggaagtggtggtggaacgaaattgtcatcccgtccttcaagttattcttgataacatcatctaatgaatctactaacttatcgtcacccttggtaacacgaacatcatgaccagtatagtgaacaattggatgaccaatttcagtagtttcaaatggcttgtagtttgttgaatctaaaattttatctgaaatttcgcgtccgactttatttttcaatgtattcgccctcctcattgatcaagttagaagcctttgctaaacgaattacccgttgtgcacgtaatacaactgggcggtcaaccatttgaccgttcattgagataacacctgaacccttttggtgtgcttcttcaattgcagcttcaacgtccaatgcattttcaatttctttcttggttggttcataaatcttatttacccaatcaatttgacgagggttaacaagagatttaccgtcaaatcctaattcgtgaatgtgttcagtctcacgtttaaagccttctacatcattcatattagtaaagacagtatcaaaggctgcaatgccagcggcacgtgctgcgtgaagaatcatgttacgagcaaattcgagttctgctccatctgggtaacgatgagtcttcatatcagtcgtatagtcttcagcagaaagtgccaaaccaatcatccggtcagtacttgcagcaatttctggtgcattaagtactcccttagcactttcaatagctgccataacatgcgttgttcctggcttaataccaaatttgttttcagcttcttctactacttttacaagatctagcatcatttgagctgattctacttttggcaaacgaacaacttgaataccagcttttaccattgcgaaaacatcattcttaaaaaatggtgtatcaattccattaacacgaacaactaattctgaatcaccataatcttgtgtttgaagagcttgataaactaacatccgggcagcatctttttctgccattgaaaccgaatcttccaagtcaaacataatggagtcggcaccataaataccagcatcctttaccattccggcattgttacctggaacaaacatcattgtccgacgtaaacgttcttccattattaaaatacctcccagtctggttgatctgctgtatcaagagcacgttgagcagcagccattgtccgtgctttaattacacaatctaaagctcctttatccacagctttaacattggcattatcaattccataagcagttaaagtatcagtaatcaccttacgaatttgattaccataaagttcttccacagaggaatctaagtcaatgttgataccattattaccttggctcaaagtaatttgaatatcggaagattccaaagttcctgctaatgcagtcttcttaatatccattatttaatacttccttcctttatccgagtttgaagctcagaccagttgtttttaataaattcgagcgttgtatctggaacatacttttttactaactcaatattatcattagcaattgctgctcgtaccttcgttgctgaaataatatcctgatccttgtttttctttcgatcaataatctttacttcaacatcaggtggtagaaccctatttaactcttcattatatatatttgttgttttggaatatggttcattcccaagatatcgagatgttatattaagtggttttgcaatttgttccttaaaaagggttgcatccaaggaagcttgaaatcttccaacattttgatcatcttttaaaaagtatgctggaaacgtagcataactaaccatgtattccttacctggtactactataacatttggtaaatcagccactccagctttaactaatttaaagcgttcagaaaatgaaaaaatagaaacatcttcactaacaacgaaaacatacacatgatcattttctttactagcagtttcaactaggtaacgatgtccgtttgtaaaaggattggcattcataactattcctgcaatcttactttccttttgatcattaaagttcggtaaagaagaaatatagtcatgaatatcaggagtaccactttctaatacagttccttgttttacttttgctaattcatgaaatccaacatactggaaactttgactatattgtggtttcgtaaaaacaaacaaatgaaagcgccccatcattgcagcttcgttttctaatttactaaccaaactgttaaatgtttcaccatgtccctgaacttttgaacaaattgcaatatacttcaatacattaccagcaattgatccagttgctaaaatctcaccattttcttcccatacaaaagtcttatcaatagaagatgtttctttttcagaaaaaacttcaattccattgaaccgcaagaacttttgccacttggtcaaattgcgttttaaatgaatgttaatttcacgaacttccattaatattctcctaatcgttattcttttgacttgcataatgttgaacagctttagctactgtatttactacaccatcatcaaatactccaggaacaattttttcagctgttggattagaaatcatatttgctaatgcagaagcaattgctttttcaaggccgaaatcgactttatttaaatcagctgataataatcctttatataacccgggaaataccaaaatattatttacttgatttgggtattgacttgagccagttgccattactgctgcatctgcatcttttgcaatttgaggatcaatctcaggctttggatttgcaagtgcaaaaataattggattcttagccattgtctttacttgttcacttgttaaaacatctgcatcagaaagaccgataaaaacatcccgatcctttaccgcttcacttaaattcttataaggagtttgatcagcactttgttttactaaatctgtttgataatgattataattttgactatcaacatgcactggtccatcaatatcaacaaatgtaatatttttaatacctgccgcaaaaagtaatcgagctgttgcaactcctgacgctccaactccattaattatgactttcaaatctttcagatttttctttactactctagcagcattaattaatccagccaaaacaacaattgctgttccttcttgatcatcatgataaactggaatattaactactttagacaatttctcttcgatttcaaaacaacgaggtgctttaatatcttctaaatgaaaacccgcaaaagattcctgcatattctttaatgttgctacaaattcattaacaggaacttgctcaacagttaaaggtagtgcattaacattagccaaatccttataaagtaatgctttcccctcaacaactggaagaccaccggctgggccaatgtttcctaatcccaaaacagcagagccatctgttactaatgctacaagttttccactaagagtatatttatcctttagttcgggataacgttctataagcttagagattatcgcaactcctggagtatacgcttcacctaattcttttcgatttttcacttcaaattgaggtgcaatattaagtactccttggttcttagcatgcattgagagtatttctttatcttccatttatcgaaagcctcctcatttcattattaatatcttaccacctttttaaaaaaattaaaataattactgtattttttaaatatttaaaaaataatgatatacttaaaacaacattgagcatgaaaggaataaaaataatgaactcacagcatcaacaattactcggtaaccttgcacaagattattaccttagcaaaatggcaattagtgatatttctaaaaaatataatcttagtcgctacctcattatgaaataccttgatgaagcattttcaagcgggattgttgatataagcattcatacagattatgaccgaaatgcccaactagaacgcgaattatcaaatagttttgatataaaaaatgtctatgttattaaagatccaagcaaccccttggaccgcgataaaatcattgctaactttgcagctaatcagatccaatctcttattaaagaatataaaataatcggattatcgtggggggaaacaatttatactattcttgatcatttcagcaaacactcttcccgcaatttagttttcacacaatttatgggtgaaaatatgaaatataaatcttctgccgcatcaatgcgaatggtacaaaaagctgcatccaaatatgattgtccttattacaccattcccggaccactttatattcttaatgacgaagcaagaaatgacctatattccgaaccggcttttacagaagcatttaaggttgccaataaaatggaaatgattgtttgtggattaggcactctccaatcaatagacagtatccctgcttggcatgattataaaaagaggttatttaaaggagttagtttaaaccaaattgctggaatggcatttggtcgtccatatgatattaacggtaactttctaattcatcccactaacgataaaactctctctatccctttaaataaaattcttaacgttcctatacgctttgctattgttcaacgcaaatcaaaatatcaagccgctttaggagcccttcgtggaggtttatttactgatatgatacttacagaatcaatcgctttacgaattattgaagagttaagataaaataaaaatccgaattcccgttacgagaattcggattttttatttacttcttctaccaaatgccaattaggcgcatccagaaggttccaataataccgtaaacaagtaagtagaagatacctaatataaagttcatcttccaccattcgctctgagtaacgtaaccagatgatgataaaatcgaagctggtccgttagcatagtgagtagtagaacccatgatagcagaagtgaaggcaaggagcattgcagttaacattgctggtgctccagcagcaatcgctacagaaacgaaagccgtgtacattgcagtaacgtgagcagtagcactggcaaagaaatagtgagcgtagaagtagacaactactaatacaactaatacccaaatccagctaactccgtgaagggcaccttcaatactgttagagaaccatttaatgaagcctaacttagtcaattcactagccatgaatactaagattgaaagccaaatcaatacattccaagcaccagattcgttcaagacgtccttagtttccaacacgccagtaataagcagaagagcaattgctaagaaagccacaaaagtcgcgttaatagcaggaataaaactagtcaacatccataaaacaagagtcaataagaaaataagccccatgagcttttcagaaagcttcatgctacccatcttttcaagttcgctattagcccaagtcttagcgtttggtgtttctttgatttctggtgggtacatcttgtagataatgtatggcacagcaattaaacaaagtacactaggaagaactccggctacaaaccatccaacccaagtaatattaatgtttaatgtcttagctaaggcaactacaaccaagtttggtgccatagccgtcatgaaggttgcggaagtaatcaaattactgtggaattcagtgaaaactaggaaagaacctatctttttccgagtacctttctttgggtcagacccataagtttcagctaaggacttaataattggataaactaccccaccagcccgggcagtattacttggaatggctggtgaagtaaccaaatcaattcccataatggagtatgctaaccccaaactatgttgcccaaaactacgaacaaagaccaaagcaattcgccgacctaatcccgttttaataaaaccacgggaaagtaggaaggccattgcaatcagccatgatgacgaattttcaaaggcctttaatgcctcttccatcggtacaatgccaaccaagaccataattgtgaacccaactaaagtcgttccggcaatcggtaacggctgggtgatacatcccacaatcgttgctacgaaaatagcaaacatatgccaagcagccatagaaacgccatcaggacggatcggaccgcagaaccataagattaagccaacagcaacgggccatgcccatgccttagctttaaatttagctaatcccattatattaaaccctctttcaattaattcttaataaccacaccatctaagacatctttcatcttagcagcagagtattttagtttttcgatttctgtatccgaaagtccgtaatcaacgactttttctattcctgttcgattaacaattgcaggtattccaagatacaaatcattaataccatattgtcccattaaaggggctgatattgggagcatgatattacgattttcaataatcgcttttacaatataagcaagatatttagctactccatagaaagtagctccttttccttcgataatcttaccaccacgttctttaactgctttttcaagttcgctatagtcctgagcagttaaatcagtaacttcttttaacggttttccattaatagtggcttcatcgaatgcaccaaacgatgtatctccatgttcccctaaaactaaagcatcaatttcatttactggaacatttaacttttcagataaaagtacattcaatcgagccgtgtctaatgaagtaccagttccgataacacgatgcttagggaatccagagagttgttgtgtcactgtagttaaaatatcaacaggattacttgatacaacaaaaataccgttgaatccactttcaacaattgggttaacaatagttgaaagaatctttgtgttccttgaaacaagatccaaacgagtctctcctggcttgcgtggaactccagcagtaataactacaacatcagcatcagcagcatcagaataatcccccgcatgaatgttgactggactagttagtggagtaatatcttgtaaatccaatgattctcctgttgccttctctttctttaggtcaacaataactaattcatcaatttcttgtgttgtttgaaggagtgagaatacgaatgatgatcctacagctccatcaccaacaagcacaactttatgatgatatcctaacataaaattttcctccaaataatatacaaataattgctctaggcagtttctcactgcccattatttttttactttaagccacgggcgtaaacagttacttgttgacctgcttgacgtccaaagacaattgtttctgcaattgagttaccaccaacacggttattaccatgtaaaccaccagcaacttcacctgcagcatataatcccttgattacatccccattaccatcaagcacttgagtctttgtattaatatgaataccacccatagtgtagtgaattgcaggtgcaatatggattgcaaagaatcctggcttagtaattccacgatccattcctgttgtccgatggaattctttatcgtcatgattttcaacagcttcattccatgttgcaactgtcttctttaagttctcagtatccatgttgaggttctttgcaagatcctcaatcgtatcgccatgaacaacaagaccaactttatcgtaaaattcaattgccttagcatggtcacgaataccttggtcaaaaattaagtaagcactgtgttctggaagggaagtaattgcattagaaacaatctttcgagtgtttaattcgttaacaaaccgattaccttcagcattaactaagattgcaccttcaccacggacagcctcaccaataaggtaaacatgaggattatcttgttgaacagttgggtgaacttgtacaagatccatttgcattaattcaccgccaacgccttcagcaagcttcaagccatcaccagttgctcctggttgattggtagtcttgtaatcagcaaggtcagggcggaaccgcttcatgtattccttagaagcaccaaatccaccagtagctaagataacagcctttgcgtggatggttttaattaggccatcagcattagcttcaacaccgattaccttaccctcatcatcttgtaagagcttgttaactttaaccttattaaatactggaatgttttccttttgaacaacttccaataaactttttactaagaaaccaccaattggcgccatacttgctggacggtgagtacgcttacaagacattccaccagtaattgtaatgtcatcaagcttaatcccatgatcagctaaccagtcgattgctggagctgtgtgatatacaaagtaacctagcatatccttgtcgtttagacgtccaccatcttggtatgtttcgtggtagaaatcggcaacgttatcaattactccatgttgtaattgcacattggtttcagcggcgttcattcctgaagaagcccggttagtatttccaccaagttcttcttccttttcaagaacgaccgtcttcattcccaattcgtttgcttgaattgctgcggaaagacctgttccaccagaaccaattacaataacatcgtaatcattatctaatttacttacagataatggttggaatttttcagccatgatattgctctccttttaattatatttaaatgtattaacagtcaaaaagagtggaacaagttctttttattgcttatttccactcttgccaaaattggcattacttttaactcaattcttatttatcacgatcaacgttggtcatcttaagcatgtccatccattcatcgtattgttcttccgtaagcttaccagacttcaaagcagcttcttttaatgtgctaccagctttatcagcagcttgagcaatcttagcactgtcatggtaaccaatgtgtggtgacaaagcagtaacagtcatcaatgaattatcaactaattcttccatccgcttttcattaactgtcattccgtggatcatcttgtcagcaaatccagtaattgttccagttaataagtcagctgattcgaggaatgcatcgattaatactggcttgtaaacattcatttcgaagttaccttgtgatgaagccattgttactacagtatcgttaccgaatacccgtaaagcagccattgttacagcttctgcttgagttgggttaaccttacctggcatgattgatgaacctggttcgttagctgggatatttaattcgccgtaaccagcacgcggaccagaagctaagaaacgaatatcttgagcaagcttgaacatgtcagctgctaatgtcttcaaagcaccgtgaacaacatctaaaccagagtggttagctaaaccgtagaacttgtttgaatcagcagtcaagtttaagccgtaaacttcgctaagcttttcagcaatcttttcaggcattccttctgcagcattcaaaccagtaccaacagcagtaccaccaattgccaattcatctaatgttgattccaaagtcttaatgtaatcaaggtcatgttctaaggaagcaatgtaaccagaaagttcttgaccaaatgtcaatggaacagcatcttgcaagtgagtacgtccaactttaacagtcttcatgtacttctcttccttaacctttaattcatcaattaaatgttgaacagctggcttcaacttatcaagcgcttctaaagcaactacattcatagcagttggaaatgtatcgtttgaactttgacccttgttaacatcatcatttggtaagatttcaatgtcagggttaatttcatgagccttgtgcgcaacaacttcattagtattcatgttggtttgggtaccagaaccagtttggtaaacctttaatgggaagtccttccgcaattcttcatcacttaatgcgagtaattcatcaatcgccttaacgattaaattacccttttcttcagagatagctttagtttccatattagcttgagccgctgcctttttaatgttcaataaagcacggataattgctaatggcatgtattgaccggttgggaagttattccgactccgttctgtttgtggtccccataatgcttcagcagggattttaacaggacctaacgtatcttcttcagtacggtattctgacatctcaaaaacctccaatatattaattgagcaattttgtcttgtgaaatgttacacatcatttacacgtatatcctaccttgtaagtaaagctatagtcaaatctttaattttcaataaatttcacttatagctattgccttgccaactgttataatagcttttttcaattacgtttgcaaaagtttcacaaacttcgatacaaaaaaacacctaagattttttaatttcttagatgcttttctatttttgtctaataatctggttttattattcacaaagatgaaagctgcttgattaatattgaggcttccaaattttttctgctactacgctcttcgcatcagtaattccgtcgccggctaggccttgatcgatagcagattcagctactcgttcagccactcgcttagaaaattctgttaacttagaaacaggaggtaatacagctgctcctggtttttctgggtcaactaagccacttaaagcatgagcagctgcagcaagcatattatcatttaacactttagcttcagcagccaaggcgccaaaaccaactccaggataaattaacgcattgttagcttgcccaatttgataaacggttccattatactcgatatctttaaccggaattcccgtcgcaattaatgcctttccatcagtccatttgagaaggtcggctgcttttgcctctgctaacttagttgggttagagagtgggaagataacaggccgtagagtatgggctgccatttcctttacaaccgcttcatcaaaacttcctggctgagtggacgtaccaatcattactgttggatgaacagccttaacaactgcaagtaaattagttaattcatcagcattagcaaattcgcttcgttgacgggtaaatggcttttgctttggtgttaagccgggcgtatcgtcaaacaataatccttgcttgtcaacaaggtagaagtgcttctttgcttcttcgggtgtcaggccttgacggatcaattcgtcataaagcatcttagcgattcccattccagcagtacccgcaccaaatgttaagaatgtttgatccgttaacttttcttttgagatattcatggctcctagcacaccagctaaggcaataattccggttccttgaatatcatcattaaaggtcaaaattttatcctggtacttatcaagaatccgtgcagccgttccccgaccaaaatcttcaaagtgtaataaactcttagggaacaatccttcaactgcatcaacaaacttatcgatgaagtcaaagtaaggttgtccttcaacccgcttcatccgattgccaagatagtgcggatccttaagtaatttttcattattcgtcccagcatcaatagaaaccgggagcacttgggatggatcaatcccagccgctgctgtgtaaaccattaatttcccaacagaaatgtcaaccccatttacaccccagtcaccaataccaaggattccttcagcatctgtaacaacgataaggcgaatatcacgaccatcagcggcatcagcaagttcctctttaattaagtcaggatgctcaatgctcaaatatgcagcatcttgcggcttaatgtaacgttcattatattgctcaatcgcctcagcaattacgggatcatacacaactggcataaattccgcaatatgtttttccattaagtagaagaaaagcgtacggttagtattgaatacttccatcaataggtgacgttgttcaatccgtgagttcttagattgatataaccggtagatttcgtctgcctgttcctcaatcgttcttacacaagatggtaacaagcctaataaaccatacttttttcgttcttcaattgtaaaagcagttcccttattcttaaagggatcatttaatatttgcattcctttacgcaacattatcgcctatcctttaccttttttctgtttcaacattcttagagtaattccagcgctagtttatagtcaaatatatgctatgatataaataaaattgataataccccttataatcactgatagagaggcatttactatgaaattaaacggcctaaaatattatcaagcactggtaaaatataaaaatttttcgcaagttgcagcaaaattcaatgtcagtcaacctactattacaatggctatccaacgactagaaaaagattttgggacgtcattttttgttcgtgaccatgtccataaacaattgcatatcacgccgactggtaagcaattcgccattcacgttgacgttattttaaacgaattaaagattgctcaccaagaaatcaatcaagctgaatcatccagtattcgctttgggctgccacctattatcggcaattactactttccgccattaaccccgctattaatgcgagaaggccttttaagccacttggaaacctctgagcatggttctaaggaaattctcaagatgcttaaacacggtcaccttgatttggcattgcttggatcgcttaaccccctaaaggaagtggggctaaaaactactgaactggctgagtatccctttaagattattgttagcaagcgtcatcccctcgctgctaaaaaggagattgattttgctacgcttaaaaatgaacgctttattgttcctgatactgaattctttcatgagcaagcttttaagcaaatttctcatttagctcattttcgtccccaagtcatctaccgaaccgctgacattcacgttatcaaaaccatggttgcagaaaatcttggaattgcttatttaacaagtttggcgattaccccagaagataatatccattccataaatgttactagcccgttaaaacaatcgttccgtctgtcagctgttactcgttcaactgaattattaacagctcccaagcaaaaactatgggatctcttaactacaaaaaaggaatgacaaataaccgtctaatacggtggctatttgtcattcctttttattatttctctttttcaatcttaattgtcttaataataacgtctttttcaggcttatccatcgcatctcgcttaactttgctgatcttttcgacaacatccattccggataatacttggccaaatacggtgtgatggaagtcaagccacggtgtaccaccatgtttttcgtaataatcaataatctcctgcgggtatccaacagccttcatttgatcaatcatattttctggaacatgttcattagtgacaataaagaattgactgccatttgtgttcggaccagcattagccattgacagagcaccagtgaagttaaataattcttcagaaaattcgtcttcaaatgggtgaccataaatactttcgccaccacgtccggttccagttgggtcaccaccttgaatcataaaatcaggaataacccggtgaaaaattacatcgtcataataatttttctctgctaatttaacaaagttttcaaccgttttaggtgcgtactttggaaaaagttgggccgtaattgttcccattgtagtttcaattactgcttttggtcctttaacctcatccaatgataattggggatatttcataaaaaagcctcctcttttctcttctaaacctctctaactatcttagcaggaatatgaaggaaaagacaattattagtcctcactaacacgtaatacacaagctcccttaatatcgccatgtttaacatagcgtaatgcttcatcagcctttgctagtggatattcgtgtacttcaggatggatattgagacggtcagctaatgttaagaattcttccccatcacgacgggtattgctctcaacactcgttaatgtcttttcgtggaatatttctttttggtaattcatcattggaatatcagtcatatgaatgccagctaaggccaaagtcccgcctggaactagactagctaaggccggtaataccatatcaccaactggcgcaaagatgattgacgaatccaaaggaaccggcgcagggtcataggatccttgaacagaagcacaacccaattccagggcgaatttctttgcatcctcaccacgcgtaaagacatgcacttcaattccctgtgcaagtgcaatctgggccgtaatgtgcgctgagccaccaaagccatatagccctaggcggccaccagcgggaacattggcacgttcaaaagcccgataaccaataatccctgcacataataatggagctgcctctagggaatcaaacttttccggaagccgatatgaaaatccttctggaaccgtgacatattctgcataaccaccatcatgatcccaaccggtataaagtgaatgaggacagagattctcatgacccgagcgacaaaacttgcataccccacaagcatgccggaaccatggaatcccaattcgctccccaagcttaaatcgttgtgtttctggtccaaaaccgacaactttaccaacaatctcatgaccaggagtaacgtgttcgtggtgaaccggcaaatctccttctgtcacatgcaagtctgtatgacataccccacacgttaataccttaacaaggacttctccccgtttaggagtcggcacgggcttttcggtaaattcaattggtgatttcttaccatcaatcggcccaggagttgtgactgcccaagccttcattgttttcggaatagcattttcgcgtttttccatccttaaagacctcgattaaatatatatttcattctttattgtagtgctttttattcataagagtgccgtattttttcaatttgacgagaccattgatccttaaattttggaatgtttaacggagcattgatagctggatcatcctttgctgcttgagttaacccttctactcctccgatatcatccaagattccatttccaaaaccactaacaatttggggactgatatgagccggcaatcgtttaggctttacctcctcaaatctaattttaaagttccacatatcgccaaagtcatatattaggtcatattcatggtcaagattacaatcgcctacccaactttgggtaatatcttttgattgaccaaagccactatcaagaatcggcaactgatagtgagtatttccttgatgcagttcaaataagtgatgcccgtccgcgttaaagactgctaagcttgcaaagcacaacatatccaggcgcatatcaccgctgacggtaaatcgccgccacattttaggatgataatcacttagctcaacataaatagtatattgtttattaacatattggattgcatgctcgcgttgatttcttacttgccgctgcatatcacgaattatacgttgtaggtggtacatccgctgtttagaaccaagatcttttagcctctgactaattgcttgaacaaacaaatcgtagtcctcactagagaaaagatcttctgcccgtaaaaactttccaaattcgcgaaaggcatcacttttagaatgaaagccggtatcagtcggacgatcattatgtagtttttcatagttaattaaatagtgatagaccaaggtaatatcgtcaagaacagattcaccgagtgcctcacagtagccgatataatctgcagcacaatctaaatcttgatcaacgatgctctcgctctttccacgactttctaaataatcttgataatcatctaaaatcttttctccgaccgccgttgcattcatgatatcgttaattgaaagtgagcggtaaagatagcgacggttatgttcattaagtttagggtgagtaggcaccttaaagtccgtaactgaatagtcttcaaaaatatccattacaacatattcttcatccgttgtcttattggtaatacgtgtctgttccgctaattgaagcgcaatttcagcattggtcgggtctttttcccaatcaataattgaattaggccccatcatgaggttctgatacatctgcaattgctgttgagttactggctgaatttggcgtgtaaatactactttgctaaattgggcgtcacgaatcatcctaatttttgcatgaggaattggcgaaacttctaataaacttaagaattcacgcttaaataccgcaataaaagatcgtgagtcattaaagcgttgaggatagcgtacaataattggcaacgacattaagttattcataataatcatgaattcaccagtaacacgaattgtccaaacatttgtctctaatagatcagatggtgcaatcacctgtgaattaatatgcaaatgttgggcaagtgaatttcccactgcaataatcaccctatcaactcctcctataatttcgattatattaattttattttgaaaagcattatttatcaacttaatcaaaccatatttactgaaaattataggcagaaagcctgtgactttagtcatgggatgaatgccttccaaagcagccatgagactgctttttcttactaaaaagtctataaaatctcgtttctgcccctgcaaatttagtaatattaaagtataaaggaggtgaaaacatgaccacagttttgaaagggatcaagcttcgcttgtatcccaacaagcaacaacaagctcaactatgtcaaatgtttggcaatgaccgctttgtttggaaccagatgcttgatatggcaaaacaacgttatcaaaacaatcctagtagccagtttgttgatcaatatggcatggatgtattgttgaaacctttgaagcaggaatatccatttctaaaacgtagtgattctaccagtctccaagttgttaatcataacttatatcaggcctttcaaagattatttaagcatctgggtggttacccacgctttaaatccagacggtctgctaagcagtcctatactggtaaaagcaaaattcaaatagtggcgaaccgctatttgagattacccaaaattggctatattaaaaccagcaaaactcgccagttaactcattgtaagatcaaacgctatacggttagttacgatccgtcaggtcgttattacctgtcactacaggttgaaaccacagtacagccactatcgaagactagtcaacaggtcggcattgacgttggcgtaactaatttagctattactagtgacggccataagtatgctaaatttgacgctgtctggttaactcaacaggcgcaacattggcagtctaagtatagtcgccgccgtcatcaagccacggtgagtgtccgtcaatggaaccataaccatcaggacgtcaaagaggaactgaatgactaccagaactggcaacgggcccgaattcagaaagctcgctatcaacgacgagtcgctgatcagcggcgtgattacctgcataagctgacgatggcattggttacgcaatacgatgtgattgtcattgaagatttgaaagtcaagaatctgcaaaagaatcatcatcttgccgcggccattgccaacgctagttggcatcaattccgtaccatgctgggatacaagtgtgactggtatggtaaacagctcattactgtcaagcccaactataccagtcaaatctgtagtcattgtgactaccatagtgggtccaaaccgctcgtaattcgtgaatggacgtgtccaaagtgtggggcccatcacgatcgggatattaatgcggcagttaatattctgcataaagggttaaaagccgttggctagggactagccgtggtaaaagaacgaaattctgtaagttaggtatttggaataccaatgtaacagcctaaatactacttcgcgttcccagaaaccgccgactttagtcggtgtgtagttcataaataaaatagaagatttaaaataagacataagtattgtctctgaaaggatgcgcaacttttgatcaatcaaaatctcgatatctttgacttacgaaaaattcaaatcaataaaactaaagctgaattggaaaataatggtaaacggcagcaaaaagaagtctctagtgacatgttaggaaccttcatgccagttgatcgcgaccccgtcaagataatccagatcactgaagctaacatgatccccgagttgcttccattgcgccaccaaagaatgcttgccagtcgcttttcatttttccgtggcaccgctgaattaatggaacatgaccttaaaagacaagcccaaagcaatcttcccataattatctgtggggatgctcatgtaaacaattttggcttttacgcctcccctgaacgcaagcttctctttggccttaatgactttgatgaagcccgaatcggaaattgggaaagtgatttaaaacggttattagttagtgctgaactagcgggcgaagagaacggttttgatcgcaatgacctttaccacctccttcaattaacgactaagacctaccgccatactatcaaaagcgctaataagatgagcctttcccaactgttttatttttcatttgcctatgaagacatggggaaagcgattgagtcttttggtgatatttcaacgcaaatgcaaacagtccttaataaggttcttaaaaagagtcagcgtagcaattcagaagaaataatccaaaaaatggcaactatcaatagtcaagggcaccttgtttttcgggataacccaccacgtgcacgccatcttagcgccgtgcgttatcaacagattgttaaaggatacaataaatattgcgaaaatgttcgtcaagatgttcgggttcttctcgcaaactttcacatttccgatattatccgctatagtgtcggggttggcagttttggaacacgatgttacttaatcatgcttactggcaatgataatagtcatattgttttacaagttaaagaagctatgccattgcgttataatttactttccctccccgtacaacaagtaattagaaatgggggaatcgctggtcaaagaattgtaacagcacaacgggttctccaatcctcatccgatcgttttttaggaagtacaacttttggtggccgtagttattacattcgacagttccgggatatgaaagaatcaattaatgttaataaacttgactttgaaagttttcaattctactgccagacgtgcgcttatttgctagcgatggctcattttcaaagccccaccgcaccaatgatccgtggttatttaaagcatcagaagatattagatactcttttaccaaattgggctttaaagtatgtcgatcaagtcacagcagactatggacaattcaaattggcaatcgctaaaggaaaattaataaattaattataattaaaaaggacttgcattcatcgttttgcaagtccttctttaatactatttttcagacttttttcgctgatcacttccataacggtcttgttccttgattacactacttttacggcgatgcttattaataaaatcttgctcagcagcgaaaatcattaaaaagtcaataaaatttttactaaaattctttttaaatttgtcccatctatttttgatcattttatatacctcataaatatcattcatctttacttttattcattctagcatatctatttttgtgcaaacgattgtgtaattttaaaataaaattgtggtaaaatagaatttgtaaaagcgcttacttcaaggaggaaatattttatggaaatatctaaagtaccatttggaacctacaaagacgatccagtaacaaaatacattttaacgaacgataatggtgttcaagtaggaattcttgattttgccggtttacttcaatcttttaaggttccaacaaaagatggtggtaaggccgatatgattttgacctctgaaaacctcgacgaatttactaataatggcttttgtactaaccgcttaatcggccgggttgctggacgaattgcagatggtaagttcagtattaacggtaaagattaccaaattgaacaaaatgaaggtaaaaatgctcttcatggtggaactaatggtttttatagtcacatttggcatgttgatagcacgaaagcaactgatgattctgtttccatcactcttagtttaaccttaagtcctgaagttgatacataccctggtaagatgcatgtcactgcaacctataccttaactaatgacgacttcctttcacttaagatgtcggctacttctgatgcagatacgttgttcaaccctaccaaccacacatactggaatatggcagcagcaaatgttccaacggtggatcaattaaagctttatgtcaactccgaaaatcacttagccgttgatgatggcaagattccaaccggtgaaaaaatcgctaacgaaggaacaccatttgactttagtaccccaactacaatgggcgatgcattagaaaaaatgagttcaactaaggaaaatggctttgatgatatttgggaagttactcctagtctcacaaaaccagttgccacacttgaagatccagaaagtggtcggaagatgagtctttactccgatcgtaacggattagttatgtatacgatgaactcagatgatgcagcggtttacaatcacggacaagttcatccccatcttggtttagcaatggaagcgcagaatctttcagatgcgcctcaccatccagaatttggtgatattactttacatccgggagaagaaaaaacatacaccattaaatggcacgttgaatactaattaattactacgcaaaatgcatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactgtgtgcagttcgccagtagcccttgcgggtactagcgaagacatatgcatcacgctgggacagccccagcttctgtaagttagttaccttagttttaagcttcttccattgcttccagatatactgtcttattcggaccctcaaccacttgtcaaggcgttgaataaagtcagttagtttcccaattgagtagtactgaagccatccacgcatttttcgctgaatttcttcaaacattcttgtcagggatattccacgattacgtttagttaataacctcaatgctttctttactcgttgttgcgattgtttagctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttgtccaactcatttagatagatgttcgccagtagtggtgacaatggccctccttgtggggttccttttccactcttagcgaaaagcccatggtctaagactccgctagttagaaacttacgaatgagtcttagtgtccatgggtcatcaatatattgttggagatacttaatcatcaagtcatgattaacgttatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaactccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcacagtggacacccttgtcctcagctcatggttccgactactacggcccatagcggactctcaccgcctagctgatacccatgccgggcgcacataaaaaagagatcgacaaattgtcgatctctttttgtgtgttaggaattataaattaatttttgtcatctaggttatacttcccagcattttgaagatttcctttgccttttcaaggtagtggtgttctgcacagaataccttgatcttgccaccttgatcatcggtaagagctgctagcttttcatcaagttccttaaattccttattaaggtccttaataacgccttcttcatcttccatgtaaacatagtgattttctgctggatctttacgaccttcactagcacgttcttcaagctttactgagtccttatctactttccaagcatgcttaaggattgacttaatatccttaattgtttcgtgttgagcagtacggtgcttctcattgtcaacactatcttcaatctttattaagtgtccttcagcatctgcaatcttctttgcaatacgatccaaagccttaagttgacgttttgcgtaatcagccataaataattacctcctaatataatagctataattcctaattcacttttattatatttttataatttaaattataaaaataacgcgtcttaaaattatagttaattttattatgaggtaatttcagcgcctaaataaatagatgattgatagaaattctcctattcaatcatctatttattaaaaaaacatcgactttttagcaacgctttggcttgtacttactggaatattaaaatcaggcagtcctggaatatgcaactcaattgagccaacttgttgattcttctttatcggtgcagttagttgtttttgatcatctccctgcactcgtaatgttggtttagttgcttgtaatttcatattctttggaagccaaacggtagtcttctttgttagcttaatattagccttattcttatttttatcattctttacttttacactagtaagcttggccgaaagatcacttacttttttgatttcaactggctggtactcatcgactaatttattataaaagtcttgttgcatcttcgactggtcattccattccccttttgtatgcaaggcaactaaaataatccggcgtcctgcaaaggttcctgttgacacaatacatttacccgcgcgatcagtatttccagtctttaagccgtcaatttccccatccttaggagcaaaaccgttttgtggcaaaagagcattcacatttgtcattaaatattgttgatctttagttacatcaaagttagcaaacttttgctttgtaatgtcgagagtttcaggataattttcaacaagatactttgagataagcgcaacatctttagcagataataagttctctgcgtctttatctacgcccttaagtttatgctttcctaagtccccgttaggcagcccgatcatattgtagatttttatatctgtaactcctgcctttttcgcaaatgccatcatctttttattaaaggctgctgtactgcccgcgtcagctaatgccaatgcttctgtacttccatcagcagatacgagcatcatcgaatcaactaactgacggactgtgtattcttccccattcattaatgggacatttgaaaagtgccaatcatccgccatcttggcaactgctggtgtaatcttaatcttttgatcccattttaaatgatggtttcgaatatcttgtaaaattactcctaaagttaagattttaattacagatgcaattggatagcgtttagttgcatttttttggtatagaacctggccactttctgcatcaatcgcataagctgctcgtgcatccatctgaaaagctgcagtatcagcatggactttttcgaacatccccaagccatttaaacagatactaattattgccgttattaataataatttggcaaaaaaagatttaacctttttcattataacaatttctctcctttacacatttaactatcatatcctattctgcctaaaaaaggtgtaacgatttggtaacaattcaaatgaaatccttatttttcattaaattaagaagatgcaccttttaacttctataaattatctgtattattaataagtatgctaattttaatcagaaagggtcggttaaaaaatgcaaagatcgcaacgtcatcgtcgtaaaccgcgcagacttatcttaattatcatcgctattctgctcattattatgggtgtccggcacttcagctcgacaagtgcccgcctaaaatccgcatggaataaaatcattttcacttccaataataatgttagtattgcggtatactcaccaaagacccaccaaatttatacttctagtaatgtaccccagcataagtttcgaactgctagtacagtaaaggttagtattctagcgggaattcttgctaagcaacaaagtcctcttacaagtcatcagaaatcgcttgctactaaaatgattgaacaaagtgacaatgattcaactagcgaattatttgaagattatcttggcggaaaaaacggtctccaacaaacttttgaaaaatttggcatgacccaatctcaggctaatagcagttgggggttaactgttactactccaaaagatcaagttaaactattaaataatattttctataagtctaaagttttatctgatgacgaaagaagtgaaattcgtgatttaatgggtaatgttgaaagtgatcaagcgtgggggatctcagcaagtagcgataattttgcattaaaaaatggttggctaaattacggtaaagatgaatggatcgtcaatagtattggctacgtaaaaaatagtaacggaacagactacacaattgcagtttatacggataaaaatcaatcaatggccgcgggacaacaagcaattgaacaacttgctcgtgtaacaaagccaatattagactaaattgaaatgataaacaaaataggggctggaagaaaacttcaaattttcttccagccccatttttataggtagtttattgagagagataaagcgttttggaaaggaatactacctattttattttgagagagattactaattaatttgatgtctatttttgttccatcactttttcaccattagctgtaatagtgaaagtcttgttagcagcatcagcatcaagaacagccacattcttgccatccttatctttccgcgtaaccttgatagttgtttcagttggtgtttccacttcaattgaaccatcaagatcaaaggctgcaaatttattccgccatgcaagtaagtctaagagattcttaactactggacgttgaacttcttgtgcaacttcttctttagtgtagtagtgacggttgatgttccgaccttccttagtcttttcaagtaattcaaggtcatttgaaccagcaagtaaaccaacatagtaaaccattggaataccaggtgcaaatacttggaatgcacgagaaagcaagtaagctttgtcatcgtcacctaatgcagagtagtaagtagagttaatttggtaaatatccaagttgttgtattcagcacttgagtatttccgcttaacgttagcaccaaccttgtataattcattggatgcatattcgatttcatcatcagttaagatatccttagcatcaacaaccccaataccatcatgagtatcaagagtagtaaattgcttcattggtgacatctttaaccacttagcaaggcggttagtcttaccagagtaaagggtataaagagtagtcattggtaaggtaaagtcatagatgaagaagtcatgttgtgaaatcttttgtggaatggtgtagtgttcgtgaatttcgggaaggatgatggccttgtaaggagccaaaatatcttgaacttcatttaagagatcccagatttcaggttcaacgaagaaatcattagtaccaaccttcttaatagcgtaagcaaaggcatcaagacgaatcatatctgcaccgtgcttaaccatgtcaattaatgtttccttgaagaattcgttagctaccttactcttaacattaatatcaatttgttcttcaccgaaagtgttccataagttttcagtagtaccatcatcaaaggtaatttcttgcttaggagccttatcctttcgcttgtaaattaaatcaacatcttcttgagttggacggttcttaccagctttttcccagaacttttcccaacgaataaagaagtcgttgtacttagaatcatcgtgcttcttcttgaagtcttggtacatttcagacttcttggaaatatggttaatcatgaagtcaaacattaagtagtagtcttcacctaatgcttcaacatcatcccagttaccaaaagcagaatcaacaacatcgtaacggtatggtgcaaaaccacggtcaccagttgatgggaagaatggaagtaagtgaacaccgccgattgcatcaccgatatagttctttaatacttcatgagtttctttaatatttttacccattgagtcagagtaagtaattaacattgcttcatttttgattggcataatgatatcctccaataattttaaatttagttagcttgtttagaatgacgagttgcaaagaaaataattaaggcaataactattagcattaccccgtagattgggaatggtgcggcaagatcaaggccactcattgggcgaccgactaatcgattcatccattcagcaattgttggtgagaagaaagctccaaagttaaaaccaatcagtaccattgaagttactaatggttgacgcttagcaggagctaaatccggtaacaagttaaaaatcaacggagaaactaattgtagtgggaagccgattaaaagcaaaccaattactaacattgcaaagttgccgtttgcgaaggcaaataagaagtttgaaatggccattaacccgagaccaaggtaaacagtgttaaaacctaacgctttattaattgatccgtagaataaaccaccaagcgttgccccaattaacattaaggaaagaaacattgatgaaccagtatagctacttcctttaattgcaacggttaagccagggaaacgattttccattccaacataatctacaaccaagaggaaggcaaagagaacaaggaggtaaactactggactaatctttttaattggttcttccacttcagttaattcttcagcaagatcgtcttctgcaacgttattatcttgtgctttgctatcgtcaggaacacgaactgcaaagaagaaaagaacaacgaaagcaagaagataaacggcaaatgatgcatgccaacctgcataactaagaattaatccggcaattgcaagggtacaagcttgaccgatttgttcagccgcagcacgccaaccaagcatttgagctcgggttgtaccttcataccaaactgaaatcatcgaaattgcttgagagttatataaaccaaatcctgctcctaaaactaaccgggaaatcaaaatcgcagtgtagtcattcgcaaatataggaacaattccggcaagaccaacaattgtaaccccggccataataatctttttatcagaaatattgaaccattgttgaagtaatggtgaaaggacaacaaaaatcattacagcaaatgatggagttgtaactaaatattctgactgtgtctgtgagattccgagtgccgcctttaattgcggtaaagaaccttgaatggcataagcactcgtaaccatgaacgaaactgacaggaatgccaatttggtaacaagagaatttttgttattcataattagtagatactctttctataggtatttgacaaacgtttatcatttctgtacatcaataatatacaatgaacttttcaaaatgtcaaacgtttaacaaagatttattacaaaaaattgtaatcaattacattgttattataacgcgctttaaatgaaaatagatgaaaacggatgagaacgctattttagctcttttttgaacaacttgtgaacaactatacattatatttttataatttttttattaaaaaagagtaaagcaatgactaattcatcgttttactcttttttacttaatccacacaaagcttcttgattgcctgcgcatagatttccatcgctttatacatgtctggcaatggccactgttcattagcttgatgcatataatcgggagttgttggtaacattccgccaaaggcaacacaattattcatggttcgagcaaatgttgccccaccagaaatttgtggttcagcatcaacatccccagtttgttctttataaactttcatcaaagtttgcactaatttactgtcttttggaacgtacagaggggctaaataatcaaaatgaacatacttcaaatcataagctgccacctgtttacttagttttgctagtaaattatcgcgatcgatcgttacgggaatccgtaaatcaatctgcattcttgtttcattttcattaatctcaagactagaaatattgaaagttaattgtccagactcatcgcgaacatcaccgagaacattgctccccgttgcatcttccttaaataatttgccaataaaatcaagtggcttaaaatcaaaaacatcatcaagcgcaatcactaaccgtaaaacagcattcgttccttccggtgccatcatcgcatgaacagacttgccaataacagtaattgaattaccgtcacttgtatattcaaagccatgcttatctaaagccgccttcacttcatcctgctttggaccatcgtacactgcactatcagggaccgcattaaacgcatttttcaagttaatctttagttgatctgttcctggaccaacgagataagattgttgcaaccccttttcagcataaattaatggaaattcagcatcaggagaaattccactatcaattggcgcttcctttttattatattcagcaattccacgccatagaatttcttcatcagttccataaataaaacgaattcgttgattgaagtgataaccttgatccatcaatgctttaacagcatataaagctgcaattcctggacctttatcatcttgtgaccctcgtccataaactgcatcattgattactgtgcctttaaatggatcatgtttccatttgcctaaatcgccggcaggaaccgtatcaagatgacaaattacaccaaaaattttgtccccactaccaacttctgcatagccatagtacccgtctggatcttcataggtcttaaaacctaattcatcacaaatcttcatcatttcatcgagggcgttacgaattcctttgccaaatggtgcgccttcttctgctggttgattatatgatggaacagaaattagtcgttctaaagttttaacagcagctttttgttcatcttctgtaataattttatccattcaaatcccctcctagagcaaggcagcaattcctaagaacaagcaagtagcaacaaagagataaatcattaatttcagcatccacttccaccaaatgccgacattaatatgcgcaattgctaatgctcccataacaactcccgaagttggggtaataaggttaacccaacctgaagctgcttgataagcagtaataacaaggctaccagaaacatgcgcaaaatgtcccattggtccgataattcccatcgttgccgcagctaacccagacgttgatggaattaagaatgacattgggatatagaaaatgtaagtcaaaataataaagatcgtttgtgataatccatgaaggcccaattctccccagtgaagaactgttccagtgatcatcccattattcattattacttgaattccccgtgcaactgccacaataattgcaacgcttaagaaatctcccattcctgacatgaaagcatcaataaattcactttccttcatatggtaaacagccataatcaagaccgacataaagaggaagagcatggtaatttcattgaagtaccatgttccaagaggtgccatatcatgccctaataaatcgcctaggaatggaatattaaccaaccactttgtaaatttatcaaaaaatgtccaatggctattaaggtttgaccatggaattagtcctagaatcatcacaacaaaagtaattccgaatagccaaataactgtcttttgacgaccggtcattttatggtcgtcattaggatcagccttgactaaaaagtgcttttcatcttctgctcgttgattgtaaactaatgatttagttggatctttttcaattaccgatgcatagtggtaaacataaataatactaatcgttatcgtaataattaaaaggattacccgggaaactaaaccatcaccaggagaaatatttaacgtttgagaagctactcctgtggcaaacgggttaacagttgatgctaaacaaccaacttgacttcccactaaagcaatcgcaaccgctacaattgaatcaaagccaacacccatcatcacggggatcaagagaggagaggatagaatgcaatcgtttcttcccccattccatatgttgatccaccaagagcaaacagaagcattaaaattggaatcaattgtttttctcgtcccttataccggcgaacgattgaaccgatcccttcgtttaatgcatttgtcttattaaccactcctaggaatccaccgataacaagaataaatagtgatactgagatagctccatctgtctttttatcaccgaccatcccgataacgggtgccataaagatatcccaaattccctggggtttatttgtcaccgccttatatgtgccagaaataatatttccagctttatccgtctcatatgtccctgctggtataatccacgttaaaattgcaattaaaataataattaaaaataaaattgtaaacgcagagggcatatgaaaatgatgttttttcttcgtttgtgtttcctgcacaataaccgcctcttttgtaaaattagtatcaattttattttaattcagtttgaaagcggcttcaacttaatctaagaattatccttaaagaatgctataattgccttgtagtaattttaaggaggatgaagctaatggtaatgaatcctaataaagcacaagacgtttggaaagacgccggtgaacatgtccaatttactgtattagaattaaaacgagaaaatcaagcaaaggaacaagaagcaattcaagaatttgttgaacggttccaagcaattactcgatcactgcgaattcgggataataagggtaatcttaaagtttctttaggctttagcaacgacgcatgggactatcttttcccaaatgcccctaaacccaaagaattagaaacttaccaaacattaaccgggccaaaatacaaaatgcctgccgcaaaaggagatattttcctccatattcgtgcaaacgatgaggctgcagtttacgaattcatggctcaagtaatgctctttattagagatattactaatgttgttgatgaaacaaagggctttcgctattttgaaggccgggccattattggctttattgatggaactgaaaatccggaacctcaggatgctgctgaatacgcaattattggtgatgaggatcctacgtttgaaaatggttcatatgcctttgcacaaaaatggcggcataacatggacatttggaataagctaactactgaaacgcaagaaaaagctgttggacgaaagaagttttctgacttagaattaagcgaaaaagagaagtttaagaatgctcataatgtcgcttcccaagcggaaattgatggtattgaacagaagattgtacgcatgaatgttccatattcagaccctgccgctgataatactggaactttctttattggttattcacggcattggactgtaactaagaagatgcttgaaaatatgcttgagcaaaacgattatctcctaactttctctgatattttaggtggtcaactcttctttattccttcgcgtccaatgttggatcaaattgctgaaggcgaattaaattagttgattgacaagttgaaggcaaattgctatattattagcagcaaattttaggagggatcatccattgaaattttaattctacacaatttaatgtatctggaactgtggattcacgcagaaaggtactacgggtagaattatttttcaatgattgatcaataaatgagaactaatgggccaataccattagtttaaaagtctacctgtagtggtgggctttttttcgttaccttttctgcgagtaacgaaagggtgattttttaatggaaccaatcacgataaataatttaacttttgcttatccgggacaagaaccgctttttaatcattgtgatcttaatattagcagcgattggaaacttggtcttcttggacgaaacggtcggggcaaaaccacactactcaaaatcttgcaaaagcaactttcctttcaaggaagtattcaaaccaatcttaagtttaactattatccattagtaattcgtgaaccgaatgattacacaatgaatgtccttatgagaagtggctatcaaggtgagcaatggcaaatcgaacgagaattaaatttgatggcaactcccacagaattactatggcaacctttcagtagtcttagtggtggcgaacaaacacatgtgatgctagcaaccctttttgcccaggatggatatttccccctgcttgacgaaccgactaatcaccttgatcaggatggtcgaaaacaaattgctcaatatctaaaagcgaaaaaaaacggcttcattatcactagccatgaccgagattttctcgataaagtcattgaccattcattagtgattgaacaacaccagcttgttttaacccgtggtaattacagtgattatttcgttcataaggagcaacgagattctacggccatcaagaaaaacgaaaatttattaaaagatattcatcatttaaagcaaacacgtcaggcaaaatctcaatgggctcaacaagcagaaaatgaaaagaagaataattctcatgcggataaaggctttattggtgccaaagctgcaaaaatgatgaaaaaagcaaccataatgaaaggacgcttagacaccgcaatcgaggaacgaaaaggacttttaaaagagattgaaaatgttgttccgctaacaattaatgtcctccccactaatcatcaactattgttaagcattaatgatctaacgttatcgtatccaactaaacaactctgttctaatatcactgcaaccattgaaaaaaatgagcaggtcctgctctgtgggaataatggtactggaaaatctagtattattaatgcaatcatcgggacattcagtggtaagcaaagcggagatatactttttagcagtgcccttaaaatcagcacagtacgtcaagattattctgataatcatggaagtttacgtagttttgcatcttcttctaaaattaactacgatcaatttcttaaccttcttcgtaaattagggatggaacgtgctacttttaatgttccgattgaagaaatgagtatgggacaacaaaagaaggttgaactagcacggtcattagctgagcccgctcacctttatttatgggatgagccgctaaattatcttgatacctataatcagcaacaactaattcagttaattcaagaaaagcgaccaccaatgctaattgttgaacatgatcaaaatttcattaagcaaactgccacaaagaaaattgaaatttaatatttcctgggaaataatcaaatttaccaacttaatgtaaaaaaggagctgtgacacaagttaggtcacttccacaaaatacgaacagcgcagtacaacaatggccttcatcgtccggcaaagtcgaacgttgaaggcctattgttgcttgcgggggctcgaaaacgaagtcacgagtgacttctgtctcgctcccataatttttagctaaattaaattcaattcagttaaccactcaagaaatagtgggaaccactttcccatatgattatctacccgatcattattgacaataccagtatattcgttagctaatgcgattccatgtcccccagtgccaaactcatgtaattcatatggaacatcatacttgattaacgcatctgcatatacttggaggtgatcaacaaagggagttaattcatcttttgccgatccccacataaaggttggtggtgtttgtggatttaccaattccgctacattttctgttgtaacccccatgcgttcatcaatcaagggttgaataacaggatatcctaatgcggcaaatttagcgtgtgttagtttttcgttactatatgcagcggcaatttggcctcctgcagaaaagccaataattcccagtcgatcaacgtcaacatctaattcatttgcatggttaacaatatattcaaatgcttggtgaactgctattttggcttcttcataatttttatgttcaactactggataccgcacaacaaatgtttgccatgcatgggttgcaaacgttaatgccacccgctcagaatctcgttccataatcttgttataactgcctcctggcaaaataacaaggccgggtaaagttttatcagtattactatgataaatatctagagacgaatatggttgatctaagttaacacttttaatttccattttctcacctcattttgattttgctaaatgttaaaattacaaataatagtataacctcaatatgcaataaacgatacaggtaaaaaattgttattaattcacaaatttccccttgtttatcatgatacatttgttaaagtgataaggtatcaattattatttgggggttagaaaatctaatgagtattatgaagactaagtcattctggattgctgctattatgaccttaatttgttctgttgctggggtgcttttagcaaaactaccttatgtcaacctgattggagcattggttattgctttattattaggtattgccatgcagttgactcctgctagcttgcggaatgaggctcaaggcggcatcggatttatttctaacaaatttttacggcttggtattattcttcttggtttccgcttaaacctagaaaaacttgctgccgctggggttaagactattttggttgcggctattggggttaccggaacgattgtcctcacttattggcttagtcgaaagtttggtgcagaagatgaattagctatcctttctgcttgtggctgtggtatttgtggagcggctgctgtaatgggggtttcaccacaaattgaaactgacaacgaggagcgcaaacgagaaaatgaagtattagctgttgccgttgtttgtgtaatggggacagtctttactttagttgaaattggaatcaaaccattactcggacttaccgatccacagtttggaattgtggctggtggttcattacatgaaattgctcatgccgttgcagccgggggagcttttggtgaagcaagtttagataacgcccttattatgaaactttcacgggttcttctcttagcgccagtcgctttaattgttggttactggtatcaacaccgccttatagttgaaagtgaagaagaacatactaaagaaccaaagaaattaccaattccttggttccttggtggttttattttaactagtgtgttaggaacctttcttccattctcaccagcctttcttgatgcacttgttcaagcagcctatatctttttaggaatggcaatggctgcattaggtgtttcagtaaactttaaggttatttttaaacgtggaggggccgtttttggcgcggctgtgattagctcaacctgtttattggtatttatgattattatgagtaaaatattcttctaagttattaaaagcgttaaattgaggatttattttagtggcatatagccattccgccaatttaacgctttttatttatattttttatttatattcttctatttaaccgtctttcccagctggtaagcttcttcaacatgtttagctagtttttgattattccaagaatcagctgcgagcacctctcctactttatcccaacgcatatattcaagcaattgcttaaaatataagttaagtgaagcaaaggcatctgcttgaccataaccacttactaaagtaatagctttctttccgccgtgaagttcatggttatagctgtagaaacgatcaatcactgcttttagcgctgcattgatcccgtaataatatagcgaactaaccaagactaccatatctgccgctaacagcttaggcattacttcattagtaataacatcattcggttcaatcgcaacttcttgtccgggatgattgtcctccaatttaatcatcgaaaattcatcggtccggcgtccagcatcaaagcgataaacttcatttcctgcttcagttgcgcccttaacaaaggcatctgctaattgctcagaagttcctggatgatggggacttcctgttaatacaataatcttcatcatgatcccgtcctttcttatttaattatagtgatagttcgactaaattagaaatagaaacattgaatattaatagataactaaaatgaattaacgaggccaactaaagattttcaaccaatttaacttagtacgctctcgtttttgttcttccttaatgtatgaacgatccgtaatgaaatgaaagatattcatgcctattcctcataaatatgttcactaaggtagcgctcgcttgaatcaggaaataccgtgactaaattagccccgtgtggcaattctttagcaacttctaaacttgccgcaagcgcagccccactagagctaccaataaagaggccgagatttttagcaacccagcgaacataatagaatgcatcctcatcactgattgtttttaccccggtataatctaagtccttgaaaaacggtggaataaactccactccaattccttctgtacggtgactatgggctggacccccatttaaaatcgatccggctggttcaacaatatagccttttaattctgggtaagcatcttggagcgccttttgaattcccgcaaaagtgccaccacttcctgcaccagctacaaaggccgccagcggtttattagcaagatcagctaaaatttccggtcccaaggtgcgttgataaacatcagcattcgctggattctggaattgtaaaggcacgtaagcatccccgatttcagcagctaattctttggcggccgcaattgctcctttgatcccttcttcactcggagtattaatcacttcggctcccaacgcacgcattaatgtttgcttttcaaaactaaacttttctggtaccactaatttaactggtaaatggtattttagtgctgctaaagcgactccaatccctgtatttccggcagttggctcgatgattgtcgttgtatcttttatttttccttcttccattcctcgctggattagcgccatccccaaacgatccttgatactgccacctgggttaaacatttcgagcttagcataaatattaacgtcattcggagtcttcatcggcaagtgcattaagggggtgtgaccaatcaaatcataagtattttcaactaacataatagttccttcttcctcagaaaagtaagtgggaattaacctcctcgacaaggcggtgggctaaggatagaacggtgattagcacggcacgggctgattatcgttcgaacttagcctcgagccttgtggttaatttccacgatatcgtaacaatatacctataaaaaacgaggctgttgaaaaaacaaaagttttttctcagcctcgccttatgtgttatcaacttgatagtaattcaattaaaaatgagtataccaaaaagtgagtcgcataagacgcgattcacaacaacaaatatttgcgttaacaaaataattgttttccattggtaatttcctcgtatttcaaattacagtaataataactagttaaaagtaagttgtcaagaaaatttacatagacaggtgtaaaataaaaaagaatcattttataaaacaggagcgctacacatgaaaaagaacggactattattagtcaatctcggttcacccgatacgccaacaactcccgacgttaagcgttatttgaaagaatttctcagcgatcggaatgttatcgaaatgccaccagcactatggcaaccactccttcgcggaattattcttccaactcggtcatggcgatcagcgactttttatcgtaattgttggacaaaagatgggtccccattgattgtctacacagaacggttggttgctaaggtccagaaattgatgccggagtggattgtcaaaatggcaatgacctatggcaagcctaaaattagtgacacaattgtcgaaatgaaaaaggaatgtcaaaatattacggttctccctctcttcccttttttcactaaaagcacaacccaaacgatcattgagaaggtaaaggatgctgatccagaagcgaaaataattgatcgtttctcggcagaagaagattatttagacttattggctaagcaaatccaaacggcatgggataaagggaaatatgacaaattactcatttcgtatcatggaattccgacagccatggttaatcatggtgatccttatcgtgatgaaacagaagcggccaccgcggaactgattaaacggctggacattcccgaaaagcaaattaagatggcttaccaatctaagtttggcccaatgccatggttaaaaccttacctccggaatacgctgcttaatgaggcacaactcggtcatcgtgatgtgttagtcgttgctccatcatttgtagcggactgtttagaaacattagaagaagatcaagtacaaaactatcaggtctttcgtgaaaacggcggaaataaccttgtaatggtgccttcgctcaatgactcaccagaatttgctcagtttattactgatcttgtgcaacgaaagggataaaaatggaacgaaaaagtttagacgaaatcaatgggagtgttgatgtaccaaatgtctatcaaagtgcattttggcagaaatttctcgcttatagtggtcccggtgctttagtcgccgttggttatatggatccaggtaattggttaacgtcgcttgccggtgggagccaatatcgctatcagctattagtggtcctttttactgccattttaatcgctatgtatatgcaatctttagcaatcaaactcggcgttaccacccgaaccgacctcgcccaagcaattgcgcggcgtttacctactcccctgcggattgccctgtggttatttaatgaaatagcgatgatggcaacggacttaaccggagtcgttggaactgctgtcgccttaaacatgttattcaagttgcccttacttatcggcgtcctgctaacaattgcggacgtgctagttgtcttatttttccttcattttgggatccgccgaattgaatttatcgttttaactgctattctggttgtcggcgccatctttgcgattgaagtctgtcgggcccaccctgaattttccgcgatcatggacggttttgttcctcgttccacaatttttactaatcacagtgagttgctaattagtttagggattgtcggcgccacgattatgccccataatatttatcttcattcctccctggcgcaaagtcgacgctacgatgaacatgatccagagcaagtcaaagaaacgctccgttttgctaattgggattcattaattcacctttttgcagccttcatcgtcaacgcccttctgcttgtactaggcggaaccctcttctttcatgcggcaagtctcggtagtcttgaggatgtctttttcgggctaaagaatccccatatcgttggtgctctagcaagcccattaatgagttggctctttgcctttgctcttttggtaactggtttaatctcctccatcactagtaccttggctggacaaattgtcatggaaggatttatcaatattcgcctcccactctggaaaaggcgtctccttactcgagccgtaacccttgtgccaatcctaattatcggcttcatgattaattttaacgaagagcaatttgagcaactcatcatttatgcgcaaatcgtcctcagtatcgccttgccatttacgctctatccccttgttgctttgacaggcaataagaaactgatgggaccacacgttaattcaccatggcaaaccgtccttggatatgttttggctagtttggttactgggttgaacttgttggtgttggtataatttttatttattataaatccaatagatagatacccttattttcaattatcagtgtttaaaaaactaatcaaatattgtaagataataataaattttgttgtaatttttgatgcaataaaagactggtcactatttacttttgggatagtaatttgatattaaaaatattttatctttggtgtgacgcttttatcaatctcattttacaactgaattaaagaagcagggctgaacgatatttatgttcaaaccctgcttctttattttagtttcgtcgtgcaatcatcacgcgctgtccacctatttgtttaactttaatgtctttaaaacgataatattccagtagttgacgatagcgttgtacagtagtagcagtaatcactatggttcccttaaaagcgaggacccttatcgcctcttgcaaaacacgtccttgcgtaattgccggttttacctgctgtaaattactaatcagaacatagtcaaactgatgatcagtgaaaggcaaattagtgttatcagtcaattctactttcgcgcgatcagctactgcctcttctttgatcagttctttcacttgctgtgcttgcttttcatttttaactattcccataattttgccgggagcagtcaattgcttggcaaggttagtaaacgtttttccattaccaatgctcatatcaaggatttgaacatccccgcgtatcgataaatcagcacttatctttttccagacctgttgcctttgccagatcaaccatccaataattccaacaactataacaattacgatcccaataacgactatcaattctcttcacccattattttaactaacaatatcgtttagcttccgaatatcctttaactgcccaacaactgtgattttatcgtgcggttgaataacatcattagcttgtggcatttgattaacttcatcatccttactaacaatgataatcacattgacattataacgattacgaaaattcagttcgtctaaggtcttattaaagaactttggattattaatatttacttctgccaaagttatttccttactcaaggtgacataatcaacgacgcttggatttagttgttgaaaaataagccgcttagctaaatcatgctctggacgaacaaccatatcagcgccaattcgttccaaaacgcgcgcatgattaacattttcagcccgacagattacatctggtgccccgagttctttagcaattagcgtggccatgatacttgcttcaacattttttccgattgaaatatacacatgatcaaaactaccgatatcaaggtcacacagagcatcctcatcttgcgcgtccgcaattaccgcccgcataactgaccccgcgaattcatttaccacttcttcactagaatcaatcgccaatacttcttgaccagcctgaactaaagcttcacatatcgaggccccaaattgcccaattccaataacagcataactttcttttttagccaattaacacactctcctctggataacgataattcttcgctgctgtacttgcatttaggattgagaacattacagtataaattcctacccggcccacaaacattaaaaacattataataaattgacctaataaattaaggtgggttgtaattcccaacgatattccagttgtcccaaaggctgccactgcctcaaaagtaacatacgccaacgaatcatgttttggcaaatcctgtgtttcaacaagcaacaaaattgatacaagcaaaataaataaagcaacaaatagtaatgtcaaagcacgataaatattttcttgggtaaaccggcgatgagcaaatgtcgtgtctcgctgcccacgcaaagttgcaaaactctgaatcgttaatagaccgattgttgtggttttaaccccaccagcagttgaccccggcgttcctccgataaacatcaaaataaccgtaaacgcgaggccggcagcacttaaatcagtataaggaaaagtaattaaaccggcagttcgtggcgtgattgccataaaaatagtattgagaatacggttggaaaaacttaacttatcacttaattgtgctaagtttttctcggtaataaagtaaacaaccacagaaacaacgaataaaactgctccagtacgtaacgctaactgagtatgcaaggatagccggtgatatttaggataattgagaatatctttccatactaaaaatcctaatgatccggcaacaatcaaaacagcaagcacacatagcatataagggtcattagcataatttgccatactattatcaaacaagtcaaagccggcattacaaaaggctgagattgaatgaaaaatactaaaccatattcccttaccgagtccgtaacacggataaaaatcaaaaaataaaaatattccacccgctaattggataagtaatgaaagccgaataataaggtaaaccacgttcaattgggataagtggtcaagattaagggcttcttgagttaataatcgtgttgacattcgcattcgttgccggatcagtaacgacatcatgactgcaaacgtcataaaacctaagcctcccacttccatcaagattgcaatcacaatctggccaaataatgtccagtgatgagctgtactaacaagagttaatccagttacgcaggttgcactcgttgaagtgaagaaagcagtcataaaatttgtcgtttctcctggtcgtgttgcaaacggcaaggagagtaaaattgttcccataaaaataacaattaagaacccaaatgtaagaattttgggaaatgtatatttatgtttatttatttcaatcacttttatccttcctcatatcaatattactcaactaattataagcgtttttgttaaattctaaaccattattttatttcccgggaaatcatctcgagaaagcgctacaatataactgtagattacccgattgcttttcctgaaaggagatccttttatgtactattcaaacggaaattatgaagcatttgctcgtccccgtaagccggcgggagtggataaaaaacatgcttacattgttggtgctggtttagcaggcctttctgcggctgtcttcttaattcgtgacgctcaaatgccaggcgaaagcatccatatttttgaagaattaccaatcgctggtggttcgctagatggtcaagatcgccctgatgttggatttgtcactcgtggcggacgagaaatggaaaaccactttgaatgtatgtgggatatgtatcgttcaattccatctctggaaatccctggtgcatcttatcttgatgaatattattggttagataaggatgatccaaatagttcaaattgtcgcttaacttataaacggggcaatgaggttcctactgacggcaagtatcttcttggaaagtcaactaaggaattaatgaaactaatccttacacctgaagaccagctcggcgatttaacgatcagtgattacttctctgaggactttttcaagagtaacttctggatttactggtcaaccatgtttgcttttgaaaagtggcattcgctagcagaaatgcggcgatacgcaatgcgatttatccaccacattgacggcttgcctgactttactgctcttaaatttaataagtacaaccagtatgaatcaatgactaaaccattgcttgcataccttaaagatcatggtgttaagtttgaatacgatacccaagtccaaaacgtcctggttgataccaagaatggtgaaaagcacgctaaaaagattattcttaagcaaggcggcgaagataaaaccatcaacttaactgacgatgatctggtatttgttactaatggttcaatcacggaaagttcaaattatgggagtcatcaccaggtagcacaaccaacccgagcccttggcggcagctggaaattatgggaaaaccttgctaaacaatcgccagcattcggtcacccggatgccttttgtaaaaacattcctaaccgcagttggttcatttctgcaactgctaccgttaagaatccacaaattgaaccatacattgaacgactaactaagcgtgaccttcatgatggaaaggtaaacactggtggaattatcaccgtcactgattctaattggatgatgagttggaccatccaccggcaacctcattttaagagtcaaaagccaaatgaaaccattgtgtggatttatggtctctattctgatacagaaggtaattacatcaagaaacgaattgttgattgtactggggaagaaattactaaagaatggctctaccatctcggtgttccagaagctttaattgacaatttagcaaaagaagagtcggttaataccgtccctgtttatatgccattcgttactagctactttatgccacgggtaaaaggcgatcgtcctgatgttattcctgaggggtccgctaacttagcctttattggtaactttgccgaatcgccaactcgggataccgtctttacaactgaatattcagtccggacggcaatggaagctgtttacagcctcctcaacgttgatcgcggggtaccagaagtctttaattcgatctatgatattcgcgaattaatgcgggcaatgtactatatgaacgataaaaagccgcttgaagaaatggacttgccaattccaaagattgttgagaaaccactgctcaagaaaatcaagaagaactggattggcgaattaatggaagaacaacatttactttaaaaaactaggggagtgaggcattaggtatctctacttttgtcccactcccttcaatttaatataaaggagtcttttttatgaccaatgaaacgattaagcaccaattaaaccatcgtacaattcgggcctttaagcccacaactctttcaacagaacaattgaatactctttactctgttgctagtcatacaccaaccagtatgtttatgtagcagatgtcaattatgcacattaccgatccagataaacgggccgtaatcagagaaattagtaagcaaccgtatgtcggcgcaaacggtgacctgttcattttgttagttgacctttatcgtaaccaacaaatacgacagcaaaagggcaaggatgatggccgtttacataccgctgatattttcttccaaggccttgatgatgcaatcatggctgcccaaaacatgattactgctgccgagagtatgggccttggcgttgttccccttggttcaatcaaaaatgatccgcaaaaaatcatcgaagtccttaacctccctaaaatgaccttcccagttttaggcttacaaatcggtatacctgaccaagaacctcaactaaagccccgcctgccattaaaatttatcgcatttgataatgactatccaaaagagatcaagctcagtgacttaagcgattatgatcaagaagttactacctactatgaccttcgtgatgccaaccgacgaattgattccttcaccaaccagattgcgggggctaaactcgatcgccactataccaagcgcgatgaaattatgaaggtgttacaccgacaaggtctttgcactgatgaaggaattgattagttcatcccctcaagagcagctaatgtcgttaaggtcgcatcataataatttttctctgttaagggtttactgaaaatgtgtttctggctagcaaacagattatcatacccttcattacgattgcagctaaccgcataaaaaatcggcgcactgaaactatttgattgatatttaaccaatcggtgaccgtttaatgaatagccagccgtaatataatactgttcactgaagaacctcatcattttatttaagactttctgagctcgtggatcattgctttttgccaacatcattggaacccgacaagcattcgcactatagtctccatcatattttccagcaaccgtattcggccccactggcttggtactccctggtcgagcccaggcaaagtcaggtactagtcctgttcggtgctgtttacttaatgcagtcagacggtcaagcatattatttttgatcatctgccaccttgaatcgtgagtacaatcgtataaatgatcaaaaactgtcggcattacatctgaagttcgcaataaataataaaacttagaatccttcgtaacccaatcacccactgttaacatgtgcgtggttgggttatattcatatttcataatatcagtggcaatctgttgctctagcttatgataataaggtgctttttgtggccaaacttttgcagcccggtgaagagccgcagcaatgtaaagatcaccatcagtcgcactattatgatcatcaacccattgaccttctttattataagactgacgccaggacattaagtaagttagctggtcatggtgttttccaacataatcgcgatgtgcaaggtaatagttaagtaacttatcaaagtcattttcacttgcccagcccttttcagcagcgcgagatactacttgcagcccgtagccttgtccttccgataatgcaacaggatgtttttggtcgttgctggtattaacatacgtttgcttattatttttgcggaccaaatatgtcccctgccaccgccgataagcttcgtattgaatatgttcaggattctttattcttacaaacgcgagcgttgcaatataaataactgcaacaacgagcgtaagaagccaaatatatactggacgtttcataactaatccccttattagtcagcaaaccgcttagtctttacccattttgtcccgtcacgccgtaatagtcgatcaagtgcaactgagattaccgcatgaatcgaaacaattataaataattgtgaataggtaaagtatgaagcaagcgctaaccagatttgcttattcgtcgcttgcccaaattgcgtagctgctgctgttgtaatttgtaaaatatacaagattatcattaataaccaattaaaaagcaaaagttgggcgattaggatgttactttccccgaatgtaaagggaatcattacctgtggattgaaaagatgaacaatccaaaaacctacgttcgctaaaaagattgcatcagaaagaacaattgccgcattaaaccagaaaaaagtacaggaataataaagagtttctaactttactcgccaattgctccggtcaaaaagatgcctaaaatttttcaagacaacctgataatttccttttgcccatcgtaaacgctggtagtaataatcatgcaggcgttttggctcctgttgaaaagcttccgaattataagctaacgcgattagttttccactttgcataatcttaaatgaaatatcagtatcttctgttaaggctccatttgcccagcctccgattgaacggacatatttactttgaatgataaagttagttcctgggatccggccaattttaaataaatgccaaattgcacagtgctggatccgttgggtaacaacaatttcttgattaatgcacttcgttaaaaagttttgctcggcattgcgtgtcttattccggccaaatgctgcaacgtaccgtgttggattttcgaggatttttcgtactaagaaatagagggcgtttttttccggcattgcatcggcatcgtaaacaccaatatattcaccatgagccattttaagggcatcgtttaagacaccggccttccctccgctaccatgacgttctatcacctttgcttttcttttctcatattttggaagctgtaacactgttcgggcccgttgagcagtttgatcattgcaattatccgcaaagattaataattcgaccttatctgctggatagtttaattcaaggattgcttgggtcgtctgcgcaataactactgcttcgttatgagcgggaacaacaatcgtaattaatggatatcgttttaatgggacaatatccacaatttttctactatgctcaagccaaaagtgaactgccccacctaatgtaatagatgacattaatagcgaactccaaattgagatcagggtcacaatcattacaaactcggtcattgctttttcctttccctttttacatttagtgttgtctgttcaacgcgaaaataaatcacccactgaagaaccgcaaatattaatgcctgaacaaaaaagatcatcgtaatcaccatcgccaaccaaaagaaaattcgtatcattatttctgaactcctcttagatactcaacgacaaggtctgtttccatatctcttttaatatgacgcattacactttccagattcttaaatgaagtcgcattaatatcatcaactttcaaatgtccccatttaaattgaggctttgaattattaatttgtaattcatcaagtcctgcacgtgtgctttggttctgataagcaaatgtaatatctggtaaatgatatgacaaaattaaaaaagtaccatcttctaaatagtacagggcttcagatggtaatcgtcgtcgttttaagactttcgcaatttgttgaagggcatagttataatcttgaggatgaaattgacgtatttgttgattatgaacccagtgaatcgctgtaacatcaatccataaatcagcaatctgttctttaataatgaattgaagttccttttcataaatcttattagcattataggccgtctgaagttttactatttgattatagtgggtcgcatagctttctatctccgcacgattgcggtcaagccagccccactcaccaataatgtaccgactgaaatacgccaaacttgcggtaattggaaaggcaaacagtaacattattttgattgaattatccattaccacataacctagcaataaaatggcactaccaatcgttgttaggccgattgcaagccaggttaaaataatatttggtactaagctccctaccattaagcccaaaatgatcataatcatcatggccgtcgtaataaaatgggcgtattgggatgcccaccacatcattaacacaattgcagtcaatattacacaaagcgcaataagccccgattctacaatatgtcgccgaatcataagaatgttctccctttcttcctataaattagcaactaatatcttagcacaccttttttagatttcactagtttaaaagcttggtaaataaggagttatgctttgtttgtaaaaataatttatcattttataacaagtaaattcccttgaaaaaattactcttttctatatttaaatttatagacattcatattagatatgttttatttttgtacgttgataagcaaaagcacaataattaaggtaaacaaaaaagcctgatttaactgtgcaggaaaaatcaggcttttaacttagtaaactcatcgatgaaacataacgttgctgatgttaattggataaagggatgcattgtttcaatgaagagtcttttatctaacttaaaaaacaagtggatttcttgtttgtaagtattatagcacacctattgtgaaaatgttaactaagatttaggatgattaaatatttttcgcaataatttcttatttatctactatttatcttattttccagcagtgattatcatcacaatatcacattatttctaattaaatttagaaataataaattaccttgtctgtctctgattaaaattctcctcggtattttatagataatatcattacttttatctaataattttcattatatctagttcattatattataatttagaaaaataaatatttttatgtgattggtgttaaaaaagctaagataagggtgataaataaattttgataaatttgtttaaaagaaatgaatttattattcctgatcacaccccatacggtcagcagcgatgattttatagctatttataaactactatttcattggattttatttatcaatttttatagaaaggagcagagttttttttactttgttagctaagtttaggggtatcatttgagttatttaatttactttatagctacttttcttcctttatcaaattgattaaattgcttggattcatatcactaatacttttaacctagtaattctcttttagcgtttctcattattcttagaagcttcttagaagcgctattgtttgatccaaaaatagaatattcattaatacgcaattacaaagcaatctctatatttaagctttctaatcaaaaagcaacctcagcgtcatcctttgacctcgagattgctttttatttgattactgatttccagttaatttccgacggactaacgttggatcagcctttcctggattcaattcgaccagtttccccgatccactgtaaataatccattctgctaagttaacaatatggtcgccagcgcgttctaaattccggataacggccaaatagctttcataggcttttacatcttcgccacctttaaccagtgctttcatgatttctttttgtaatttcacataaagtaaatcaactttcaagtcctcgttagcaacctcataggcaacctgctcatcagtatagacataagcatcaaggattcgttcaagcattttgcgaacaatcatcatcatctgttcaattggctgttcgatgtcttcatgatgttcaaatttacttaaggtaatcgcagcgcgggcaatatgggtcgaatagtctcctaatctttcgatatcagtactagcttttaagatactgataattttccgaaagtcggttgcaaccgggttttgtaatgccattagcttcaacgcctgtttttccaaatgaatttcttcatcgttaatctttgtatcagttgttaaaaccttatctgctaagtccgcatcatgatccgtaaatgcctttgttgcttgatagatctgctcactagcgtcaattcccatttccatgaagtggctccgcagccgttttaattcatcatcaaaaattgctcccatgttttcactcctaaccaaattttccgctaaggtaatccgccgtttgttgttgttgaggattcataaagatatctgtcgtctggttaaattcaattaattttccttggtgcataaaagctgtccagtctgctgaacgtgatgcttgctgcatattatgggtaaccataataatcgtaaatttctcttttaattgtactaaagtatcttcaatttgcgaagtcgaaactgggtcaagagcacttgttggttcatccatcaagataatttctggttgaactgccagcgtccgcgcgatacaaagtcgttgttgctgccctcctgataaggcgagcgcactttcttttaagtgatctttgacttcttcccacaaagcggcctgacgcaaactctcctctactcgttgatcaagaatttgccggtcctttactctggcaagccgtaatccataaataacattctcatagattgataaggggaacggtgttggttgctggaagaccatgccaatttgttgacgaatccggtaaacattaactttaggctggttaatattcaagtcatgaaaattaatttcacctttgaccgttgctaagtcatcgttcatccggttaagacttcgtaacaatgttgactttcctgaaccagaagccccaatcattgccgtaatcttattggccggaaatttcattgaaacatcatgaacaacgtgtttgtcaccatataatacttgtaaatttttcacttcaagagcaactgaattttccattcttttatcctcactttgcaagtcgttgcttaattaaataaccaatatatctagctaataggttaaagattaaaattgttagaatcaaaaccgctgctgaaccatttgaaacagcacgggcatctggaaccaatccctcactgttaactttccagatatggacagctaaagtttcggctggtcgtaatggatttaagaaactggtaggactaaatggattccaattggtatagctaattgccggtgaactctgcccggccgtgtagattaaggcagcagcttccccaaagatacggccagcacttaggatcgctccagtaataattcccggtaaagcagccggtaaaacaattttagttgttactcgccactttgacattcctaatcccaatccggcctgacgttgaagataaggaacttggcaaagggcgtcttcacatgcccgcgttaaaatcggcaagttcaaaattgttaatgctagtgcccccgcaagtaaggagaagtctaacccccattgcaaaacaaagactaagtaaccaaataatcccactactactgatggcaatgaactcaaaacttcaatcgccaagcgtaataagtttgtccaccgattatctggtgcatactcacttaagtaaatggcagcacacaatgctaaaggaatcgaaacgattaatgttaaaacaaccaggtaaagagaattaaataattgatcacgaattcccccaccacttctaaatgattcagcgcttgacgttaagaaatgccaagaaatatggggaattcctgatagtaataggtacgctaacaaggcaaataaaactaaccctactaaaccggttaaagttaaaataatcacggttgccaaccgatctactttttctggacgcattattttacccctttccggctaacgagccgcattaaaagattgaaggccaaggacattactaatagaattaaagctaaggaccagagtgcattgtttgagatcgtccccatgactgtgtttccaattccggtagtcaaaacactagtcaaggtggccgctgaatgcatcaatcccgttggcattaccgtcgtgtttccaattaccatttggactgctaaggcctcaccaaatgcccgggccatcccgaataccattgccgttaaaatcccgcttttagcactcggaataatcacccgcgaaatcgtctgccagcgagttgcccccagccctgcagacgcattgcgatattgtttaggaactgccctaaaactatcaattgtcatcgaggtcattgttggtaaaatcatcaaaaacaatacacaagtagcagcgagaatcccaaagccagtgccgccgaaaaagcgacgtaagaagggaacgattactgttaaaccgacatagccatatacgacggatggaattccgactaataattcaatggtcggttgaagaaacttatatgcggttgatggcaaaatctctgtgattgcaatagctactactaaggcaagcggcaaagcaattactcctgacaaaagagtaacgctaaaagaagtggcgatcatcggtaaggccccgaatacatgatcacttggccgccatttaattccacttagaaaatcccacaatgaatagtgattgccagtaaagagggcaattcctttccaagttaaaaagattaagatcgttgccactagtcccccaattaaagtaattgcaagataactaattactttccctgaggcttcctgcttactttcaaccgagggctgtgtcaaacgttgtcgtaagtcttccatcgtactatttcctttcagttactttcccagttggtgttttttcaactttcatatcatgaatgctaatatagtgagcttctgttacaagcgtcttttgaactttctcgctttgcatatacttaatgaaatttgcagttgattgggatggctgtttttgcgtatacatgtgctcatatgaccataatggccacttattagtcgtaatgttatcagcagttggtgctactccatcaaggttaactgactgaacttggtcattaagataagcaaatgcaatatagctgattgcccctggtgtatttctaataatttctttgactgtcccgtttgaatcttgttcttgagcatttactgcctgcatccccggtttcaataccgtctgttcaaacgcaacccgggttccactcccatgagcacgattaataactgtaattggcaaatcaggtccgccaacttcttgccaattcttaatttgaccagtaaaaatttgttgaagctgtttcattgttaaattcttaatgccaagttcttcattaacaattggtactattcccgaaacagcaacaatattatcatctaatttattggcattaattccatcttgctggtcagcaaagatatcagcagatccgatatttactgctcctgcttgtacctgactaaggccggttcctgaacccccaccctgtacaataatgctggtttggggatgcttagtccggtaatcatttgcaactgcttcagctaatggttgaagagctgttgagccgacaatggtaattttttcttgtgatggttgttgcttagcgagtacccatgacccacctaaccaacagactattgcgacgataacaaccccgataatcgttttttcattactattcctacctgtttattagttgttttcatatatttcgtatggtacaaatagagaatagcaagtcgatgtaaatttttaatctttgtaatgtaaaggttatgtaaattttggagaaagtattatgaccaataaatttttgctaatgagccagcaacgatctcgtccaccagttacaagctatttgtaaaaaagaacactggacctatgagctcgtgactactccgactgggttagtagtagccttagaaaaaaatcaaattagcggaatttggtgggatatgacgaagtaagcttagacaccacgattgctaccatgacccttattcggtcgcaagtccaaggaccgattaccgtttttactcctcgctttacggaacacattcaacgaaaattataccgggcacatgttgatgatgtaattgcattcctctcctccccagtattttccgctccttaatcagcagcgcttgtggacttaccactatccacagatgcattcattagctgatgataatacaaccaaaaatgacccagtaataactactggatcatgggaaattaatcaaaaacctatacttactaaaaatgataaaacaattgctttaacaccaaggaatttcaattactttcttacttagttgatcataaaggacaggtattaaatcgggatcaactcgttaatggagtttggggatatgatattcttgatacttcacggatcgttgacattcatatcagtcacctcgcgataaacttgaagatgactcccaacaccctactcaccttctcacagtacgggatttggctataaatttgtttaaaatacccgaaatgtcaatttaagttagaagaaagtagttgctcatcagtgacgtaggacatgaatacctcatatggagttcgatagcctagtgatttgcggggcaggttatttcgcttactcatcagttgggtcaccaattcatcaggaagattgcggaaatctagctgttttgttaagccgtcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgctgcgggaatttccgaagccactgacctaagtgttggttaatcgcatcagccgtcttttcgtgcacattgagtacaatttcgaccttcgattggcgttcggtcagggtcattaccgccccttggtgctttttgccttggacggtatcagcttcaaggtgtccaaattcagtggcatagtgcggaaagtccttggcacgctcgtgaatacttcgccccaattggccagccttccgcggcgctcaatatagccattcgggtgccgcttacctcgcatgggcaaagcacggacatccaaaccgaactgcccccgttcaaacatccggtaaagagttcgccggttacaactaattgggcgctcagcgcgcccaataatggtgtcaggcgtccacccctgggcaattttgtcgttgatataagtaagttcagccagtgacaactgagtacgttttcggccacaacgttgcttattgcgcatatagtgatcttgataatcagcaattgaggcaccggtttccaggtaacgataaacgcgataaacggtttcggcgctacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgataataaaaaatgagcgcggctggaaaaaaactcctagtccaaaataaaaaccggatgatgaattttttgaacaattcatcatccggtttttatgtacacaggaaatcgttcctgatatgatgtaattatccctaaaaacaaccaaagggagcgagttccatgtatccaaattataccatagggcaaaccgaattctcactaaactataactatgatttaccacaaaatcatgttgcacgattaattagtgattttgtcgactcgattccacaagatgtgctattagaagattcagtagcggctaccggccgccccttcatcgcatccagcaattatgcttaagattctcttgtttgcctacgcacgccaaacttattctggaagaaagattgaaatgatgttggatgagaacctaccaatgcgttggttagcttatgattatacttatagctaccataccatcaataactttcgccgcagtcagcacgccagtaagctaattaaacatgcctttgtctactttaccatggttttgaaagatcacagactaattcaaaacgatgcggtttttatcgatgggaccaaggtagaagccgatgccaataaatattcatttacttggcgacgggcagttgaaaagtatcacgctaagttaagagaaaagacaagtaagctttatgaggaactagtagaaaagcaagtggtgcaagaaatggcaccggagctggttacttccgccgaaggcatggacgtaatggaacaagaactggcggagaaaatcactaagctagatggagagattaagcaagaaccaaaaatcatcaaaggtggttcagtgagaaaacggcgccgtcgttttctaaaaaagcttcgtcaccaattaagcaacgacctaattccgcgtgccaaaaagtatgaacgtgccgaaaatatcttccaaggtcgtaatagctattccaaaactgaccacgatgcgaccttcatgtgtatgaaggaagatccaatgatgaatcgggagttgaagcccggctataacctgcaaatcgctacccataagcaatttgtccttgattacgggctgttttcaaatccaactgacaccaggaccttagtgccattccttacccagtttcatgctttagatttctttgaacatatcgtcgccgatgcaggctatggtagtgagtacaattacacaatgattcttgatcggtttgaaaagtagccggttatcccatacacaacctatcaaaaggaccagaaacgtaagtttaaaaatgatccaactaggtcacagaattgggaatataacgctaatgacgactactacattgatcatcaaggagttcgttttagtttttattgctacagtaaatccactgatgagtatggctttaagcgtgactttaaactgataaacatcaactatcagttaaattagatgagctagcgaagacaccaggtggtcggcaacgctatatgaaggttaacccaacctggaattattataaagctaaagttaaagataccctctcaagtgacgaaggaaaggcaatttatcgtcgacggatgtccgacgttgagccggtctttggtcacatgaagagggattttggcataccccgaactcatctcagtggacaacgggctgtggaaaatgatatcgggctagccctgatggcattaaatctaacgaaatttggccaatcaattagtcgattgaagactaatttcataactaatttaaaatccgaactacgatttttggatcgatcaaaaatcatagtccggattttattgttagagaaccaagaattaatagttaattcccagcctcgttttattagtgtaatcaatttaatttatctttcatccgtgtgaattttagtaaaactaaatatactgttcaaccatgtttcgatactttaatagttctttttgccccatggaagaatcggggagaacgacttgaacgctattgttgccaccattttcatccatttgctgacgtccccatacccctaatgacataatgagacgggcaatttcttgaccacctgtcgtgagaacaaaacaaccagcttctttaatcggactgattaagtatttggtttgtaattcctcaattatggttatcgattgattatcagaaatattagtcaataattcgtgtaaatcatcaaagtccagcggttttattcctagccaaaaaagaactttagagtaatcagcattacgcaaaaagcttaaagaataagtaattccatgattagcttcttgattcatcattaacccactcccgcgtacaaaatattgtaatattcatcacaaattataacatgaggaaaaagcaatctcaaaataaccccctatttatttatcagattattaatcttaaagacacttttataaataaagtcaatttatacaatgaaatcgctatcaataacattatattgtatatttactttttagtaaaatttgtgcctcttttattccaaagaaatgtgatttaggactactcatcttatgagcgatcaatatttgttgcgcttgttcacactgtacttttgctaactcatttggctggaatatttgcagatagaatgataattgccgtaatttaatcgctaactggctccgcgccttcgtcaaagtcacatccttaaactgcttataatcatgaatcatgaaacgagttttccggcgctgtaaagcatagttaattgaattgctcttaatccggtgaagatcttgaactgtgaggccgtgttgacgaagaagataattaaacatcgtaatctgctggtcgacttgtcgccaatccgttgcaatatcatctcgtaattgtgtaatctcttctttggtaagacggtgggtaactccttgttttaattggtgatataaggtttgcagatcttgataatcgcgttggtggagtggaaggtcaacctgactaaataagttgcatcgctggtaaaggatcgtcccttcgtggttcttaaatccctgctgggcaacaacaaactggaatatcttttttggaaaacgccgaccagcttgataagccaacagaatactatccatatacaggttaatttcattaatgcctgcctggatctccctagcaactttgtggggaatgcttgcatgctgctggaagtgagagatgcctaaaaatagttgccgaccagttgtccgtgaacgtaagataaattgattctttaaacgccgaccacaatcacaatagaggttgtcgccaggatgatcatgttgtcgctgataccaaggatcaattaccattccctgaaactcccaatcagtctgtttaagatagtgatgagtatgaaaacgcgatagcatcgcataacgcgtaaattcactcaatgcctgaacctggtctggccttaactgttgtaaaatatcttctcgctgttgacgggtcaacgcaatgattttgtccatcctctcattcctcccattaaaaatactgtattactatatcagaacaaatgtttgatttcaaattgtctatttaatccctttctggtaaaacatttaattacaaggagtgatattatttggatttagacatacagcccgtgaggttgagtttaaaagaatataaacaagttaaacaattatatatgcgcgcatttccgaaatatgagcgagaaccgtggacgtggctgctcatcaagagtaagtatcaacgcgctgactttatggccttttatgaccaggaacagtttgttggatttgcttacgttattcacagtcacggtatgcattatattttgtatctcgcagttaatgatcaaatccgttctcaaggatacgggacacggattattaatgaacttcgtcgcctttaccctgaggattcgctggctctggacgttgagcagcctaatcctcaagcggcaaataaccaacagcggttacgacgacttaaattttatcggcgcaatggctttttcccaactccaaagcttttcaaagaggaaaaagtcacttttcaagttttagcaaccaataaaaaaatcaaccaacgaaagattgataaggcctttgagtggttctcatggccgcttggttggctgattcaataaagattttgattttactagtttgaggctgttgaaaaagcttttttgctttttcagcagccttttttactgtcaagaaaataaggtttacaaaagtgttacaatttatgtaagcggatacataaagaagtgataacattggtagaaccattatttttaaagccagtctttcatgagaaaatttggggtggtcgacaccttgcaactgatttcggttaccaaatccagcgggaacaattggggagtactgggcaatttctggccatcctcatgggccaaatatcatcaccaatagtcaatacaaaggccaactattgccaaaagtttatcagcaacatcctgagctgtttggtaatccacgctcttctgtttttccattattaacaaagattcttgatgctaatgctagtctatcaattcaagttcatcccgacgatgcttacgccgaagaacatgagcacgaactaggtaaaacagagtgttggtatgtcattcatgcagaacctggagcttatttaacatacggccataccgcaaaaacgcgcgatgagcttattaagatgatcgataatcaccaatggtcaaaactttttagtagaaagccagtaaaaacaggggactttgtctatgtgccaagcggaactatccatgccttaaataaaggaattatcgtcttagaaacccagcaaagttctgataccacttatcggatctatgactatgaccgtcgagataaaaaacaggtcagctacgccagcttcatttaaaacaagcaaaagacgtgacaacagtgccatttactgagccacaaattaacccccgcatcgtccataatgatagttcaataattactactttaatttctcaacctgactcaccattctttaccgtctacaagtgggagatcaatgattaaaccagcttgacctggtaaagaaattgggcgctactgaaacaattaataacacggctgaagatcccgtcaaagcaattaaggaaatcgttccgcgtggtgtaacttatgcaatcgatactaccggaaacaccggtgtaattaagtcagcaattgatagtcttgccaccgctggagaatgtgtcctcttaggagtttgcggcgatattaccttaaacttaatgaatgatatcttatcagaatctaagaaaatctctggggttgtcgaaggagatagcaatccccaagagtttattcctcaactagttaagtactacaagcaaggcaagttcccccttgataagcttgttaagtactacgattttgctgatattaaccaagttatcgctgactcaacaaacggaaaggttattaagccaatcatcaaaattgatcctgaattagctaaataattaggtgaagtgtttttatgaaagtaatttttgtttgccttggtaatatttgccgctcaccaatggcggaagcaatgttcaaaaaaatggttgcagaagctggccttgctgatcaaattactattggttcagccggaacaagtaacattgcagaaggttcacctgctgatagtcgaacaaaagccattctcgataaatatcacattaaagacgacggaatgattgcccgtcaattgcaggacagggattattatgatgccgattatattatcgcaatggatcagatgaatgtccgggacgcaaaagatatggcaccagctgggttagaaaataaggttcatggaatctttaaagctaccccaggaaaagaaaattgctatatcgttgacccctggatcactcaccgattccaagatacctatgatagcttaagtgaagctctccccaattggcttgctaagctaaagaaggaaattaaataactgtttatcaaaaaacacgcctgaaaatttcagccgtgttttttctttttattggtaattaagatcgtcaaacttcttatcagcgttttgttgtgccatatcctttgattggtagtaaacagcatctacccaatttccggcacccccggctgatacaagaactttaacctgctttccatcgattgtttcggtcttaacagtatatgatgaaccgtcaccggcattttgaacccaaccacggatatttaaccatcgtgatccatccatgttaaagaaactggctttcccccagttcttagtagcgttttggattccttcgttagtatagttatcctcgtcttcaccccactcagaatcctgtttaaagagttgagttgttgtactgctattctcaccactgtaggtaaaggtatgaggaccaaatgttattgttgaatcagcatcattatctgccgaataccatgttccctgcatttcacttggaacatcaatagtaccactgcggccatacttatgatcattgccagaattactggtgcttgctgaggaattgctatccccactgcgcttatcgactacctgtgccttagcagctaagtcattaacgagctttccctgaccttcttgattaacataattggccatttctgactttgagattgtggcgagtttagtactcttttgattttccttgacattttggtagatgtttacatcatcgttattaacagtgtaaaccaagccctgtgactttccaccagcagtcacatcgtaagctactccttgtcctccatcactcaattggtatttagaacttgggtaaagatttacctgcaatccctctttttgcgcttctttagccatggcagcccaattcccaccataacgaaggccacaatacgtactaatcaaactaacagcttcttgggggctcatgttatcactattaactttcacattacttttagccactaataaactactgcttgaggcagatgaagaattagccgctttattgttagcctgatttccacaaccagctaataataggcccatccccgtaaccattaaaaatcctatttttttattcatattaatatactcctataaaaaaatgaggctggagaaaatttttgttttctccagcctcaactgtttttatgaacaatagtaagataacatggaaaataaccacaaggctcaagtcttagtacggacgataatcgccgtcttagcttagtccaccgccttgtcgagggggttatttcccacttgcatatttaactaagcccgtgacttgtagctaccatcagtagtgttgatgattaacttgtcaccattcttgataaatgcaggaacgttaacaactaaaccagtttccatcgtagcaggcttaccaccaccatcgatagtagcacccttaatcattggttcagtttcagcaacagttaattcaacagtagttggtaattcaacaccaatgatgtcgccgttaacaaagtttaagataaccttcatgttttcaacaaggtagttcttgtcgtcaccaagcaagtcatggtttaaactgtattgttcgtagctttcaaggtccataaatacggctgagtcaccttcatcataaaggtattgagcagaacgcttgtcaacgttaacttgttcaaccttttcagatggacgcatagtagtatggacaattgaacctgaacggaggtcttggatgtccatttgcattaaagtgttacccttaccaggcttgtggtggttgatttgaagaacctttaataacttaccgtcacgttcaaaaaccataccttttttcaaatcaattgtttgaatcatagtataaaaactccttcatataaaactgaactcttttaccgattaatgggactttgctttaaagcaagccttaatctttggcttcgttccgtgccgttaatcatagatagttaccatctataatttacattcactgtctattgtatcacattccctaatcacaacaatagcagttgttaggatgttttatcaataaaaaactgtctgcctatttcataattttcaatagacaaacagcttttttctttgatcgatacttctaaaccagctcaagatgtaattgcttttcaccgatgaatccagcgcgcttaagaacaaggtaaagagcaattgaaagaacagcgggtgctaccacgccgaaaaccatgtatgtgctgaactgagcccagccgcgtgataagtaagcaattggtgcaatcaaggagtttagtcccaatcctcctaaggtcgatgttgaacggaaatcaaacagaactgttgcaattggtgcacaaacagctgctgaaacaaccgttggaactaaaagataaggattgatgaggagattgggaaattgaactttaggggtaacaagtccttgggcgatatttgcgccaaggttattttgccgaaatgacatcgcagtaaaaccaacaaattgagcagtagtaccgatcaaggcagccgccgaagagatcggatcaagcatcaacgcaacggccaaggctgcagaagaggcaggcgtcatcagaaatagggcccacacaacggaaattaccattgatcctaaaactggtgaaacttgcatcgaatgcgcaatgtaggcggacacagcaagaagcgccggcgtaacaactgccgcaacgactagaccaaaaccgatccccacggctaacgcaccaaatggaacaagaaccatatcaagtggcgtctttccagttaaatacttaccgacaagaacagcaacaagtgccgctagaacagcagaaacaggttggccagtagtaagaaccggtgctcccgctgccgccgcagttacttgccctgttgcagtcattcctttaaccgccgtatcagtaaaatgaacaccatttgatccaacggtagccgctaccattgatgcaaatgtaactaatgtatttgtgttcatctgtgaagcaaccgcaaccccaatagcaggcgctaataatgcttgagcctcaccaccaattagggtaaggacatggatacctgtcaagttaccaattgtttgagttaataatcctcctcctagaacgaccaaaatagcattagccaccgccgcaaaaattcgataggccacttccttgacctttgatgaattttgataagttgcattagctttagaattgctaactcgattttccatcattaacgcctccttataatttgtttttgtttaatgattgttgttagtttatcggagcgaaaattaaaagtcaattatatttctcatttatttttaatttaaatcaagaaattgtttttattaaattctttacgatcgtcacatttaaagtaagcgcttttgtaaatgaattcttaagaaatcataaccacccgtcaaacgggtggcttgcacataggctataagccgataataaaagccggcgtctcaaggcgctggctttcgctttgctcaagccaaaatgctctgactactttgccaccgctttaagcggtgtttatactacctcacttacccttaaaagggtccgaatattccacacttgttagcttatccattgctatatcatgtttctcttgatctcggatatgcttctttatcgtggattcattcaatccaactgtacttatatagtagcattcagcccaaaaatgtcggttcccatatttatattttaagtttgcatgtcgatcaaacatcattaatgcacttttctcttttaagtatcccataaactactagacacttagcttcggcggaatacttactaacaagtgcacatgatctggcatcatatgaccttcaattatttctactctcttatatttgcacaataaacgaatataatctcttaggtctcttcagtattgattgaagatcgctttacgtctatactttggtatgaatacgatgtgatacttacataaccacttcgtataggctaagctatttaatttattagccatatttatataacctcttttcccttattgactttggcttgaacacctacatcttaaggcaaaagaggccttttttatataatttttatctcccacccgcatagcaggtggttttttgtttcgtgcactcgctctgctcgcgcactcaactaggtctaaagacattaataatcatagccaccatttgtggtagtagtggctgttgttgcaacaatcttattttcttgaattgcttcattggcaggggtgtcagcagtatttacattgaaagtaagaaaagcatttttattttcttcttcactattagttttatttacagaagaagcggaacttgaattttcagtagcctgagcagttgtagtcttttgttcactggttctagaagtgtcagtagtattagctacaatatttatcttcgtttcagcagtatctagggcagtctcatcccctgaattttgcggttgcgccgattcagctacaataccacctgcttgcgttgttgctggggtagtcgtatctgcttggacactagcatttactaccccagttggcccaaaagccaacataaaagtagcacaggcagtaatccactgtttcttcgccttatatagtttctaattcttatttttgggagtcatactccgtaaaggattatttttacccataagatctcccccgtctcttaatcatttatccatctataattataatccaatacaagttcttttaaattaattttttatcatcctattaatttaaaggtcaacaaaatttatccttggcattgttaagagcaaaattaataaaaaaacgaatggtcgctttacgcttaatcccatccgctaccacaatacattagtcattgcttttcgttgtttctttcggttgcttctttgcaaataagtgatacacgagtcgggcaaccagtgcttgtaaaacaatcgttactacgctttgtgcaagttttcttacccatttcataattttagctcccttacttaaatcatgccttgtagttaaacctaatcttctattactttaattatactcgtttcttattaatttgtttaatagaagtctttatcttaagattagataaaattattaattttcataataatcttcaattcatcaatataaacgcacaaaaagccctttttattcgataattgagaataaaaagggcttaaaattaccacaatgttgtcttttggctaattataattttattattaattttctagataatttaatggcttatcaacattcacctttgttccttgatactttttagcaatccattgttgaatttgcttattatggtaaagcttgactaacttcttatattctttattatcacggttcttcttagcagttgctaaaacattaatgttatccttcgtgctttgatcaactttttcgtgataaatagaatctttcaacacatttaaatgaccagttaaagcaatcgtattaccgattaatactaaatcagttgactttaatactcgtggtccggtggtatcatcaatttctttaaattgaaggttctttggattagccgcaatctcattggttccacttgttgccccaaagcccggcttcaattttatcaagcctgcactttgtaagagcaagagaccacgcgccgtgtttgctgggttattagcgatcgcaactgtggcaccatctggaatgtctttaacactcttatacttatctgaatataagcccattggttctaaataggtagttccaatcgccgctaattgtgctttcttattttccttattataagcttgcagatatgaccatgattggaaagcatttacgtcaatttcaccactagcagtcgctcggtttaaagctacgggatcagtaaagctcttgaccttaatcttcaaaccttcacttttggcctgtttactatttgcaatgtgttgccaaacctggacatctgggccaatcgttccaacagtaatctcatcgttgcgggtaaacccaccattagcgcccacactaagtccagctgcaactaaaatcactactacaataccaacaatccaccagccggtacgctttttctttctcatcataactacccctttacttttgttttcgctattcgtcataactagtcgcaatagccaacgggatccgacatgtcgttattctcgagaaatccttagtcagcgtttaccaaaattattattagtcaaccacgtggcgttcaaatggcttatctgaaatcccttcatcaagaatcttctttgaccattccttagcagagaataatgaatgatcacggtagttaccgcaagattcaatcgttgttccctgaacatcttcccacttagtcttgtaggcaatttcttcaagtgaggacttcaaggccttggcaacttcagtagttgagtgttcaccccacgtaattaagtggaaaccagtccggcagccaaatggggaacaatcaatcacgccatccaaacggtcgcgaagcaaaccagcaagtaagtgttcaatcgtatgtaaaccagcagttggaattgcattttcatttggttggactaaccgtaaatcatagttgctaatcttatctccctttaccccttcttcaacggtaattaaacgaacgtaaggtgccttaacctttgtgtgatctaatgtaaaactttcaactttagccataataaatctctccttttctgcctgatgagaatgaatcttggaactaaaaaatccctaggaacggcaatccaaccaattcctagggacgtttaatattcattaacgtgataccaccctaatttagccttatctcacaataagacccgcaagaagtacataaaaatactccagcacggtaacgggtgctaatcgcttgctgctaacacgtatgctcacagcatcagtctgctccaagaccatcttcattattcgttaccatactggttctcatctttcctagctctctgtaatggcattaaataattactcatcttttctaagcaatttctaatttaattgtaattataatatccttatccttactaattgtcaacacctatttcaaaattattcatgatataacgttcttaacgttttagcatcatttttagttattccgtttttgatgtttcgtgggatcatcacactatgctcatattctggagcgtgagccaatccaagggcatgtcccagttcatgttgggcaacctcacttcgaaattctttattagtataatctaactgattagggtccaaagttaaagttgccttatgcaaggtattcgtagtcggatcatattccgtccgggttgagccgagttcagatgttgtatagccaacaccattgtttcccgtattatttcgtgctagatcaccatcagccgcaataatattggccttatcttcgttcttagtccagcggatatgaactgctttcgtcttattccattttttgaccgcatcacgaaaagcccactttaattttggatcagcagtttccatgtaaatagtaatattctttttcttccacctaaatccttcaagcggtgtcggtgtattttctgggattcttagccgttctgcatttggtcgttggccgccattagaaaactgaaaatcattactatcagaagaatcctgactaaaaaatgatgattggaaaggttgggaaggcgcatctacatcagcatagacatgataatcgctaattccaaccgtccccacgactaagagtgctactaaaaatcgacgcatttaatcatccccattccataaagttagaaatgacaacacggttcgaggcgttcttgccagaaactaacaatccagttctgggagaaaaagccgatcaccgttccaatattaaaagcaaagattgcatgatttttaagagaacataacaagataatgataatgggcaaaataatattaaattacttcgtgaatttaagactggcgcggcgctttaaatagactgtcaacttatcatgcggttgaaaacaacaattacactgttgataaagggcatacccggcaaaggcaatcactaagccaagcaggttaaaaccaaagcgcagaaaaatgttcatcgtatcaattccccaaaatcgccataagttcgcaaatagttgcatgaaaatactgtacggaactaaaaatgttaactcccagccaaattctttaggagcaaattcgccaaccaaaagaatatgtagtcatcgctaaatatcccagcgtccaattatgttcttcttctaactctacaatcgcttcaagtaactctgcttgctcattataatatcgacttggctttcgattgagccatttgtaataaccatctcgcgaagaatcagctattttacacaactggctaattgaccatccattttcctgatttagttctttgatcgcttggtaccggagtcctttttcacctcccgattgcgtatttttgttaatttttttgcgaacgcaatctctatcttttgcttttctagctgagcccttaataagcgattttctgccttgagtcggtcaacttccgtccacttctcttctggcttagctttgcctcggcgatcacgaagtgattctgggtcattaccgcttttgcgatacttttgataccagccataaatctaatgcctcatctgtttgttgatattgttcaaccaatgagtttttaaattctttagagtagctttgattatgatgacttgcttgaagtcctggcattccctgatacttgtatagaagactccaccgcctgatagttttttggctaatcttgtatttaattattaccttatggattccatttcgtaaaacttcattgaggattaaaaatttttcctctgccgagtatttagattttcttcccatagaaaaagccctccataactacctcggttgtcttagaaaggatatattcctcatgactaatgatatcaacttttggaccggaatcaaggacccttacttaatcacctacactgttattctcggcgtaacttccaatatcactggttatccaatcaagaagtcgtcgaacggctacccgatttctctccagatctaagggttactatcaagacttaatagccacgattagtaaccgcagtcaggccttgttagatcagttaatcaagcggaataatttaccaagtgcgatgcgacgagttaagcgaacccttgccaagcaccgccaggagatcattgccagcttttacatccgactaaccaacgggcctatcgaaggcactaataataaaatcaagataatcaaacgaaccgcatatggctatcgtaacttcttccattttcggattaggattcttatttcgttgaagacttctaatctcatgattcgtgaattatcaaaaaagagaactagaccaaaagccaaagtagcttagtctagttctccaaattctcttcatccttaccgattgacaaagagccagggttcatggtatggtttaattatcaaaattaaaggaggtcatcatgatggctgataaggtaatgacgagggatgaactagcaaagtacaatggccaagctggtcaaccggcctacgtagcagttgaaggtgtaatctatgacgtctctgctaacccggcctggcagggtggccgccaccatggaaacttggccggtcaggacttgaccgacgttttgcttgaaaagtcaccccatggtaaacgggtattaaaggatctgccagtcgtcggtagacttgctgaatagaacaccaaaacagctgcggagggaaaatccacagctgttttttatataacaccgtttgtaaaattaagttagaaaaatagaaaggccatttgtggtagacttttgaatacccctaaacaaaagaaaggaaaccacaaacgagctgacaatcatcgcccattctttcgtgcaaaagcttaaagcgtaccgagtggcccaaatgatcaaccgttgtgccgaaaccgtttatcgcgtttatcgttacctggaaaccggtgcctcaattgctgattatcaagatcactatatgcgcaataagcaacgttgtggccgaaaacgtactcagttgtcactggctgaactcacttatatcaacgacaaaattgcccaggggtggacgcctgataccattattgggcgcgctgagcgcccaattagttgtaacctgcgaactctttaccggatgtttgaacgtggccagttcggcttcgatgtccgttccttgccgatgcgaggtaagcggcacccgaatggctatgtcgagcgcagcgggaaggctggccaattggggcaaagtattcacgagcgtgccaaggactttccgcactatgccactgaatttgggccccttgaagctgataccgtccaaggtaaaaagcaccaaggggcggtaataaccctgaccaaacgccaatcgaaggtcgaaattgtactcaatgtgcacgaaaagacggctgatgcgattaaccaacacttaagtcagtggcttcggaaattcccgcggcacttcttcaaatcgattacctttgacaacggaaaagaattcgccggctggcgcgagattgccaatcaatttgaccttcacacttactttgccgaggttggtgctcctaatcaacgagggctgaacgaaaacaacaacggtcttttacgccgggatggcttaacgaaacagctagatttccgcaatcttcctgatgaattggtaacccaactgatgagtaagcgaaataacctgccccgtaaatcactaggctatcgaactccatatgaagtattcatgtcttacgtcactgatgagcaactattttctttctaacttaaattgacatttcgggattttatcctccccaaacgtaattgaactactcccacttagctaaacctacggtttaattgcttgaagtgggagattctggaaacatcgcatacttaccctaccgattctgaacgaaccttcaagcagaggttacgactattagccaaggctcgtcccgagcctaactttatctatcggatagctaatcctttttgcaagatgacttgtgcagcgttaatatcacgatctaaatgtttaccacagtttggacaatcccactcacgtaccgctaaccattccgatttattcaatcctaaccgatgattattcttcccacaattagcacaaatttggctagtatatgacggattgacctgaataagctttttaccgtaccactcacacttatattgcaacatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgtcgatacttcgccaccataatacgagctttctgataattcttaaaatcatctaattgccgtggaactaacactttattatgatgatcccaggcgatttcctgctgagcctttaagaaccgacgactacgcaatttctcccaacgatacaactttttatggtatttgtcttcaaaatgattgatcggttccttgcatccatctgaaagattaagtaatgacttaagtcctaaatcgccaccaatatatttacttgttttaggaagagtttggttttcgctttccactaaaacagtaatgtaatattgaccagcaacgttcagacgaacagtgacattcttaattttacccattggcaatcgaccagctctaaaatagacgataccgagttttggtaattttatatgatggcaatctaaaactttaatattgccattaacgtactttgaattgtagctctgagaatattttctggatttaaatcgagggaacttattttgacctttaaaaaagcgttgaaaagcatcggctaaattgcgattagcactttgcaaagcagttgattctgcttgtttcaaccaaggatactcaaccttaagttgtttcaacagattattcatcccaaaggcattcacaaatttagcttccggattattcttgcgccgttcaatttgcatattaagcatttgattccatacaaaacgaacacaaccgaaggtttgccagagctgatttcgttgtgctgaatttggatagatgcgcattttaacggcttttagaaccattattttctcccttgactttcaatatatcgttttacaacttctaaaggcgctccaccagtgctaattaagcaatagctttgtgtccaaaaggctgatttccaaagatattgcttgatttctggaaattgttttttgaccattctggagctagacgatttgtaagcatttaaaatttagccatttccgtatgaggcgttgctctaaacaaaacatgtacgtggtcctgatcatgattccattcttgcaaattaatgccgtatgcttgtcccacaactacaaaacgatgtttaagatattcagatatttcatcgttaattacttttcgacgatacttaaccaccattaccaaatggtaattaagtaagtatactgaatgctgatttctatctaattctattgttatcaccacattttatagatatatactaaatatatcatagaacaaaagaaaaagcactaacgcgctttaagagagcgattcatcccctacttatagaagtaggggtattctcgcaaatttatggataaagaccagaaagaatgcttcccttctttccagtctacctattaatcttcaacttttagcgtcgttcattgccttcatgatagaagattctttgaatgacaatccttgatcatttggatatcttcttcacttaattcaacagtgtatttagccatgatcttcctcactttacttaaaaaattacacccttactatatcacatcacaggagcagtgtctggcttaatcagtaaattaagatcattaattgacattcaactgagatttgctaagattaacattgaattgcataaacggggagcttgcagacaggctgagaggggactatgcgtctcgacccaatgaacctgatttggataatgccaacgtaggaaggattaataaaggacgaccaggatcaaagtgattactggtcgctttttactttgcactatcttaatcaaatcaaacttaaggatggtggaattatgcaacgacagacaacaattatcgaaaacagcatgatttggtgtggcgccgggatttcaattgctgaaatcctaactggaacttacttagctccccttggttttacaaaagggatcgccgtaattatccttggccacattatcggctgttttctgctctttttagctggaattattggcggtcagcaacgtcttagttcaatgaacgccgcaaaaattagttttggccaaaatggcagtaagttttttgccctattgaatgttctccaattgatcggttggaccggcatcatgatttatgatggtgcattagcagccaatgggggctggcaccttaatcaggcattatgggtcattttaatcggcgccctgattattggctggctgctcgtcggggttcggcacctttattaccttaaccttgcgaccatctcaacattattaattctaagcggtctcctatgcgccgccatttttacccaccattctaccagttcaccaactggtacattgtcatgggctcaggggatggagctagttatcgccatgccattatcgtggttgccacttattagtgattacaccagtgttgctcaacgacccgtgccaactagcgggattagtgcagttgtctatggcctgactagttgttggatggccttcatcggtttaggagctgctatccttactcatgacattaacatcgccacgattattttacgggccggcttgggaattgccggtttatttatcattattttttccacaatcacaacgacatttatggacgcttattctgctggtgtttcttcaaaaacgattttcagtaaatggtcaggaacaatggccgcaattggtgcaacaattctaggaacaattagtgcgttgattttccccatggacaacttcagtaattttctttaccttattggttctgtctttgccccaatgattgcaattcaaattacagattacttcatcttgaaagtagattatcgtaaacaaaattgtcaatggactaacctaattctctggttgattgggtttatcatctatcgaattctgctaaattattcatttccactcggcagtaccgttaccacaatcattatcatcatcgcaataacctggggtacacagcaagttcgcaatttggtcaaagtgaaataattatagttttcctactaagtaatagtattattaatgcaattacaaggaaggaattacttttatgaaaaaaatagttgctaaacaagtatcaatacttgaactcttctatgatttaatttttgtttatgcgatctctcgaataacaatgatgattcatcatccaatcgatggtagcttgccgccaagaatatatattgaatttatcattgtcgttatcttcgttttacaaatttagctttatcagacagtctatattaatcgctttggaacaagtcgggccgtcgatacggttggcttattgattagtatgtttgccgccatctatttagctaataatattaatactgaatggcggttaacatttcatgcgttcaatctttcggcagcactaacaactattaacttaatctttcaatatttatttggctctagcactcattttaaacgagatcatgatctccaaggatttattattgcgcttggcttagaatttattcttcttgtaaccgggctgattattggttatcagtatggtgtctatctctgcgttgccggtggtttaatcggctttttaatgcccttagtgatgtaccgcatgtttaggccggaacaagtcaactttccccacctcgtagaacgcctaagtttaataattatcattacgttcggagaaacacttgttaacattacccattactttaagggcgctatctattcaccattagcaatcgcaatctttctaggagtagctgccctattcggcgtctatacattgctagtagaacgcttcttaaatcatcatcagcatactcgcggctttattgcgatgtacactcatgtagtaatgattatcagcctactctcgattacgactaggattatctatatggctgatgaagaagtatcacgtttgtttcttagttgctttgtcgcatctaacctcatcgtcttctacctttgtctctggctttatagtttttataatcgccgccatttacgcgttaatggtcgagatcttagggcaatggcgatcgtccttttactaggatcacttggcattattttatgtcgcgaaaataacctaagtttgatgagcgcatttgcgttaaccaacgtggtcgaattcggcttgttggaatggaagctgcaaagaaaaaaagccctctaaggagcctcacaacaactattcatcacataattagttttcatccgcatttatattccatttatcctaataaccatttagggcagatggaatttttattcccgaaatgtcaatttaagttagaaaaaaagtagttgctcatcagtgacatacttcatgaatacctcgtaaggtgtttgatagcccaatgacttgcgaggaatgttgttccggtaactcattatttgagcaacttcttcatcagctaggtggcggagatcgcgacctttgtggagcccatcgcgccgcagaaggccgttgttgttctcgtttaacccccgttggttaggtgcccccacctcggcaaagtaggtctggaggtcaaattggttggcaattgctcgccagtcagcgaactccttcccattgtcgaaggtaatcgacttgaagaagtggggtggaaactttgccaaccattcctgtaagtgctggatcacactggtggccgttttactatggacgttaagaatcacttcgactttggaagtccgttctaccaaagtcataacggcgccctgatgtcctttgccctggacggtgtcggcttcaaggtggccgaattcacggttaaagttgggaaagtcgatagcccgttggtgaatgctttggccaagttgaccggccttccccgccgttctacgtaaccattggggcgacgcttgcctttcatcggcaaggtccgcacatcaaaattgccccgctcgaaaaggcggtaaagcgtccgcatactacagctgagtggctgttcagcgcgtcccataattgtgtctggcgtccagccttgagccactttggctttgatataagttacctcatcagtgggcaattgaatagccttccgaccgcaatgagccttgttttcacgatagtgttggtaatattcttggagcgtgtggccggcggccagaaagcgataaactcggtagacggtttctaagctccggtgcaaaagtttggcagcccggtaggcttttactccttggtcacgaaaattagcgatcatcgttagttcgtctatggtaagatgatggtaggtcatttgtggtgtcctttcttttgatgtatgggtattcaaaagtctaccacaaatggctttttatttttctaacttaattttacaaaccgcgattttaaattcagttcaaatcccatatgtttattgtcaattttgtcatcaatataaatcgtaccgcgttttataaaaccaatatcttggcctattttttgaacaggaatatttttgtaatgagtatcataacggaaattccttactccttgcaaatacccaaccgtaagtagattggagaagatatatttcccaaaaccttgaccattgtgggaaggaagggctgctaatcgatgaatgattgcatatggctcattttattttaaccacgatccatctttaatctcttcatacgtttgttccggggttagttgtaaggtagccgtcccaacaattttttgattatcaattagcacccagttatagccagctttaatatcattttccatcgttttctggaaaggatgaccatcttgccattgtggattacccttttcttttaattgtgctcgtgcctgttcaataattgtcatcacactttgaagatcatccaaagttgctcgtcgtaagtaaattgccattatcttttctccttaatcatctctcactcctaacaacaaaattctaatatattaatgtatggtcattttatcacgattaattattaaactgatggggctttagctaagtttaagtgttttgtcacagcgttttcattttaaggagggaatctcatatttatccatattgaactactcccacttagctaaacctacgatttaatgcttgaagtgggagattctggaaacatcgcatacttaccctaccgattctgaacgaaccttcaagcagaggttacgactattagccaaggctcgtcccgagcctaactttatctatcgatagctaatcctttttgcaagatgacttgtgcagcgttaatatcacgatctaaatgtttaccacagtttggacaatcccactcacgtaccgctaaccattccgatttattcaatcctaaccgatgattattcttcccacaattagcacaaatttggctagtatatgacgggttgacctgaataagctttttaccgtaccagtcacacttatattgcaacatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgccgatacttcgccaccataatacgagctttctgataattcttaaaatcgtctaattgccgtggaactaacactttattatgatgatcccaggcgatttcctgctgggcctttaagaaccgacgactacgcaatttctcccaacgatacaactttttacggtatttgtcttcaaaatgattgatcggctccttgcatccatctgaaagattaagtaatgacttaagtcctaaatcgccaccaatatatttacttgttttaggaagagtttggttttcgctttccactaaaacagtaatgtaatattgaccagcaacgttcagacgaacagtgacattcttaattttacccattggcaatcgaccagctctaaaatagacgataccgagttttggtaactttatatgatggcaatctaaaactttaatattgccattaacgtactttgaattgtagctctgagaatattttctggatttaaatcgagggaacttattttgacctttaaaaaagcgttgaaaagcatcggctaaattgcgattagcactttgcaaagcagttgattctgcttgtttcaaccaaggatactcaaccttaagttgtttcaacagattattcatcccaaaggcattcacaaatttagcttccggattattcttgcgccgttcaatttgcatattaagcatttgattccatacaaaacgaacacaaccgaaggtttgccagagctgatttcgttgtgctgaatttggatagatgcgcattttaacggcttttagaaccattattttctcccttgactttcaatatatcgttttacaacttctaaaggcgctccaccagtgctaattaagcaatagctttgtgtccaaaaggctgattcccaaagatattgcttgatttctggaaattgttttttgaccattctggagctagacgatttgtaagcatttaaaaatttagccatttccgtatgaggcgttgctctaaacaaaacatgtacgtggtcctgatcatgattccattcttgcaaattaatgccgtatgcttgtttcacaactacaaaacgatgtttaagatattcagatatttcatcgttaattacttttcgacgatacttaatcaccattaccaaatggtaattaagtaagtatactgaatgctgatttttatctaattctattgttatcaccacattttatagatatatactaaatatatcatagaacaaaagaaaaagcactaacgtgctttaagagagcgattcatcccctacttatagaagtgggggtattctcgcaaatttatggataaaattaaagaacaaacagcaacaggtttaaccgaattattggatcaagctcagttagaaaaagatgacctcgtagtgttatgtctttcaactagtgaagtccatggcggaataatcggaaaggactctaacattgagattgcctgggcgattgtttcgacagttgttaatatcttacgaaaacaccaactccatttagcagtccaaagttgcgagtaccttaatcgggcacttgttgtcgaacgaaatgtagctaaggagcgcggctttgagcaagttactgtcttcccttcgctccatgcaggtggtgcaggacaaattgctgcttttgaaaactttaacgattcgattgaagttgaacacattactgctgaagccgacatggacatcggtgatacctcggttggcatgcatgttaagtttgtccaagttccagttcgcacttcgataaaacaaatcggactggctcatacgacttatctccgcaaccgaccaaaattgattggtggtgcgcgcgcaaaatacgaatgggatccgtttgacaataaataattttaattatgaggctgcgagaaaactttttcaacagcctctttttttatacgaatcttgttacgatatcgtggaaatccttgtagactagctttgcattgtagccatccttgcgggagtgggactaaaaactcgcaagcaagtttaattctattccctttttcgttcaattatttaactttccgattacccaattcccaaaaagcgagggccgaggcagccgccacatttaaggaatcaacgcctgtagccatcgggatcttaattgtaaaatcactctgcgtaattgtattttctcttaatcccggcccctctgaaccaaggataatggctaatctatccaccttagctaactgaggatcatcaatatcaaccgtgttatgacggagcgccatcgcggctgttttgtagccagctcgatgaagaagatcaactccttctgactgccaaactttagcatcaacataggtccacggtacttgaaaaaccgttcccatagctacccgtgaggcccggcgataaaggggatcagctgagttgctcgttacaattaccccatcaattccgagagctgcggctgagcgaaaaatcgccccaatgttggtgggattaacaacactttccaggattgcgatacgcggatggtcactgggcatagtagccaaaaaattatttagacttggccgttcgacgcggtacatagctgctaatgctcctcgtaaaagattataaccaccaccagccaactgccgaagtaatttactattaactacataaattggcgtttgttctaatcccctagtttggttaattgccatctcatgatccaaatcagccaagtcacgctctagttccttttcttctattaaaagagatgctggccgataacctgctcgtaaagctcgttcaatcactttgggactttccgcaataaataaacccggattaggttcaagagcatgaaaaagttgtgcttcattaagtcgcatataaggatctaaatctgatcctgtaagatctgtaagaaaaattaaattatgcatattaaatttaccttatcttaaaaactgaattagtttagtatactcttattttcgacctttttcatgacggttattttataacgagtttcgtttgccgatcgggtaataaaatcacgttgaatcaaaagagaaacaatcattgctaaagcatcaataattatgaaaacaattaaggtgacatagtaattgtggagaacttggtgtgtgtaagaaagaagaaggggtcccaccatcccagcaattgcccaggcagttaagatatagccatgaatagctccaagttcttttgtcccaaaaacgtcaccgagatatgccggaatcacagagaatcccgccccataacaagacattaataagcacaacgctaatgcaaagataaatggcgccttaaataaaagaagaacaaagagcatcacaatatcaagaacaaaaatcaaactataggtaagtggccggccaataaaatctgataaagttgcccaagctagacgaccaaaaccattaaatagaccaatgataccaaccattacggcagccgcactcgctgtcattgtcgtcatgtcctgggccattggtgaagcagctgaaactagcccaattccggtagtgatattaataaaaaacataaaccataggaaggcaaatgtccgtgtccgcaaagcctgattagcagttaattcgcgaccagtcaaacttatccgttcagcattcttagcaatcgctggagggagttcatgtgatcgtggcttcttgataaattgggcagcaaccagcattacaacaaaataaaagcctccgagaatgtagaaggtatttacaacgccaacgttcgccattaaactttgcgcaattggccccgtaagcatcgctgcaaaaccaaagcccataattgctaaaccagtagctagtccccgcttatcgggaaaccaacgcacgatagtagaaaccggggttacatatcctgaccctaatcctaagccacctattactccatatgcgacatataataaccataattgatgagactgaatcgctaatcccgttaaggcaatcccactcccatagcaaatacttgaaatagttccagtaactgttggcccaaatttttctactaaacgccccataaaggcagctgacatccccaaacaaaagatagctaagctaaatgcaaacgatactgaagtttccttccagcctgtatatccagagattggtttggtaaacacactccatgcatagacactaccaatcatcaaatgcaaaattactcctgcaatagctactccataacgatttcttgttttcggcatcttcactactccttctctacataatttacgaactttatcataaattaagctctataagttcgtctatttaaaaatatcatagagcaactaacttatcaataagaaaaaaacgaacaatctaatttagcgatagcatttattactgcttgaaacttacctttaatagcaaaaaacacccagcttttacactggatgtttctcattggcaaatatgttgtttttaattgagttgacttagttttaaaactaccaaagtaccatcatatcgcagttccaactctaagttacattatataattctattcgtactcttttgtagagggccttgatatatcagtacttcaaccgtgatttagcttatacggtagaaaaccggtagacaactcgtattacaatgccacaaattgattaccattgaaatcaactaaagagtgattaggatattcaattttccctattgctccattcagctggtcagcaacagttcgattacgaccacgccataactgtgaataatacttaagtgttgtggtcggcttagcatgccctaaccgttgagatacagctaaaatatcaacattgtatttattaattaacaaacaagcatgtgacgtccgtaattctttagcctgaatacggtgaactcctgctaaatcagcatatcgattaacaatattattaacggttgaacgatgtaatggttcatcagtggcactcagtacataatgatcatcaccctgttgcggtaaattatcatactgtaactttttccaccactttaaaagatccacaaggtcagttggaatatcaatggtccgcatccccgcagtagtcttagtataattcttgcgttttttatctgggtctttagtattcgtcaaagtatgactaaccttaatatacccatcagctaaattaatatctgaccaccacaatgcaagtgcctcggaaacacgcattcctgtgaaatagtaaagattgagcatcacgtaagctaaggcaccttcaatatcaccaatataacactttgagataactttcttgaattcttcaagcgtctaatagtgaataatgtggtggcctttggaaatcgctcccgttgccttcttaatcctagaaggattttgagttaagtaatcaagctcaactgcactatctagcacttccctaaacaggccatataccaacgaggcatacgattgcgaatagcccttctcatctgagagtaaccaatttctaaactgtaaacaatccactggctggatttgcttcagtttcttgttaccaaaccactttaaaatcatctcaagaactggttcacgagacaaccaagtgctttcttcaacatttccacgataagttggcttaaacactttattgtagaaatctaataacttaacgttaccggactgcgttggaaaaccatttttactgtactcatcgcggatacgctcagcttctaaatgagcatcacgcaaggttttaaaacgattaccatttttatcccgacgtgccttcttgattatcttttttccagttaaaggatctaagcctagataaacgctaatataaatatatccttgttcgccatttcgaggaggctgccgatacactgattaatatttagtctttgccatcagcgtcatcctcctcaagaggaactcccaaaacgacttcttctatgatagcacgaggtgcaacttgcaagcgaggattaccccaaaaagtttttccccgtttaaccatgacctgacgagtatcatgaagaatcgtttttgcttgattaggcttaaagcccatagctatcaactcattctttgaaaccgttgctttcattgattaccaccaactttctgagatggtgtataatatgggcgacaatgatttggtagaattattgtggatggctttgcaatgctttggtcggctgcaaagtcttttttattctgtaaataggctaaaattagcgattgcctcataggacttcgtaactcaaacaagtgaacgtactgatgattacttacgttatgttgtttcttataatgttcaagaagcagaataggtaagtacttactaggatttccattccagatcatacaatatcgaatcgctcgataataaagatgaggatacatgcttcgccaagtaacacctattagctcatgaatcgaaacatcgttgcaattttgttcgcaatattgatcaatcaacgtatcaatacattgaaaatagaattcaaaaacattcaattaagctcacttcttttaataaaataagcttgattcaaagagtaagtagcgctctccataatctagaatataaaagcgcttaaactcttctttagtaacgcccagttcttcacgctcctgatcaatctctttttgacttagataattattcggttgtccgttaaattttaagccagctggtcccaatttctgatagaaattcaattgagtatcactaccaaccagcttcagcatctggtcgccagcgtagttcatgaacatgtcatcagcataaatgcgtgatagtcgacgcaatagcaataaccgttcaccagctggcttatttttgaaataatttacatgattattctgattcttcattaagtcattccaaaacttatcgctagaccgtgtttctttaatagcagtgaatagccaacgtcgctcagataaggtcatgttaaagaaagtctggtaatttttattttaagaattgattgtattttttcataaaaaaataccccctacattttcgtaggaagtatttttagtcaaccataccagttgacagatatccaaattaatgctttgcaaagaagtcgcggtagacgtccgggaccacccggtcggccgcttgccattgggcctggagccggttttccagttggtcgcccggggcaaagaccgcctgcaagtccgccaccatttggtcgacttgtgctggttggtaacggttgaccggggccacgtagcgcggcgcgtgcagcgtttcttcaaagcccatgatcaacatgttgttttcaaaggcgccccgcacggcatcgaggatttcgttgccacggttgatgtctaaatagacgtcggcgtgggccaccagtttccgcaccgtcttagttgcgacagttggatagaggtcaacgttagcgtagtggtccaaactcatcagcttgctggacatttccgtcaccgccgctatcgcgaagtggaagtccggcaagcccttgatcagactttcaatttccaccaactgatcagaattagtcaggatcaagatttccttgcgttccttgttgagtcgttggaacggataagcgtaaccaaggtagctcagctggacttgctgctgcggctggtcggctaccaaacggcgcaagttgtcgtaagcggccttggtctggacaacaatttcggcgttaggcccgaggttgccgtttaaaataaaatgcatgttgcccggaatcgcatcttggagcggttcttgccagaagagacgcgggtgcttaacggctgccccgagcttctggacgacaaacagcggcgtggacagggagttaaagttaatttggcgaatatccaggtccgcttgctgcaggtagtaagcaatgatctcagtctgattgttgaagaatcgtggctggccgttaggttggtagtagaccagttggccggtcaggtggttagagacgacaatttcttgaccggcccgggtcaggtaggtggtcagcgtcgggtgaccggcttcatcgtagtcggtcacggcgtgcttgaagccccattgattgtagtgatcaaccacccggactcggccgttgcggtcaaaccattccaccgtcttgaccggtcgggagttatcggtcgtggcaaaggtaatccgcccccgttggatccccatgtccattagcttgccaccgctgctgttagcttcaatcgcccagtagcgcggcaaatcaatctggttaaagtagcgcggtttgccgactaattcttccccggccagctgtaggtagtacttcagcggggaagtcacgtcgtcaggcaagaaaccatcatcgtgcaagacgaccgtcgggtacttttggccagccaccaactgggaaaattgcaggtctttgctttcgactgtgtagaaatcaaataaattaatcatccgcttgcacctctttcaacaattgggcccacttggcctcaatttctggttccaagtagtccgccgccaggtcataggacacttgttccgcccgttctaagtctaatttagcaaacagggctgctaacgtcgtcgtcaaagcgtggatcgcttgctcgcccgtttcgccgatttcgtacggaatcaaataaccattttcgtcgttgcgaataaaggtctgatttccatagcggacgtcaaagccaatcatcgccagtccggaacccacagcttcaagcaaggtcagcccaaagccctcactggtggaagccgaaatgtaggcttggtagccttgataaacatccgttaagttctggtgtccctttaagtggatgtaatcttccgcttgcccgtccttaatcagctgttgcaacttggcccgttcgcccccttccccataaatatcaagggtcaattgcgggaattgggccttggcggccatcacggcttggactacccaatcgaggtgcttttcccctgccaaccgcgaagccgtgatcagactaaacggccgccgcggcgtggttgggtgctttaattccagcaaactgccgaccggaatcgtaaagatttgcgggtgggcctggttgtacttagcaaattgggccgccaacagctcggtctggacctgggtggacgtgacgtagaaatcaatgtcgcggtggtgctggaagacatactcgtagtagttgttccacaagatatgatcatcattggtgttattgacgctaaagtgctcagcgtgcacgacgctgccgaccttggctggccccttgtgggctaagatttgttgagccatcccggtcccccggtcgacgataatcacgtcccccttctgcaaggccaaccgttccaaaaaggcggtgatcaattcttccttggacaataacagttgacccggcaggcggaaagtcgcgttatcaccggtcggtaattcttccatcgccacggagccgtcctcattaaagaagcgccgcaccatcagcttggccttaccatcgatcggggcgtaatattcgctcatgtagcggccgtagctaaagaaatcgcggtgaaagaggttgccgctgcgcacgtattcggcccgcaggacttgctcactgccagcgcaccgtaaaatggcccgcacgtagtattgatcattaaagatgtacgtcaccatgttgccttggcgttccactttcgttggttgctcggcaaaggtcgcggttaaatcggccaaagtgtaggtcgtcggcgcaattttaaagtcactaaaggcttggtagagccagatgacttcttcatctttaaagcccaggttggcggtatagtgctcaatattttgggccgaaataaaatcagtaaagataaattttgcatccacccctaagtgatggaagacttgggcccggtaagcctgggcgtattcgaccccgctgctggcccagccgattccttggttaaaattataaacagtcatcataactcctcatttcactacttgatccatcacaactggcgcttggcgcaaaggttcaacgtcaaacccctagttgctgagttggccctaacgcaagacgctcatcaacgaaataatgacccccataatgacggagagggcaatcaaaaacatcaatttttgttggaggttaaaagctttttcttttttctgcttcgtgggcttgaattgctccttggctaaccggttggcgatgtcgctggtcaacgggtcgtcatgcttttcgtgctcatgcattggtttttccctcgcttcctagacaaagtaaatctgcttttcaccctttttgttgacgtcgatcgtactcatcaacaagtggcgggtaatccggtgatacaagtcgtggcgcatggcgttatatgaacgcagggcttccttgtgatattcatacaagggattccgctgggccgtcgaccggctggtcacaatcgtttgcaattgggacagcccatcgatttcttccacccagcactcatcaattgcttttagcaccacaatccggtaaaaatcattttcttccttggtgtccgcaaaagtggcctgcttgcggcctaactccgcgcgggcaatgttcatcaggtagtcgacgaccgtggtttgatcagttaggtctaacgtggtcggccgtgcaaagtactgataagtcacgttatctaaaatatagcgtaccagttgatcgaccgttaaagccgggtgggtggtaaagaagcgggtaaactcagcttgcaaaatcgcggctaaatccaaatcgacttgctgatgatacaagagccggttgcgctcgccaatgatcaactgccgctgaatctgagcgctttcgtccatttccaaggacttgcgccgctgctggcggtcggcactatcactggcttcttgggcctgggcaattgcgcggcggaacttccgggtagtaatctcctcggggtgggccggatcagtttgccgtcggcgcttcttatagtacttctgcaaccagcgggccccgtgcttgattacgacttggtcttccaaggaaacgtaaaattggctggtgcccggatccccctgccggcccgcccggccctggagctgctggtcaatccgcttgctggccattttttcggtcccaatcacggctaaaccacccaactccttaacgccgggccccagcttaatgtccgtcccccggccggccatggtggttgcgaccgtcactgcccctttttggccggcttcagcaatgatcgccgcttctttggcggcatttttagcattcaagacactgtgggggattttttgttgcaagagcaattccgaataaatttccgaaacttccacgttggccgtcaccaagagaatcggccggccactttcgtgcagccgcagaacttcttggagggaagccattaacttttccggcagggtggtatagaccttgtcgggcaaatcaacccgcgccaccgggcggttagtcggaatttgaatgacccgatcgtaataggtctccagaaattccttttcggccactttccccgtcccggtcatccccgccagcttcttaaacttacggaaaagattttggtaagtaatcgaagccagggtccgggtatcgggcgaaattttaacctgttccttcatctcgattgcttggtgttgtcctgcttgcagtttcattccttccatcacccgaccgttggcccgatccaaaaggtctacttcgccatcttgactgacaatataatctttatctttttcaaagagccggtgagcctttaaagctaagtttgttgctcgtaataattcagtgtgatgaccattgaataaattcttaaccgcaaagtagcggctcatttttttataacctaggtcagtaaaccaaactgcattttcctccttatcatatttgtactcttccccttccttaagggtgtagatgaattcatctgctactcccaaccaagttgattgtacccgcggtgaacctgaaatcaccaacggcatcaccgcgctgtccaacaaaacagcatctgcttcatcgacaatcgcataattaaaatcacgcataaatttattttccacactagttgctaaattatcaaatagataatcaaaacctagtgttgcattagtagtataagtaatatctgccgcataggcactccgcttatcttcgttggtaaactctttcgatcccggcgcagcaaaaccaactttacaattcaaccctagccattcataaactttccccatttcagtgccatcccggtaagccaggtattcattcggagtcaccagcatcgcccctttgccgcttaagccgtttaaatacaagggcatcgtcgccgttaaggtcttgccttcgcccgttttcatttccacgatattaccctggtgcagggcaatgccacccatcacctgcacatcgtacgggtacatccccagcacccgccgatcagcttcgcgcactaccgcaaaggcttccactaacaagctatctagggagtgtccgtcttttaactgctgcttaaatttccgcgtataatccttcagttgaccatcactcaaggccgccatctgcggtgccaactgattaatttgtttggtaatccggcgcagcttttttaatcggacccggtttaataatggcttcttcattactctttatcttccttttttattaatttctgcctactaatccagatattgattcaccacattaatacgacgttcttgttgaatggcattgtaaattaattgctgttcataattgacgatagcgctcaaactctcgtcaacgattgcatcttccacgtcttcgtcatcatcttctgctttagctatttttacctgttcagctacctggtcagtcacatcagttaaatctagtcggtggaaaattatctctgtgcagccagcgctaaccagctcaacagcataaaagtaagcggtcggttcaaaagtaaagatcccactatcttgacgtatgattgccatcttcaccagcttgccttcataattaaacatcaagactcgcaagtataatccctgctcgtaattgctttcggctactaagtggagctggtattgatgattgtgttctaaaagtggcaactggggtaccgcatgggcagttgcaaagttaaatagttcatcccagtggtaaatagttgagccagtcggtaaaaagggattccgtaactgaacatggtcctgggccaaaaatttaatgcgcgttccatgtaggtaagcatgagtcgccgattgaacagcactaccataatacttgtcggactgataaatctctccccgcgcagcgcctaaaccaacgtaaaacagatctgctggtgacttaatgtagatactttgcatcattgcttcctccggtcaaaatcccgttccatcattgtccagtattgcttttttaaccaggctgccgtttcatacccagcatcattatggtgtccatctagcccccgaccaataacataaggatgtttgccagtttgggctaagtgaactaacaaatcatgatacgccttattatcgtagtcatcttggcgcatataagttaacatcaattgggtttggttgagatcggtctggtcaaatttagaccagaaacgttcgttcatcgtcttaaccatctgtttgcggccagccaactgtgctttccgcgtagtatatttattaattatatctaaagaagttgcaaagccaccataacgaacagattgctcacactgagcaacgtttccaagatttaccaatggtttcccaacaatgatactatgcgcccccagctgactaccataatatagagcaccaaaggttccagctgataagccggaagtattaagctgatgatgatcaaatcctaaccaagccagggttttcaagatccgctctttaatctgagtttcaaactctggactccccaaataaaaggctgtcccttcgatccgtgggtcagcaaatagtaaaaatggtgccccgaatgaacgcatcatataaaaggcttcaaatccctcggccgtccggtacccagaaaagtaaacatttaacggcggtttaaggtcaccagggttaaagtagtaattaacttccgtccgatcgtgatcgataagtcgtcccccacccggcaagaattcccccatttcatagcgtgaccaacggaggtgaacattacctaaagatagccatccttgtcctttagcctcaaaggtaatacaaagacttcctcccggaatcgtatcataaactggcacttgctccgtcatatctttttcagtaaaaactaagcgtttagaaaaagtatacggatttcccggtggtgcttcataaactaccattcgtagcttaacttcctcactatgagaatactcactccaaagcttaagtaatcttcctcgatcaatataaccaccaaaacgataagttcctactggttgatagtcagtgccaaagtcgccagtcaattcgaccgccagaaagccattaaactctaagctaccacgataatttggtgccggttcaaacattgaaggatcaagttttgcccccccttgcccctcaaacagacgagtttgcaaccatttcacaatttgatcccactcagttagtggtaaaggccgaaccactttcgccttaaaatagtcggtttgtaatggcgtttttagttcttttaggaccgcaggggcgcaagtaacacgataactgtcaacatacttgaacagagcttgtaaatctacatctgtcgggcaagctgcaaagtaagcccccacgaaattttgaacccgtggcttttcgacttcgacaactggcttttttttctttaactggttagtcgcctctttcgtcactggcttttttgaagataattttggcttaggatttaaatcagctaacaaggatgacactgcccctggtgcggcataatgccactgatgatctttgtcggcaggtaactgtgctgttaaatcatttggcccaattaataagtaatgttccactttactcctccgcctttttcaatgcaacttgaaaccgcttgacaatccgaccactagtatagtccgcaattttattggctgcatggaccagcgccacgttccaatttttcaagccatctaaataaaagtgtaaggatggcccaagctcattttcaacatcatcaatgcggcgcccattcttcccttcctccacataaagcgattcagcccttaaaatttcagggatcccggcactaatcccggcaatctgtaaaaatacatctggttgagcagctaaatcaattatgatacgagtagtatgaatggcttgaattaaatctggttcagaatttacaacgaccaaatgaatatcacgcttacgttcattattacgtgcagcatcaaggtcatcagcaagttggttttcggccttagaagcttgtacttggttaaaagtatattcatcttcaagatccaagtttttgtctaattccgctactaaacccgcgatttcatcctgacgttgaaaatcctggaaagtaaggagcgttaaatcaatcaattcattttcattcatcatagtcatgataatccgtaaacttttacgtaggagaattggatctactccgtcaatagcgaacataattttcaaaagccgctcctggttgctgatgccaagacttaatcttgtatccaaaggtggcagttgtaacacctgagcaccaaccttcgtcagctgctctcgattataattagaatcagcgatcgttaagactgcacgctgtgccatctcagcttcaatctgttcttctaaattagcccgattaccaaagtaagacaacactacttgatcattgggaagcacatccattagcatttgatcatgaaatggatcggcagcagcgattatgacatctttagaatgaatttgttgctgactaaatagagtgaactgctcgataattaaactcctcaggttcggatagaccccctgatgctgagcaaggtgagtgcctccaacaatatgaactttcccgtcagatgccacgtagaattgttcattaccgttactatccaagtaagcctggcgttggcactgttgctgatcatcatattcgctgactcgcgaaacaaagccgcgatcgtcaaagtccagcttccgataaaggcggtcatctttaaaaagatccatcatgattagattgccttccggtcccattgaaagctgagcataacgttgggcatggctaaagacagtcacggtaaaggggttgtagacgtaattggcgtcagcaggccaggtaaagtcgtggtaatcaaggttgaccaccgataaatcggccggaatcccctgtaagtagtcaaagaccgccaagcgcggcacttcgtaaatcccctgctggtaggcaaagtgacggagattaggaaagtacaccggaaccagtaaggcggccgtttgctcgcttcgagtaaacatccgaacctggttgatcgtatcgtcaaagccgtgctggttctggcggaaccaaatttgttcgcgactgtcccaggattgatcgccccggtaccaagcgggtaaaaagtaatacatcccttctacacctcctttgcgtggtcaaatagcggccgatactgcttgcgaatcgataagatattgatctgatcgatcatccccatcgaaaaaccaacgatcatcaagacgtagcccggcaacatatagatccccaattgtccggggtggctgacaatcatcaacattggcatcccagcaaagataacattgtaaacaccgcccacgaccccaaataagagggtaatcaggttgatccgccgctcagtcgccttacccggccgtacgcccagcaggtagtcgccggagcgctgaaaggccttggcctgctgttcggcattaacgttaaccagcgcaaaggccaaggacaggataaacagcagactgatgtagaggatgattcccggcaacttggtaaagccaaaactggtcgccccccaagccaaccagtaattttggggataaaaggtcaataagaataaacaaaagtaagtgggcagtgtaatcatcgacatggcaaacatgatcggcatcccgccggcggggttaatttaattggcaaatacgaacgcgaagcataattgttatcaatcataagacgcaccaagggcaaacggtattccccccggtcagccataacattgaggtaagcaaaaaggaccatgatgatgaccagggcggcgaccaccaccattagacgggtcgtggaatgatcggctaacatcaaaatccccgctaatcccgttttcatcgcactctgcaaaatattggccagtaccaagagggtcagcccaccaatccctaacagggcgttcatatttgacagccacatgataaacatcgtcccggtcgtcatggtcagcaggaccgcccctttcgccgcccagcccgtctgggtcaattgcatggaactgaccaggacaaagccttgaattaccgttagtagtaaggtaatctctttgcttatccaatccttgcgccgctcagataagcgatccatgccaaaccctcgtccctgagtcaataaattggcgatgatcatcgccgacatccacggtgaaagccccaaactaaagagcgaaagctgggttaggtccccccagtcgccaggctggccacgtgcaaactggcattttttaccaccaacgatttggcatcagtatatggaagaggaatcgacttccctaaaatgaagataaagacaaacaataccgaccagcaagccttatgaaagaccgggtgattgaatttccatttttgccaagtgtgcaccgcacttcccccatttcatcgaacaatgtttgccactcagattctagctgttttataatacaatttcaataatgcaataatcaaaatagcgatcatatttatatgtttgctaaaaaaacagcatcgataagggcgcgcttggtaaagaatccatctcgaatcatatttcctatgcgattagcatttctcgataatgtggcatactgttcatcactaatttctttcactttttccgctgcttcctctaaattagcaacacagtaaccaatgtgatgctcatcaatgaattcactttgcgccaaattatttttaacaacgactggtattccggacgctaagtacgtactcaattttgatggagcatccattgtcatatattgctctgtataaggatcatctgtccaaactaagccaaacccaccgtttcgttgcaaactttccagaagtaaaggatcaattttataccctatagcttcaacgttttgattatctatttttgcgtcagtataaacttttaatttcacttttaatttcacatcgtaattccaacttttaataaaggtaaacttatcaggatttccggcaaaactaattgtatgagaatttttgggagagataaatggggatatcatacctgggtggtcccaaaattgctgataaatcactggaatatcttcttttaagccatcttgccttaaacgttcaatcaatttaacagacggagcaatcagtacatctgctttattgaaatattgaatgtacttaggcatcaaatacaggttcgcttcaaacattaagggaagaacgtcttctataaaaatgacttttttcaccccgttatacagtgagaccctatcaactaatccgatatcccaatcaatcgaattccaacttggcgcctgaaagattacagtatcgttatttgctaatccggctaacatcccatcaaaccgtccgtttcttacttcgattggttcatcaggccaatcataaaaatacattggaatctctttaaagtgtaaatcatgacacgcgatctctgctaccgtattttgagcttgttgtgctgtatttacgtagttaaggccatggatgtttgtaataaagactgtcattttaacctcacttaatactgtatagcttcacctttatctccattcaagattactaatcatttcaaaagctgccctcttaattggaaagttttgcctaatcaaattaccaatctggtgagttctctcgagcatttgatcatactgttcttttgttattgacctcatagctacctctagctttgataaatcacctaatgccaaaccaatcccatgctctttaacaaattccgctaatgctgattgcttagcaactattattggttcgtcagcagccaaatacatagctgctttgtaaggagaattatacttttcatactccccgctccatcctgttatttgaggataactggtagaggcccaacatagtccaaagctcccagatagaatgctaggaattgcttcatgatcataatttcctcgataattaatgttagggtagctattcgtcgttaaatcatgcaagacattgtcggtctccacttcccgtccaaaaacgttaactgcaatggatgatggaatccccagtaaaaatcctgctttagtcaggttacctgcgaaatcgatttctaatttcaaagggcgtttccaatccattgaattcttttttgctgaatatccaaatacatccagatagacaaaactattactgtactctagtccggcaaaatcaaaatccccctgcaaacgttccgccatttgatgattatgaacgattaacccatccatttttgataaaaagtaatgttcaacaaacgaattactatgatgatctgtcaacatttcccgtgcttctttaactgatttttttccttgccatgaagtaatatcatgaataatcgctacacatttggcaccaatttgattatgaaggtaatctatcaaatagccagtgtatgcgtttgaattgtgcaccggaaattgaaggaaaacaatatcatctttctttatccccgccagttgaccatcaagccttgtttgtagtgaactggcaggttcctcatcccaaaaataaatgtaatagtctaaagtacgtgcattcaacgcttgtactaaactctctgttacttcatattgcggccgaccaaaagccgtattatcccaatatgggacaccattttcgcggctaccattactgctcataacccaataattcataatttgcacatctccatatatagataataatgatcttttagtagaaactcaaattgtagagtgttttacctctagtgatgcctaaacaagatatcaactaaattgatacgttagttatattttttcaaaaactatgactctatttgatcccaatagattggcatgacagccgttgtactactaaaaacgtacatataaaggtcacgcacagctgcaatcaaccgatcactggttgcatctaactggttaaatagttgatctacgctctcgtaaagaatcgtgtcgttatccaaatacaacacatgctcatagtcagctaacaccactggcaaaaaaattcgttgtaagtacaaaagattaacgtgatcttttacttgcgctactaattctgatggtagttccaccaaggcatgcggtttgacgtggacgtgcggttcaccaactaccgtgggtaattttgctaggaccttcaaatcttctgtaaccacctgttcgttgaaaatgtaaatgtctaaatcctcaattgacagatagtttttttatcaatgatatcaaggaaacgcttaattacttagtgtaatttcctgagaccacgtaacaaaccgcatttttagattccatataataaagttcccccaatcttcgtgttattagataaccccagttaaggtaccatccccatcactgctttttactcgctgccttttccaaaatccgcaaacgttgcatcacgttcttatactttaccagattggtgctcccactctttagcagttcatcacggtgcactcccaaccgccaacggtaagccttcaattcttccgttatatccatccccagcaaagccatcattgtaacccgctgttcaattgcttctagtgggtagacgttggcttgactcgtttcccgggtcacactattggtccgctttcggtgcatgtttaggggcttattcataaaggccagccggtccgccaataaataaacttgccaggtggtcaaatcatcttccacggcccggtcggtcgggtaggcgatctggtcaaacaattcccgcttgtaaagcttacctcacggcaccgtaaaacactagctcaggttaaaatgcatattatactcttcggcaaaccactccgccggggtatagaccttttcatagtgatcttcctcgcgcacccgaaaatagaatgtttgcttgtcttcaacaaattcataaaaattaccgattgcaacatcggcgtgatgacgttgcattaaatcaaccaattcggctaaattggtcggttccatccggtcgtcattatcaacaaaggctagtaactcgccggttgccatcgctaatcccgcgttccgactgtcgccaacgcccccgttgggcttatgtaagacccggacccgggaatcttgggcgcggagttgctcacaaagcgccgcactgcggtccgttgaaccgtcgttgaccaaaatcacttccaggttttggtaagtctgatttaagaccgagttcacgcaatccactaaatatttttcgtcattgtagaccgggataatcaccgaaaccatttgcgctatttttccatctccacttttattaattacaatgttaacaaaaattccttattttataccattagctgtaatccatatcaaaaccatttaagttatcacctaattccagcaaaagttgtcgtgaaaaaaggtttccccctaatcgacgaaaagaatcgtaatagcggataaacaacataaaatttaagggcatcaatatcccagcaatttttggagaaggataaataaatttgccgtccttaagagctacaaaatttgtaaacaaaacatcattatttcctttttgacgagtattcattaacttagtaaccgtatccggcgcagctaaaaagtcctctgcctcaataaaaaggatatagtcgccgatagcttgcgcaagcccaacagtttttaaattctcccactttttactactattttgcaatcggtcattggtaacttcgtagcaatttctggatcgttagaagctacaatcacttctaaatctgggtaatcttgttctaaacaggtttcagcacatcttttcagtccgttctccgtcccgttagttaaaattattaatgatactcgcaccacgttagtcctccctcgtaatatttacccgctgcttaccctcctacatttcttttatcagcttccgcacataacctgctaaatcctctggggtaggaaaaaacatggcttgattattttgataatcctctcgttgtaacgccaaaatcggtttaccagtcgcaaaaaaacgttcttgcacactttcatcacgttggatcagtgttaaatccaacattgctacactggtatcaattaattgcgttaatgctgctggcaagatcgtctgatgcaaattaacattcggataagctactaaacgctttaactcaaaactcataaaaacaggagaagcaatctcaaaatcaacctccggcaaaagcctaatcagctcctccaattgatttaattccgcccaagctgtatacaacaatagtttgggtcttactgatttgcttattacgcttaagtgattaccaatcatttgccattctaggttgtgatactcccaccattgcatacgtccgcgcacagttgacaaaaaattccacggtttgtcactacctgtatagtgatcaattaccgcatcattcactactaactgatcgtacgggggccaaccaaactgttcgccaacccgttccaggccaagctgattgttgaaacgagccggtaattcagtaatcgcaccttcacaaacgcgattaagaactgtttgatcaccattatcaatctcattttcatggctagagaaaaaatcgatgcaacgacgagttaaatctgctgtctgccatcgttcataatcaatagcactcctgtgttatacggtgcacaattgatttcatgagccatacccaccggttgcccttgtaaatcgaattttaataatggccacagactatgccgaacaatcacatcactatcgagatagagaattctctttgcttcaatcaattgcggcaggtagattcggacgtaactgtatccattaatgtgttgccacgaaactttgccaatcgccatttggttaagatcaatttttaagtcatggagctggctccctactggcgacaacttttgattaatattccgaaaccattctggtggaatatccatatttgctaagtaaacatggacattaggagtatgataaaaaattgattttaacgtcgtttccaaggccgttacatagccatagtccgcagccaaagctactacataatcgtgcattctttccctccaaattcacttactacttaactaataatttttctaccacttccaccaacatccgcttaaacatatagccattgcgcaacaaatagccatagtccttagcattttgggccatgcgctgatagtcttcggccgtgcaattttggaccagctggtcagcttccgctaaactttcggctaacaaccccaaatggcggtccttaatcaattcggccgcggcaatgtcagcattggccactacgggtagccccgctgccaagtaggtactgagcttataggacgcattgaggtgggaatattgccgttctggctgttccggggtatcgatgctccagcacaggccaaagccgccgtccaacattggtaacagggcgctttcgggatggaacccgacgtagtcaatgttttggtcgggatcggcctgggcatcagccgcaaataaccgcaagcgggtctgataagaccattcccgggtaaagggaaagcggctttgactgcctaaaaaggtcagttcccgccgaaacgccgccatttccggttggtaagtggtggggtgatcccacaggtgttggtaaacgatattatcaaccgtgagtccctcggcccttaagcgcgcagccatattttcacttggcaaaatcaacaggtcggcttcattgaaaaattccacgtacggccgcatccagtcagcataattttggctaaacatcagcggcgggacgtcttgaatgaagaaaacaatccgcgtttggtaaaggcgcagctggttgaggtactgccgctcgaattccagcccgttccacgtcgggagctgaaagatcacaatatcacccatctgcaaagaggcattgatgccgtcgatgcgcacccggagttgttctggcgaatcactggcgacattatagcgatagatggctaattcattagccccctgatccttggccagctgagccgttacattttgtgccgcttgggcggtactggtattcgccatgccgtagaggttggtaatattaatcttcatttggttccattccttcctgactaagatcggcgacaatctgggcggcatatgctggcgccgcgggcaaagtaatgtcttcagcaaagttatgttccatcgtgtgcttatggctgagctttaccttgctggtcgcccccatctgaaaccactcgtattcggaatcaatgtagccaatatccactaattgcatccccgttaccgccaattcgccaaccaaggctttagcagttgggccaagcatcaataagaccagcttgccgggcccatatttttttaatcgcggccttgagcacattgtactgagcaaaggcattatgcgcggggccaagaatccgctgcaccgacttggcattggcaaataaatcattcctcacccccgaccgggacagctgcccttcgacaatcaagatgtcgcggtcgtcccatagttgccgcagcttcgcaaaatagccctgggccaagcgcttgtcttgccaattcatgtagggacgggaaataaaggtgttgccgtaccagtcgacattggctcccatcaactgataaattgcggcgttggccggccgattctgagcccaaaaggcctgcgctgccggggtgtagcgttctaagtggctaaagacgtccgacatgcacaccaccagctccgggtggctcggcgtatacaacagccgtttcaaacgttctactagcgctgggtcgtaaacctggtaaggaatatcgcgtcccgcaatcaggtcaatctcgccatcaccaaagcgagcgactgatgaatgatgcgccaaaatataatctaaggtttgatcaatatccttgaccgtgaccccgtaaagcggctctgttgccatcactatcctccgatcgattaattgattagttactatgataagtagtcgatcagcgaaagtcaatcggctttcgccaaccaatgacaattcctctaaattgtctcacaatttagctaacgctttcattcaaattttacacccttttttccgttgttacagcaaatccccccatcgcgcttatcccaaagaaaaagcctgaaccctaaatggattcaggctttttgactggcaaacacgcttatttatcgttatgatcccggcgtttcttgcggccgagcaagccggctagcaagatgcccaggccacccagcaggccagtagccggggcagattcattcccggtttgcggcagcttttcaacggccttgccggtcttcgttgcgctcgggtcaactggacgtgctaagttgacgtagttatccgtgttcgtcgtcacatgcgatcccagttggctgattgattcagaatcgtacttcgccaaaccgtcatcagaaagactggtcgtctgtgaagttgatactgattgggagtcaaccttgtgactgtctgacccactgtgacttacagactcacttgcgcttgttgatgcggattcgctggcactagtagaagcggattcacttgcacttgtagatgcggattcacttgcgctcgttgatgccgattcgctagcactagtagaagcagattcacttgcgcttgttgatgctgattcacttgcgcttgttgatgcactttcactcgcactcgttgaggctgattcactcgcgcttgttgatgcggactcgctggcactcattgatgcactttcacttgcacttgtggatgcggattcgctggcactcgttgatgcactttcacttgcgctcgttgatgccgattcactggcactcgttgatgcactttcgctagcactagtagaagctgactcacttgcacttgtcgatgccgattcgcttgcacttgtcgatgctgattcgcttgcgctcgttgaggctgattcgctagcactagtagaagctgattcactggcactcgttgaggcactttcacttgcgcttgttgaagccgactcacttgcgctcgttgatgcactttcgctggcacttgtcgatgccgattcacttacgctcgttgaggccgattcgctgacactcgttgatgcactttcacttacgctcgttgaggccgattcgctgacactcgttgatgcactttcacttacgctcgttgaggccgattcgctgacactcgttgatgcactttcgctggcacttgtcgaggcactttcacttacgctcgttgaggccgattcacttacgctcgttgaggccgattcacttgcgcttgtggatgcggactcacttgcactcgttgaggcactttcacttgcacttgtcgatgcagattcgctggcactcgttgatgcactttcacttgcactcgttgatgcactttcacttgcacttgtcgatgcggattcacttgcacttgttgaagcggattcgctagcacttgtcgatgcggattcacttgcgcttgttgaagcggattcgctggcgcttgttgaagccgactcacttgcactcgttgaggctgattcacttgcactcgttgaggcactttcgctggcgctcgttgatgcagattcgctggcactcgttgaggccgattcgctggcgcttgttgaggccgattcgcttgcacttgtcgatgctgattcacttgcactggttgaagcagattcgctggcactcgttgaggcactttcgctggcactcgttgaggccgattcacttgcgcttgttgaagctgattcacttgcacttgtcgatgctgattcacttgcgctagtagatgccgattcgctggcactcgttgaagcagattcacttgcgcttgttgaagccgattcacttgcgcttgttgaagccgactcacttgcactcgttgaggcactttcgctggcgctcgttgaagcagattcgctggcactcgttgaagcagattcgctggcgcttgttgaggccgattcgcttgcacttgtcgatgctgattcacttgcactggttgaagcagattcgctggcactcgttgaggcactttcgctggcactcgttgaggccgattcacttgcgcttgttgaagctgattcacttgcacttgtcgatgctgattcacttgcgctagtagatgccgattcgctggcactagtagaagcagattcacttgcgcttgttgaagccgattcacttgcgcttgttgaagccgactcacttgcactcgttgatgccgattcacttgcacttgtggatgcggactcacttgcactcgttgatgcactttcacttgcacttgtggatgcggattcgctggcactcgttgatgcactttcacttgcgctcgttgatgccgattcactggcactcgttgatgcactttcgctagcactagtagaagctgactcacttgcacttgtcgatgccgattcgcttgcacttgtcgatgctgattcgcttgcgctcgttgaggctgattcgctagcactagtagaagctgattcactggcactcgttgaggcactttcacttgcgcttgttgaagccgactcacttgcgctcgttgatgccgattcactggcactcgttgaggcactttcacttgcgcttgttgaagccgactcacttgcgctcgttgatgcactttcgctggcacttgtcgatgccgattcacttgcgcttgtggatgcggactcacttgcactcgttgaagccgattggcttgcactagtagaagctgattcactggcgctcgttgaggctgattcgctggcgctcgttgaggctgattcactggcactcgttgaggccgattcgctggcgctcgttgatgcagattcgctggcactagtagaagctgattcactggcgctcgttgatgccgattcacttgcacttgtcgatgcggactcacttgcactcgttgatgcactttcgcttgcacttgtggatgcggattcgctggcactcgttgatgcactttcgctagcacttgtcgatgccgattcacttgcactcgttgatgcactttcgctagcactcgttgatgcactttcacttgcacttgtggatgcggattcgctggcacttgttgatgcggactcacttgcacttgttgaagccgattcactggcgctcgttgatgccgattcacttgcacttgtcgatgccgattcactggcgcttgttgatgcggactcacttgcactcgttgatgcactttcacttgcacttgtggatgcggattcgctggcactagtagaagctgactcacttgcacttgtcgatgccgattcactggcactcgttgaagcactttcacttgcgcttgttgatgcggactcacttgcactcgttgaagccgattcgctagcacttgtcgaagctgattcactggcgctcgttgatgctgattcactggcgcttgttgaagccgactcacttgcgctcgttgatgcactttcacttgcgctcgttgatgccgattcactagcactagtagaagctgattcactggcgcttgttgatgcagattcgctggcacttgtcgatgccgattcgctagcactagtagaagctgattcactggcgcttgttgatgcagattcgctggcacttgtcgatgccgattcgctagcactagtagaagctgattcacttgcacttgtcgatgccgattcactggcgctcgttgatgccgattcgctggcactagtagaagctgactcacttgcacttgtcgatgccgattcactggcactcgttgatgcactttcgctagcactcgttgatgcactttcgctagcactcgttgatgcactttcacttgcgctcgttgatgcagattcgctagcactagtagaagctgactcacttgcacttgtcgatgccgattcactggcactcgttgatgcactttcgctagcactcgttgatgcactttcacttgcgcttgttgaagccgactcacttgcgctcgttgatgcagattcgctagcactagtagaagcagattcacttgcgctcgttgatgccgattcacttgcgcttgtggatgcggactcacttgcactcgttgatgcactttcacttgcacttgtggatgcggattcgctggcactagtagaagctgactcacttgcactcgttgaagcactttcacttgcgcttgtggatgcggactcacttgcacttgtcgatgctgattcgctagcactagtagaagctgattcacttgcactcgttgatgcactttcacttgcgcttgttgaagccgactcacttgcgctcgttgatgccgattcacttgcactcgttgaggcactttcacttgcgcttgttgaagccgactcacttgcgctcgttgatgcactttcgctggcacttgtcgatgccgattcgctggcactagtagatgcggactcacttgcgctcgttgaagccgattggcttgcactagtagaagctgattcactggcgctcgttgaggctgattcactggtactcgttgatgcactttcgctagcactcgttgaagcactttcacttgcgcttgtggatgcggactcacttgcactagtagaagcagattcacttgcgctcgttgatgccgattcacttgcacttgtcgatgccgattcacttgcgcttgtggatgcggactcacttgcactcgttgatgcactttcgcttgcacttgtggatgcggattcgctggcactagtagaagcagattcacttgcgctcgttgatgccgattcacttgcacttgtcgatgccgattcacttgcacttgttgaagcagattcacttgcgctcgttgatgccgattcgctggcactcgttgatgccgattcgctagcactagtagaagctgattcacttgcgctcgttgatgccgattcacttgcacttgtcgatgccgattcactggcgcttgtggatgcggactcacttgcactcgttgatgcactttcacttgcacttgtggatgcggattcgctggcacttgtcgatgccgattcactggcgcttgttgatgcggactcacttgcactcgttgatgcactttcacttgcacttgtggatgcggattcgctggcactagtagaagctgactcacttgcacttgttgaagccgattcactggcgctcgttgatgcactttcacttgtgcttgttgaagccgactcacttgcgctcgttgatgcactttcacttgcgctcgttgatgccgattcactagcactagtagaagctgattcactggcgcttgttgatgcagattcgctggcacttgtcgatgccgattcgctagcactagtagaagctgattcacttgcgctcgttgatgccgattcgctagcacttgtcgaagctgattcactggcactcgttgatgcactttcacttgcactcgttgatgccgattcgctagcacttgtcgaagctgattcacttgcgctcgttgatgctgattcactggcgcttgttgaagccgactcacttgcgctcgttgatgcactttcacttgcgctcgttgatgccgattcactagcactagtagaagctgattcactggcgcttgtcgatgccgattcgctagcacttgtcgaagctgattcacttgcactcgttgatgctgattcacttgcacttgtcgatgctgattcacttgcgctcgttgatgctgattcgctggcacttgtcgatgccgattcacttgcgcttgttgaagctgattcacttgcgcttgttgatgcggattcgcttgcactcgttgatgcactttcacttgcgctcgttgatgccgattcgctggcgctcgttgatgcactttcacttacgctcgttgatgcactttcacttacgctcgttgatgcactttcacttacgctcgttgatgcactttcacttacgctcgttgatgcactttcacttacgctttttgatgccgattcgctggcactcctcgttgaagcggattcgctggcactcctcgttgaagcggattcacttacgctcgttgatgcgctagtcgaagtactcgtcgaggtggattcctgttcactcttactcgtcaattgacttggaatcgtcgaatcaactgaatgagtatcctgatcgtagttgtagacttcttgaccaaccaattgaccttgcaagtttttccaagtatcttgccaagagttaataattgcataaccaccagaaaatgccccattataatttcctgctgcaagattagcttggtcagcattactatgttgagtcgtaaaggtaactgtaaaagaagcattcatggtgttgttattatctccccaagattggaaatacatagccgtcccaattgtgtccttattgaaaccagtggtaaatggtgctgtgtttaccacaatatctttggtattttgtttgtctcgtactgttgcttcatcaaattcattattataagcaaaagaataaccaattttatcatctttatagcttcccttgcccgaaaagaccgagttatcaaagtcgctatttgacatatgccaaatatctgcataccgaccatattgatagaaatcattcttgacgtcactaattactccatttgtcttattaacgttctctggcttaaatgtgatatcattttctggattgacatcccctgaattgagatcacttggcgattttcgtaccttcagaccacttgttagtccattattacccaaatggctgtaagtcgttcctggttgtaagctaatatggacattcacatcgctaatgattttgtaatccttagttaggtaaaaacccatttggccatttctcaaaccataattaagaggattgtaaccttcataccatatcccttttttaggatagaaggtaactgtccactcggtttttccattacctaggtcttttgtctgtatattaacgttgttcttagcataatcagtagtttgaccagtatcccgagtagtataagcattgatatcccaccataatcggttgtttttatctccggcaatccacttgtatttatcgttgccattacttccccaataagcaggcgtatcccccggtttcgtattggtatcgggcgtccccaaccccgagctggctgggatatttgccaacaccattgtgcccaattggttgggctcgaacaccgtcatcaacgattgcaattcactcaaaccatggctggcatcactttcactgacttggttcttggccaagacgtcttggtagtgcgcaatggccgcttggtaggcttgctgatagtcgctggccgcatttttgtaactgtccgtggccataaaggtattcgcctgagctaccagttgctttaatcggtcaacattcgacgtggtcggcgctgtcgtatccaccaggctgttcgcattaatcgtttgactggttgcactcgtggccgtccccgacatcgtttggctggtggtactcgtcgtgctggccgattccttgaccgaagtcgaattgctggttaaggacgtactggtactcgtggcggacgtcgacgtgctggtttcactagtggatagtgagcccgaagtactggtcacttggctcgtagtgccttgattgttggaggaagtcaaactaacttgatcggtatttgccaaggcactgttcgcggcattattcgtggccgtcgtttggacccccgtggtcgtggccgccaacgctccggttgaagcaaccgtgccgcccccaatcattgccccggcggctaagacccctttcagcaaggtcgccgactttgaatccaagttcgcttctgattcatccaattgcaccttgtgtggtgccgaatgcgttgcgatctttagtaaacccacccgggttaacaaacattgcacccattgcttccctgacttgtacaattttacccgagtagtccgggagctttcggtgatcgtttccttttttgtccgtttcaagatcccacgtcctttcatttctttatgtacgcttctagtcagttgccttgcgctcaatatttatcaattgattaacccgtcctgcgacgctcgtcccaatttcaaacatttccgctaatcaggttaatcgcgagataaccatttctattatcactataagcactttattcattcgctttcatcagcttttcattgatcatatttaaaatgcttaataggtgttaaatagatagtaatcttttttcaacatatttatcaacgggatattaaaaaaacttacaatttatttaaatattaatacctactgagtgatcaatatttataacttgaatcataattttgagtgctttttctcccgccacagccccgagtcttagggggccattgcgtcaatttatcaatggtctaggtggtgttttcaccactcattagcttcatcatcttgttatgtaggaatggtctattttagcttatgataatttataatttttcgccgggggccggccgaccattaattttgcccttggtaccaacaaccgaatgtattgatcgggttacattttgctcccctggttccgactaaagataattaacccatccccggagtcaaacttgctttggcgcgggtcaaccatcccgtcgacatattttctcatcgaattctcatttaagtcttttcaatcccagcgaaacctgctatgctaaccccactagctgcaaagcatgctcaaacaactggattggaggagatcatatgcgcaaaattactgtgaattcggactttaccttgccagtccgcagtgaaaaacaaatcgccagcaacgttttgaaaggctcgctggggaacctgatcgaatggttcgattggtacgtctacgcttcctttgctatctacttttcgggcgcattctttcccgctcacaaccccacggcccaactcctagctgccgcgggggtctttgcgatcggctttttcatgcggccgcttggttcgttaataatggggcgcctggctgatcgccatggccgccgtacggccctaactatttcagttgtaatcatggcaacgggctccttgatcattgcgttcgtcccgacctatgctaccattggcatctggtcgcccctgattttgattgccacccgcttattgcagggcctgtcgctcgggggcgaatacggaacctcagcgacctacctgtcggaaatggccagtccgcaccaccgcggcttttacgcttcctttcaatatgtcaccctgattgcagggcaactgttcgccttgctggtgcaaattgtcctgcaaagtttctacaccaatgcccaactgaccgcctttggcattagggccatcggggccttggtcattgtgtcggggtacacctcagcttttaagagtttcgttttccttttttagctctttaagcttagactgatttgcttgataatttgcttctaatttttcaatttcatcattcaacttagcaagagtattaggagtaagtaccattcctgcaagcatcttaccttgctgaagagtaattgtttttttggctttgtcgttcacagataataaatattcataattatctaaaaattgacttaatgaaaccatataggtttcatgtaaatgttttcttagcatttaacttgccttcgctttctaaaaatttgttaaggctatttgccttaacaaacttattctaattggcagattgcaagaaataacttgaacgaatttagtgacgtaggttaagcaagaagatctcgattggtgtgcgccagttaagacatttaagtggccaggaattcagataccaactgatttgaaccagctggcgatcgctcagctcttcaatagcttgtcccttgggaataaatcgtcgcaaaattcggttacggttctcattactaccgcgttcgtgcggtgaataggcatgggcaaagtaaacctgagtacccgttagctgttcaattgcctgataattagcgaactctttaccatgatctacggtcagcgtcttgagcttgtcttgaagttgactagctagttcaagtacggcttgagtcatgaactgactgtcgcggccatggagccgtttaacaattgtcaggcgactcttacgctccacaaaagtagccacagcttgacctttacgtttgccagaaagtacggtatcagcttcaaagtggccgaactcctggcgagtttcgactttatgaggacgctcctcaatggagcggccgtgactgaacgtaccccgcttttctttagcacgatgacgacgaattccatgatcaggcaaatcgggtagctgtacatcaagccagccttgatcaatccagttatagaccgtcttgtaggcaatccccaccacatgggtaacttgttcaggggaccacttctggacttgaatcttttcctcaatcaagtgcttaaggcttttagtgagcgaagacttccacccccgttgactaaccttgcgttcaaagtcagtttgcgctagctcagcccggtactcactatttagccggtgaagttcgttaaagatggtggtcttactaaagcctaagtagttagcgatgtatcgcaaggaacgtccttcactaagcgtttcaatgacaacacggttctggaatgataaaatagcggtgctcatcaaggtccttctttctaatggattgtgtggtaacaccattaaagaccttgatggttttttctgtccacttaaatgttcaacttaaattttacaatctgccataaagaaaaatcctcctgtactgaatggtatattttcagtataggaggattggtcgaccgcgcctagacgtgtcgttattgactgcttaccgtttgttggctactaaaaagggcccgaccctaaccgtaattggttagggccgggccctttcttatgcgttgcgcggtggtaaattaattaccttagtcttcgcgcttcttcttcagaccgagcaagccgaggaaggctacgcccagcccactcaacattgcccacgtagctggttggtccccagtctgtggcaagtgttgttgtgcttgttgcttagttgcggtttggttcgttgacgttgcgcccttcgtttggccaccattggtcccaacacctggctttatcgccgagccagtagtcgcttcagtcacgtgcttgtgcaggtttgcctgcagcgtggtcgtgctaccgtccgcaaaggtaacttgtacgttcccggcggtatcaaccgtgatcgtcgcaattggggccgttgggttggtcgtctgaattgcttccttgacttggtcttgttcggcttgcgtcaagtggttcggatcaaccacgttgaccgcttgcccagggttcagtgggtatttatccgcatccgtcttgcccgttaccaagtcgtgacctgaaatcgtattcgtggagccatccgggtacgtgatggtcgtcgtcccatcgtcaccgaccgtgaccttcgtcccatccggcaggttcgagttcgcttcgtcaaccttgtccttaacggcgttcttttcattatccgttaacttggttgggtcatcaaccttcaccttgtcaccgcctggtacgtttggcgtgttcttatcagcgtcactcttgccttcaatgacctggtcacctgggatcgtgtccttcgagccatctgggtaggtgatcgttacgtcaccgttgtcactgaccgtgaccttgctaccttctggcagcgtcgacttgccattctcatccttgttggcgtctttaatggcttgttcaacatcggacttttcatcttccattaacttgttcgggtcatcgaccttcaccttgtcgcccggtaccttcggttcgttcttgtcggcatcagtttggccttccgtacccttaccttcaacgaccttgtcccctgggatcgtgtccttggagccatctgggtaggtaactgttacgtcgtcgttgtcgccgaccgtaaccttgctaccttctggcagcgtcgacttgccattctcatccttgttggcgtctttaatggcttgttcaacatcggacttttcatcttccgttaacttggttgggtcatcgaccttcaccttgtcgcccggtaccttcggttcgttcttgtcggcatcagtttggccttccgtacccctaccttcaacgaccttgtcccctgggatcgtgtccttggagccatctgggtaggtaactgttacgtcgccgttgtcgccgaccgtaaccttgctgccttctggcaacgttgacttgccattctcatccttgttggcgtcttcgacggctttaactacttccgacttttcgtcttccgttaacttgttcgggtcatcgaccttcaccttgtcgcccggtaccttcggttcgttcttgtcggcatcagtttggccttccgtacccttaccttcaacgaccttgtcccctgggatcgtgtccttggagccatctgggtaggtaactgttacgtcgccgttgtcgccgaccgtaaccttgctgccttctggcaacgttgacttgccattctcatccttgttggcgtcttcgacggctttaactacttccgacttttcgtcttccgttaacttgttcgggtcatcgaccttcaccttgtcgcccggtaccttcggttcgttcttgtcggcatcagtttggccttccgtacccttaccttcaacgaccttgtcccctgggatcgtgtccttggagccatctgggtaggtaactgttacgtcgccgttgtcgccgaccgtaaccttgctgccttctggcaacgttgacttgccattctcatccttgttggcgtcttcgacggctttaactacttccgacttttcgtcttccgttaacttgttcgggtcatcgaccttcaccttgtcgcccggcacctttggttcattcttggcggcatcgctcttgccttccaccactttgtcccctgggatcgtgtcgactgaattgtctgggtaggtaatagtggtatctccattgtcacccacagcaatcttggttccttctggtaagccggtgttgtgatcacgaatgttgtcttcgacttctttcttttcgtcattagtcagcttcgttggatcatcaaccttggtcttggctggaaccgttggatccagcttttcagcactagtcttttcttcaaccagctgattaccttcgatagtgtcgactgacttgtctgggtaggtaatagtggtatctccattgtcacccacagcaatcttggttccttctggtaagccagtgttgtgatcacgaatgttgtcttcgacttctttcttttcgtcattagtcagcttcgttggatcatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcaactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcaactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcaactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcaactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcaactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagcttttcagcactagtcttttcttcaaccagctgattaccttcgatagtgtcgactgacttgtctgggtaggtaattgtagcttttccatcattagctacggtgacacccgttccttctgggaacttatccttattagcttcaacaatcttatcttcgatcgtcttcttttcatcagccgttaagctggttggattatcaaccttggtcttggctggaaccgttggatccagctctgctgaagtctttttgactacatacacatattcatcgtgatgatcaatagtatatgttccatttacagtatttgcttgattggtcgccaaattatagtccgttggtaaattgacatcataattataattttctcccaatttaccactaatcttatctgttgctacttcttccccatctcccggcacaaaaatagaatttttactcccagttacatcgatataatgaactctaacttcagacttatcttcactaccatcctttgcataatagtaaacaataccatcattagttgatgtaatctgatttatatatgtgtaccattttccatgcgaaataaacgacatgcgatcgttaacatttaacttgttccccaagtaacgtgtcgtattattaagcacttcaccatcataatacgcagtaactcgaaccaacccttgagcgtcaattactgtttgctttataactacatgtttatcaagtctaaaatcatacgattcacccactttatatggggagatatatcctgtggtctctggcgattttttcaatgtatatccatcaatagttggtgcctctccggtaattgtgtatttctgataagcaacaccttcaaaagattttggcactgcaatttcgtctcccgttgcttgatcaatataatgaatcgtagttgtcattttcgttggtattggagtcatcacaaagccatttcccattgaagctgggtctcccttaattccggtattgtgaccatatgcaaaaccaaccaccatgccatatatattatcgcctttttcgatcccatcaagatcaattgaagcactagtcccatcataattagtaaaaattggagtatgagtagttccactatactcaaccttctttgattcaccaggtgctaccactgcttcttgtatatttttacccaatccagtatgcaaaattgttacatataaactattatcattcaaattatttgagcgggccaacaaatagatagcatggtaatgttcattatagttagcaacaccggcaaagtagtatctcccgctctcatcgttggcagtgtggttttgtaagatttcctttattttttctgttgaagtgtcctgataccacttcaggttattgtatacccagttatccgtgggcttattaattatctccgttaacatgggctgggaatccagcttaatgtcttggtttgaaatcggtaagctagcagtacctgccaccttcattactggtcgtgcagccagtactttaaacttggcggctgtaaacttggcggttgtaaacttggcggttgtaaacttggcggttatcttttgtgtagttggtgttgttgcgtcgttagccggcgttacttcagtatcttttttgtcgacattggtagtattttgcgtagtatcttggccttgcggagtatcttggtgatttgttgcctcttcagtatcggttgtaggtacttgctgatttacattttggccatttgcttgtttatctgtactatctccactagtctgcggcgtagatgttgtaccttctgttgtaccttcagtaaccttgtccttattgcccccttgagtcgtggtacttcgtgttacatcatcactaggactagtaacagtatctgctaataccgcatggttgccatatagcataaaagttgtccccaacaatactgatgctactcctacagataacttccgtattccccaacgttgcttcctttcggcatgcttttgttggtagaattgatgattgtttttcgaaaccatatccgttcctcctaagctcataaaatatatatacttatcacactcttagtgtatcatatacttcgtataaatctatcaaaaaaacgattcctaaatttcaagaataagttagccactggactcaaataaataatactgatcaattgattattggtcgatggagctgtgatatctcttggtagaaggccttacgatagatatccattgacgaatgtccattaaacatagctcgtggatagtgattcatccaatcattagtcgctatgatctgagcactactatagttatttataacttcacctttggtaatctccttgcggagaaaccggttattgatctcattggatccgcgttcccaaggagaatatgggtcagtgtaaaaaacatggtcatgaactcgcgttaactcactaaattcagaaccattatcagaagtaattgttttaaaaatgcgatagtaagcattcttgccaagcttctgacgcaactcaacaaaaaaatgattcactgcatatgcagttttactggtaatttttctcgtaatattaacccgtgaaaaacgatcagtcattactagaacaacgctatccttgccatctttatgaccttgaatagtgtctagttcccaatgaccaatttcggaccgttggtccgcaacctgtggacgttgagcaatgttaggtcctaagcactttttggcttgtgaatgagattgatggtgtttacgtttagttttctcaaaaaggtccaagttagacgtacggaatacaccatcattaatccactgatacaaagtcacaacagacttagggatcagtgaatcatcactcatcaaatcacgtgccttataaatagccgcttgaggagagtaacgatgctcatcaaattcaccaagcattaattggtcggccaattgtaaaaaacgctttgagcggtaatataaacgaggacgaccggaccgttggtggcatttaagataaatattctgaccagcttcataactgtagatgtgataagggtaatcgtaagtcttaccattgaatttttgacgacgaatttggcgaactgtaccacgtttaagctcattattaatggtttggtggttcactcctaattgacgaccgattgcgcgattggaaagtccttgcgactttaaagtcgcaatcatcactctctcttctttagtaaggtgtgcatatttgcgataagtggccaaaaggttagtgagcatggtatcatttaagtgcgtcatttgacggacatcctttcatatagttttgattcacttaatatgatacctgatgtcacgccgaatggcgtttttgcatttaccaccaattaggtggctaacttcattctataatccaccgttttaatatctttttgaaagcgtcttccaatcgctaaccaactaatagttaattttcttaagtcagtagggaaaatgggcccaccatgcggcccgaagccacaaaaaaagccccccgccagcagcaatcaggccgcaagcggggggcttttcggtgggggccgaggcctcaaccaatcccttataagttgctaaaatcagttttatctaaatctgtatccgggttaacttttggccaactgtcaaagtgccgcaaccaccatttgtaattatcgtcggcgacttggtagaacaagcccgtggacgagatccggtacttggtaaagccgttgccgacttgatccatcgtgccaatgattggcaccccatagaagtactggtggtccatgtcaataatcgtggtaaagtgcccactcttggcctctttgtcggtaaagaagccttcaaagtacttaatcccttccatcaggactaagcgtgattccatatcggccaagtactccggcgttaaatgttgcgaaattaccggtggattcccggacggataagtgttttcgttgtaccccgccgtcatggtatgcggcgccaacaacacggcaatcgatcccaagtgggagtaaccggcaaattgcggcatcagcccagcttggtattccgctaacgcatgcacggccaacattgccttgcgcttatcattgaggggcgctaattccaaggggtgttcaccgatggcaaagcgcatcaagttgacggtctttaacatccgctgactgtaagcatccgccaaattgaggagcggctttaacgcggccacatcggcatccgttggcaccgtccgaatcgccttggtgacatccccattgatcgcatcctggccaccacggccggcttccagttccacttgcaattgtccctttaagcggtccaccgtggccaccagctgatcataagcaggggtccccacttgcaagtaatctccaaccgttcggtattgcagatattccggatccagcggggccccttcataaacgctcccttggtatggcaaggtcgcattgactaattcggcccgttccacaactttcttcagtgtggtcgtgagtttgtagtgttcgtcagcatattggacataggtactggttcccggcacctgctcggccattagttgctccaaagcttcttgccgccgcacattattgtccgcgatcaatttatccgcggccgcttgggcggcttccgcactggtcaagacctcctgtaatgtggccgcttgactttcatactgataggcctggtcgggatcggccagcatcgcttgcgcgcccttgatgaagtcattgacccggttgatttcattgtataaggtcaaccgcgtcgcaactaagttttgcaaggcgatcacggcggcttccaaatcgcgccgcccctgcatttgttgggccgaactttggatatataaatccatccatcgtttcagtgacgcctgattatcctgaatcccttgcgtggtataagtctttagatttggtaagacattgatcccgtatgcttgcaagatgccttctgcggcctggcggtattcaggactgacatactgcaaggccgtttgatagtaggcgaccgtagctttaaattcattgatcgcatccactttggcctgctcggcgggactcaaaatcgcgccgtctaatttggcctgggtggcctcaacttgcgccacggcggcatccagcatcgcctgcgtcaccgctggcgtggtcatcagtttttgtaaggccgccacggcttcgtcatacggggcttgagccgtcgtcgtggcattgtgataccgcggatcttgttcccgttggtcataccgcttcagcaaaaccgtcgccacgttaaagtccgtagcctgaccatccaacgcagcttgagccgcatcgatttgcgcgatggcggcctgcatttgctccgccgtaacttgcggatcgtattgcaactggctcgcggctgctaaagcggtccggtaagctaattgcttggcagcatccgcattgtaatacgcggccgttgtcatcacgctttgacccgttaacaaccgccgttgtaacggttggagatcaattttcggttgagggcgaggggttggtttcacctcgtcgatcgactggggttgctcgtcgctggccccagaaccagacgttgggttgtcaccactcgtggctggtgtgtctgtcccagacgttggcgttttgctggctgtgctactgtccgacgtggctggtgcttccccacctggcgttgcactggtcgttggattgtcaccgctcgtggccggcgtgtccgtcccggacgttggcgtttcacccgctgtgccactatccgacgtggctggtgtgtctgtcccagacgttggcgttttgctggctgtactactgtccgacgtggctggtgcttccccacctggcgttgcactggtcgttggattgttaccgctcgtggccggcgtgtccgtcccggacgttggcgtttcacccgctgtgccactatccgacgtggctggtgcttccccacctggcgtcgcgctggtcgttggattgtcaccgctcgtggccggcgtgtccgtcccggagcttggcgtttcgcccgctgaggcactagctgacgtggctggtgcttccccacctggcgttgcactggtcgttgggttgtcaccactcgtggccggcgtttctgtcccggacgttggtgtttcacccactgaaccactatccgacgtggctggtacttccccgcctggcgttgcactggtcattggattgtcgccgctcgtggccggtgtgtccgtcccggacgttggcgtttcgctcgctgaagtactgccggacgttgccggtgcttccccacctggcgttacactggtcgttgggttgtcgccgctcgtggccggcgtgtccgtcccagagcttggcgcttcacccgctgaaccactgtccgacgtggctggtgcttccccacctggcgttgcactggtcgttgggttatcaccactcgtggctggtgtgtctgtcccagacgttggcgttttgctggctgtgctactgtccgacgtggctggtgcttccccacctggcgttgcactggtcgttggattgtcaccgctcgtggccggcgtgtccgtcccggacgttggcgtttcacccgctgtgccactatccgacgtggctggtgcttccccacctggcgttgcactggtcgttgggttgtcaccactcgtggccggcgtttctgtcccggacgttggtgtttcacccactgaaccactatccgacgttgctggtacttccccgcctggcgttgcactggtcgttggattgtcgccgctcgtggccggtgtgtccgtcccggatgttggtgtttcacccgctgaggcactgctggacgtcgccggtgtttccccgcctggcgtcgcgctggtcgttgggtgctcgccgctcgttaccggcgtgtccgtcccggacgttggcgtttcacccgctgaaccactgtccgacgtggctggtgcttccccacctggcgttgcactggtcgttgggttatcaccactcgtggctggtgtgtctgtcccagacgttggcgttttgctggctgtgctactgtccgacgtggctggtgcttccccacctggcgttgcactggtcgttggattgtcaccgctcgtggccggcgtttctgtcccggacgttggtgtttcacccactgaaccactatccgacgttgctggtacttccccgcctggcattgcactggtcgttggattgtcgtcgctcgtggccggtgtgtccgtcccggacgttggtgtttcacccgctacgccactgtccgacgttgctggtgcttccccgcctagtgttgcactggtcgttggattgtcgccgctcgtggccggtgtgtccgtctcggatgttggcgtttcgctggctgtgctactgtccgacgttgccggtgcttccccgcctggcgttgcacttgacgttgggttgtcgccgctcgttaccggtgtgtccgtcccggatgttggcgtttcgctcgctgagccactagctgacgttgcgggtacttccccacctggcgtcacactgaccgttggcttgtcacccttcgtggttggctgactcccttgatcaagcggggtggccgccattcccaggccaccaaaagtcccgatcggctcactgctccggcctgaactgacttgcggccacaggatcgcattggtcgttccgattggggtccgccagacttgcggtggcaagtttcgatcaatcagtttccgaccatccggcgtagtcatcgtcacgtggttgccgcgaatctttacgaccgttcccaccgggatgtggtactgatctccttcgtgcaaaccattccactccatcaaagtatggtaatcaatccccaaaacttgcgccaaggcccacaaagtgtcacccgcccggaaagtataggtttgatccgttggcgcaatgcggggcgcaatctccgccggcgtcgtcgctcgccacggtaacaagctcgccgcatcaatcgtggttaggcctaagcctaaggtaaacgcggttaagtcaatcgcaatccaatggtttcctttcttaactaacttgacccggtacaaccggtcagcaatcatttgatatttatgttccatttttctcccccttattttaaggataatttaaccaatggccactctgcttcaagttaattctaacttaatttcttgcttttttcacttattacgcgaaaaaagaggctgatcagcgatcaagcccctttcctcattggctaaattattcttttcgtttccgcttgctcaggcccaacaaccctagaacgccgagcaacgtcaagcccagcacacttgtttcagacgtttggttccccgtctgtggcagttcttgccttgccgttggggttccttggcccgaaggggtcgacgttgattgactcggtgccgttggttgagcaggctgcgatggtcctaccggttggactggttgaactgacggcgtaatctcaccaccgttggtcgtcttcaagtagtagaagatgacctcggtcaagcgaccatcggcccctttgatttcccgacgttcaaattggtgaccagtaatcactttgtggtattcatcaaaattcgtggccccgttcccctcaacgatgatcgaatccgcaattgaatgcccattttcatcataaatgttaaaaatataaatttatccccataatttgctattaaacccatttaccaatagctagataaataaatcatctttgttataacttatttcctgatcgagtaactaacttttcgctcttaatctttccaaagcttattcaaaaacccatcaaaaaaaaacgccaaacccccttgaatgggtttggcgttttagtcaactaaatttcgtttagccttcatcttttggcgtttgccgcttcttcttccgacccagcaatccggccaacagcaagcccaaaccacccagcagcccaccttggttggtagtggctccagtttggggcagcttgcccttgctcttgtcacgctgcgcggcggcttggtccgttgccgtttgatcccgcaagctgactggagcgctttgcccatgcttagttgccgacgtggacgatgtgagcgacgtggacgtgaagtcaatttcttcagaagcgtaatcatgcagtcccttcaatgagtcactttgtgaagtggacatgctcatcgattagatgcccgattgggaatcaaccttctgactttcgctggccgaaagactgtccgaagctaacgaagcacttgtcgaagctgacgttgaggcactcgtcgaagcactcgtggatgcgcttgttgacgcactcgtcgaagctgacgtcgaggcactcgttgacgcactagtagatgcactcgtcgaagcactcgttgacgcactcgtcgaagcgctggttgaggctgacgtcgatgcgctcgttgacgcactcgttgatgcactcgtcgaagcactagtagatgcgctagtcgaagcactcgtcgaggcactcgtggatgcgcttgttgacgcactcgtcgaagctgacgtcgaggcactcgttgacatgctttgactttgtaccgtgctcaatgacgcactttcactttgtgctgcacttaacgattcacttgtactaatagattccgactcttgccttttgcttgtactagtagattccgatttcttcagggaatgactagtgctagcactctccagttgacttggaatcgtcgaatcaatcgtcttattgtccttatttaaattataaacttcctgtcctactaactcaccttgtaaattcttccacccatcttggtaggagttagcaatcgcatagaccccgagaaagatcctttattagcccctgccgctaatttggcctgatcagcattactatgtttcgtcgtaaaagtaatcgtgtaagaagcgttttgtcccccggtcgtattcccccacgattggagatacatagccgtcccaatcgtactcttatcaaaggaagtcgtaaatggcgcggttccatttactaaatcaaatgatggcggattccctccaacatttgcgttatccatttcgttactataagcaaaagcatcaccatttttatcgcttccccggcccgaaaagaccgagttatcaaagtcgctacttgacatatgccaaatatcggcataccgcccgaagtgatagtacagattcgtggtgttaccgattaccccgtttgttggattaacgtccctgggcttaaatgagatgtctgattttggattgacgttccctgagtcgggatcatccgctgaatcccgcaccttcacaccgcccccggtcccttccagttggtaggtcgttcccgggatcatgctggtgtggatattcacatcaccaatgatttggtagtccttggttaggtaaaagcccatttgaccttgttgtagtgggtatttagaagccgctccccagcccttgtaccagaccccctggccgggataaaaggtaatcttccattttgtatacccgtcccccaagtcgcttttttcgactttaatattttccggtgcattatatagttgtttatcattgtcattaccaatagaattattacgcgcggtataggcatttaagttcgtccacagtcgatccgaccctacgatccacttataattaccgttccacaaagccgctgtatcaccagttgctgtattatcatctggcgttaaaaagttgtcactccctgtggctgaattagcatcaaaaagggccatttgagtggccaattgttcaggcgtgatcccagcatcgatcaccgtcatcaacgattgcaattcacttaaaccgtagctggcatcactttcagtgacttgattcttggccaagacggcttggtattgggcaatcgccgcttggtaggcttgctgatagacactggccgcgttcttgtaactgtccgtggccataaaggtgttggcttgggccaccagttgctttaattggtcgacctgcgatgtggtcgtcgtcgccgtggttgccatcaggctatcggtgctcatcgtctgactggtcgtactcgtggtcgtttggctgttggtactcgtcgtgctggccgattccttggccgaagtcgaattgctggttaaggacgcactggtactcgtggcggacgtcgacgtgctagtttcactagtggatagtgagcccgaagtactggtcacttgattgttggcggaagtcaaactaactcgatcagtattcgctaaggcactggccgcggcattattcgtggccgtcgtttggacccccgtggtcgtggccgccaacgctccggttgaagcaaccgtgccgccccccaatcattgccccggcggctaagacccctttcagcaaggtcgccgactttgaatccaagttcgcttctgattcatccaattgcaccttgtgtggtgccgaatgcgttgcgatctttagtaaacccacccgggttaacaaacattgcacccattgcttccctgacttgtacaattttacccgagtagtccgggagctttcggtgatcgtttccttttttgtccgtttcaagatcccacgtcctttcatttctttatgtacgcttctagtcagttgccttgcgctcaatatttatcaattgattaacccgtcctgcgacgctcgtcccaatttcaaacattcttgtcagagatattccacgattacgtttagttaataatttcagcgctttctttactcgttgttgcgactgtttagctggacgggcgtaggccccattgtggtctacacccaacgaaaagccaagaaacttcaaccgtagagggctaccgactttggttttatctgggttcactttaactttcaagcgcttttctagaaactgggtaatgcttcgcattactcgttctccggctcgttgacttttaacatagatattacaatcatccgcatagcgcacaaagtgatgaccacgtctagtcaactctttgtccaactcatttagatagatgttcgccagtagtggtgacaatggccctccttgtggggttcctttttcactcttagcgaaaagcccatggtctaagactccgctagttagaaacttacgaatgagtcttagtgtccatgggtcatcaatatattgttggagatacttaatcattaagtcatgattaacgttatcaaaataggcttttaggtctaagtcgacaactcttcgatagccttgattataaagatctactacttttgcaatagcgtcatgggccccacggtggggacggaagccaaaactattatcagagaaaacacgctcaaagataggcgtaagaatttgggctacaacttgttgaaccattcggtccaccacagttggtattccaagtcttcttactccaccattaggcttcggaatttctacccgtttgactggtgctggtttatacttgccctcacgcaaactagcgatcagttccatcttattttctctgagatatggcagaaggtcattgactgtcatatcgtcaatgcctgctgctcctttatttctcttaactcgcaaataagcctgattaaggttattgcgatccaagactaagtcttggatagtgacactcatacctttaccttcaccataaccggtactacgcgcccttgtgtactttcggttttccaaacctatcctcgacaagcggtcagcttgttgttctgttttctgcgatcgtcgcacctgattacacctccgatataagttacaagttattgtcgttcagtccttaatctgattactcaaactactatgacctcggctgactcctgacttactcaacgctacaccactgtaccgcttgcttctgtggaaatttatcttattcctcttgtcggaagcttgtaagtcaggcctccccgggtaagaatattagctttcgtaccatgtcatcgttagctttactgagaccaacttcgagtagtattggacttcaacttgtctagcagccttatccagttaatttcagccttatagctacttcttgttcatcgatgcagtactttgccttagacttccttcagattccacctcacggtggacacccttgtcctcagctcatggttccgactactacggcccatagcggactttcaccacctagctaatacccatgccgggcgcactacaaaaaaagcacccagctttcacactgggtgctttcgtcatatggcaaacattttggcaaacaaacatgttatttttaatgagttggtcaagttttagcactgccaaaatgccgatatatcgcgcttccaactctaagttacattacaattctattcgtattcgatcgtcgaaggtggcttactcgtaacatcataaagaatgcggttaacgtggtcgacttcatttacgattcggactgagatcttttgaagaatatcccatggaatcttagcgaaatcggctgtcatcccatcaattgaggtaacggcccggatagcaactgcatagtcatatgtccggccatcgcccatgacaccaactgaacgaatacctggtaagacagtaaagtattgccaaatttcttcatcaagacctgcttttttgatttcttcacgaaggattgcatcactttcacgaacaatttcaagcttttcaggagtaatttcaccaataacacgaattccaagacctggacctgggaatggttgacgccataccaattcatgtggaattccaagtttttcaccgagttcacgggtttcatccttaaagagcttgcgtaatggttcaattaacttgaaaccgagcttctttggcaaaccaccaacattatggtgagacttaattgtctgggcggtgtctgttccagattcaattacgtccgtataaagcgtaccttgagctaagaaatcagcatctttaatcttcttggcctcttcgttaaagacttcgataaattccttaccgataatcttccgcttttgttctggatcggtaataccttcaagcttacctaagaagcgatctgctgcgtcaaccttaataatgttaacaccaaggtcgcgactcaacgcatccatcacttggtcagcttcgttcttccgtaacaatccgtggtcaacaaagatacaagtaagttgatcgccaattgccttatgaatcaaaacggcggtaacactggaatcgaccccaccagaaagacctaagataaccctcttatcaccgacttctttgcggatttcatcaatctgcatgtcgatgaagtcatccatcgtccagtttgctttagcgccacaaacatcaaaagcaaagcggcgtaaaatgtctaatccgtattcggaattacgaacttcagtgtggaattgaacaccatagaatttacggtcattatcagcaatcgatgcgattggacagttcttactagtagcagtaacttcaaatccagctggggcttgagttactaaatcaccatgactcatccatacatattgcttctttggcaaacctttgaataatacagcctcgtcatcaagtacttcaatatctgctcgtccatattcggagttatcagctttttcaacctttccgccaaggtcgtatgacattaattgcattccataacaaatacctagaatcgggataccaagcttaaagatttctggatcgaccttgaatgcgtttggatcataaacactattagggccaccagagaagatgatccctttaggattaatctctttgatctcgtctgcggttaacttgtgagaaagcagttcggaataaataccgaaatcacgaagccgacgagtaatcaattgattgtattggctaccaaaatccaagacaatgatcttatcaaacgcatctaaattgatgtttgccacaatgacacttcctttgttcaaatttttattcttaaaggctagtttacaggctgaacatggcatggtcaatgattatttaatattccataacaaaaagacgggagctaaattttctcacgcctttttcgttagatggaattttattgaggatatttaattagtgttctaaatcaatatttaatagacgtaattcttcatcaactgcttgtgcctcaagtgttttagtatctttatcagtttttatcatttcgacagcctcctcatctcatttaatctgtatccttcttaagtggtctgtgagtaattgtcaataaaaatgagtcataaatatcacgtgcaaccgtttcgaacattgatacattaggattaaaaagatttattttttacttttactagatgttttaactagattttctaatgcagaatttgtaatccattccaaattcggttgatttgaatgcgctttctgcatttgataaaatttagttagttattttttacttgaggtgcaatatgtttattcggacaaaatatcttaaccaactaataaacagcatgaaccagtcaacaattaaggttcttgttggcgttcggcggtgtggtaaaacgactattcttgaccagtttcgggcaactctccggcgtcaagaaatttcctcaagtcaaattcaagtgatcaactttgaatatctcctagaaaatgaattatgcaatccagaatatctcttacaatttattcttgatcgacttagtaaacaccagatgaattatatcttccttgatgaagtcgaagtggttccccagtttgcccgcgttgtaaatgccctaaattcactctctaatactgatatctatattacaagttccaacaaaaccattttggagaaagaaaatcttcaacaaatgatttcttatactatcatccccgttttcccttgcagcttccgtgaatacataaaaaggaaccaacaagaagctgattcccaatcgttatatcaatatttaaatgagggcgggttcccctatactcacgaaatccacggtccaatcaacctccgcaattacgtgaatgggatcatcaacacaattattattaccgatttcacccagcaggcgaccctttgcaatccaggcctgactaagcaacttgcccatcacttagctcatcatgctggaaccacacaaaatatctcccaaattgtcgatagtcttaaacgtcaccacatcactacttccaataagacggtcgatttttatttacagttcttacagaggtcctttatcttttacccatgcaaagaatatgatttttcccgtcgccacgtcaaaagtaccaatattcgttattatccggtagatcctagtattcggcaagctctcacactgaaaaagaatgtcctttctcaacgaatccttgaaaatattgtctttattgacttattgagccaaggctatcaagtatatagcggccgcatcaaagataatgagattacctttgtcgcaattaaaaatgatatctttacctgtatccaaatcgcttattcgcttgctgatgatggtgcctatcgccgggcgatcagcggattacggcaactttcctcaaaatataaaaagcttttaattacagtaaaaccagcgctcaattacgctggtttagatcctgatattgaaattattgacttgtatagttggctaaccaattaacctcgtcgcagataaagcttatccacgacatgtcccgttgtcttatgtaaaattacgtcagcacgacttttggttggaaggataaactctcgtaaattaggaaggtcgacgcgttgccaaacatcctttgccattttaaatgcttcctgacggtcacccttcgaataaggatagtaatagtttgatgggtcagtaaaggctgtctctagcaacatcccaaaccgttgaagataccaatgttcaatcaggtccggatctgcgtcaacatacaatgaccagtcaaagtaatcactgacatatagttgctggttacttggcaattgcaacgtgttaatcccttctacaatcaatatgtctgggcgatcaattaccaagggcttatccagctgaacatcataaacttgatgggagtatgtaggcgccttgacaactggttcccctgccttaacatcattaagaaactggaggagcctttccatgtcatatgattcgggaaagcctttccgatccatgatcccccgccgttttaattctgcattaggatataagaacccatccgttgtcattaattctacccgcttatcaggcagcatcttatttagtaagatactaatcaaccgagcgatggtgctcttcccaactgcaaccgaacctgcaataccaataatatatggaatgcgcatcgtggaacgctgtaaaaagtttgccttttgcatctgccattccaaaaagttctggtagcgcagttgaattaattttattagcggcaaatatacatcttgcacatcctcaattgaaattcgatcattcaacgatttaatttcatccaagttcccctgggttaaccgtactgaatcagttgggaaaaagccgtgccatgtttgccgatcaaattgttcgtagttcatccattcatccattatgcaaaatcctttatttcacccgtcaatgaaaacggttactcaagtttaatagtaacatattataaacataattaaagctcaatctagcttgtgaacacctaaacattttaccagataattagcgcagcgcaactgtttgaaataaaaatggagactagtactattactggcctccattttcatttgattatggtttagggaagtttaatttcggataattctttaactctggtgcatcggttgtgtaatcatcgaaagtactctggttattattttccgactttaaacttgtcttctgtttcttttgctgcttctgtaaattcttcaagctcttcttaaggttataagtatattgttttttatcaactttcttaaatcctggaagtttgtagaaccgaagcaagtcaccattcacgactttatctgataatccaagatcagttgtaacgtatttttgaatcttaccaatttctttacgttgcgctgcggtttggtgagtaatctgcttaccattcttagtgtaatagtagtcaccattatacttagtgtattttggcgttacccaatcaccatttctaaacggtacaatttgcttattttctggtgagagcaagtcttggccgaattgaatataattcttagagctaattcctaacaaatcctcaagagtaggtaaaacatcaatttcaccaccatacgtatggttaatgccaccttttaggccaggcatattaatcataaatggtactttttggaacattgctagatcataattagttactttcttcttacctaagatttgcgcaatggctggttggtggttattagagattccatagtggtcaccataaagaactaacacactgttttgccgtaaccccgtcttatcaaggtaatcaagaaattcgccaagtgattcatctaagtatcgtgcagtttgaatataagggtcgaccgtgtcatcaccagtcttccacgcttcgatatccttattctttttatcaagaatatatggatagtggttagtaactgtgatgatctttgcatagaatggttgtggaagctgctcgatatagtgggctgattctttcatgaagatcttatccttcattccatatccagcatcataatccttggtctttgggtaatactccttactaaagaagtattggtaaccaaaagacttataagcattatcacggttccagaaactaggaacatccccgtggaatgaggccgtcgtataacctagtttttgatgaagaagcgctggcgcagattggaaggtattagtcgtcccatcagtaaccattgctgatccttctggaagaccaaatagcgagttttcgagcattgtttctgcatccgccgtctttccttgaccaacttggtggaagaaattatcaaacgccaaagtatcattagcatggtacaacttattcaggttcggcattacttcttgaccatcttctttatagtcgatcatgaattgctggagactttcaaggtgaatgataaaaatattctttcctttagccttaccgtaatattcaacgtttggcgtagcataattactatggatgaaatgcaaaaccggctttaattcgtcacgattagcacgcgcttttactacactgttattagtcgtcttaaccccatcataaactgtatatgcttcgagtcctagatacttaacaatataattattatcaaatgttcgcgtaagtagttgtgaacgatcactttccgccattcctaagttaactccaaatagaacaaagccaagggcagtaatcgtcatcgcatatctaaccttaaagcgtcgcatatcaacacggacaaagtggaaaaataagatgagtgctaaaattacaacatccaggtaaaccaaaaagtcttcgggacgtaatatccccattaaacttttaccaagattatttgaagccgctccagatccctttattacgttaaaggtaatgaaatctgaaaattctcgatagtacaaaatatttgcaaaaagccatgtcgacaatgccgcattaattatcaacatcatccaataggacaagcgtccacggaaatataatgcaattcccaaaaatacaagggcacttggaatcgtattaaatgctaaaaggaattgttgcatgcttccttttacacctaaattaaattcattttgataagcccaatagctctttaaacaaaataaaagtacaacaagcagaaaaaaaccgagcttggtattcaagacacggcggagcttctgcaacgctgttttcatagtcgttcctccataaaaaaatatcattattaacaataatacactaactagctaaccgcaaccgtacaattttatttttccaaaaagttaaaaattctgtcacttttctgtcgtagttaaccttttgaaaatagatcttaaatgttatgattgagtgtcgttaattaacagaagggactgagcaccatttcaaagaaaaaagcgaatttaatgttattactggttgctattctatggggaagcagctatgtatttgccaaactaacgattcaagcagggatgcattctggagttatcaatgcttgccggggaacaatgtgtgtaattgccggttatcttatcttccataaacagatcaacaaaatgacttggctggatttcaaactaggagtccttatgggaacaattaatttcctgggttattttttgcagactgatgctctccgttatactactccggctaaaaatgccttcttgacaaccttatatgttgcaattgctcccttgatcttgtggttgttttggcatgagcgtccacaacggaagacatattttgcggtcgccctcgctattatcggaatggctgtcatcactaatgttgctaatactggccttcaattaaattttggggactttctaactgttgtttctgctattttttgggccttacaattaatcttctttggaaagtacgcaccgaaagtttctagtccctgggtggtaatcttcatgattggcctatgtcaaggcacgttcggttggattacgactggattatttgaacgtactaaccttacacaaattcattgggttcaagccctgattcccctggctattttagcgatcgtcgtaaccttcttagcgcaaggaatgcaaattacagctcagcaatatactgatgctacatctgctggattattattgatgttagaatcattttttgccagcaccatgtcagttatcatgggctatgatccccttacaccacaactaattttgggtggtttaatcttacttttagccaatgcaattatgcaagttaatctccaagatgtgccatttttaagaaaacagaattaaaaataacgaggatgaaaagttttttcatcctcgttatttttatttgcttactttcttatcttccttggcaaccgctgcttgagctagcaagttgacatagttaaatggtcggtcaaagtttggctggaacattgtatcatacattccaagaaactcaattgtattttggttctgaatgcataacgaaatcagacttaaagtttctgaaatatcgtgtttactcatcatctgtgctcccaagattcgttgggtatccttatcccaaaccaatgacatcaggaccggcgtggtagttggtataaagtgcaatattactcttgccatttatttatcaacattaactttttcatattcatctgtcggcacttgggtcagcaaactagttgtcctgccaattgatactaagcttaactcatgcattgctcgagaacaaattgtatatagcaattgtcgctcatcgttaccatggtattgctgatcattcgcattccagacaataaccgcatcaaattccaacccttttgctagatatgccggcacaacaattggcccctttactaaccgttgattctctgtccgaataacggtggtcttgatattattggcatttaacttttgatacaactcttcactgtctttgagatctttaccaataattgcgacggcatcatggtcattctgatacttattaagaatattaataactgccgctaccccttcttgttcatccttagtttgataaacttgtggcttattaccttcacgttcaaaggcttcaattgcttcaccgtcaattaaaatatgcttagtaaagtcggtaatttgtttcgtggaacggtaagacttagttaattggacaaccttcgtcttttctggatcaaacatcgtccctaactgctttaatagtgaccgactattctcatgagtgaaaatcgcctggttaaggtctcctaacaatgtgaatttagcacggggaaaacgatatttaaggtaagctaactggtaagcatcataatcttgaacttcatcaacaaaaacgtaacgaatatcacgttgaccacgctttccagtaatcaaatcatacaggtacaggtaaatggtaattccgtttgcactgatatttcccttctttagctcttcttttatcccatcaacataacctttccattgctctgcagaaataccgtattcagcaatattaacaagttttggagttacccggagaaagtgtaaaaattgtccattgatgttaagccactgattatgatcgatggctttttttattggcataaatgcccgcataacgatttgacgcgcaaggaacttgtattctttatcttcatcctcaaattcacgtggctggttattaaataggttgtcgatttcttctttactcaagctttgaatttcatcctctacccatttgttgcgcatttcagatccaacacggtgattaaggtatttaataagagcttctttcgttccatccaacctatttcccaggttatagttattgttaaatgagtagtaaatctccttaatcttctctttgctcaaaaagactttaccattaaacataaggttgcggaaacgcatattagcatgaccaagatggttagcataacgctctgttgctttgaaatattgtaagctagttaatagttgttgtgcattcttagccgtttcatcttggtgactttcaaaccgttgttctaagttttgaacatgaagctttggtacccgacgattagcaaactggaagtaagtcatctggaccatattatgctcacccaattccggtaaaacttgatcaatgtagtcattaaataattggttaggtgaaaaaagaacaacttgtgaagaggtcaaattcccccggtaacggtaaagaagccaggcaacccgttggagaactgcagctgtctttcccgagccagcagccccctgaacaaacaacaattcatttttagtgtcacgaataatttcattttgtttccgttgaatcgtcgttacaatgctcttcatcttggtacttgaatggttaccaagagcatcaagaagcatctggtcgcctacttgttcgtcggtatcaaagatggttacaatcacgccatctttaatttggaattggcgcttaagagtaagatcaacctcttgttcacctaccggagtctggtacttaactttcccgagctttccttcatagtaaacagacgaaatcggtgctcgccagtcataaacaagaaagtgatctggcttatcggtaaaggatgcaagcccgatatataccttttcggattcattggcacctttttcacgaaaatcaatgcgagcaaagtaaggtttcttttcaagtcgctgtaaagttgctagccggtctgcagcgtgttgccagctattttgacgttcatctagcatctgctgttgagcacgaaaagacatggccgtatccatcatgcctgaataagtagtggtatttaagtggatatcatcaatttgcttattgatgcccttaatatcatgttgagccgttttaatctttttttctgctttttgttcggcctgttttactttatcaatcacattatcaaggtacttttgttctagttctttttcagttttcgtagacattacatactccctacctttcatcttcaggtcgacttacttaataatttatcttaaaatcatccaattattatatcattttcgccaattagtctgttaactttccgccttctattttttcaattattaaatgtcgtttaattttaatcctaagatcatcaaaataactaataataacgctacaatatattgaagccatgatccaggaggaggaaaacaacaatgagccatattttttatcttctaactcatattgcggaaataattattcccatgtttgagtggatgggcgcttggagctatgttctcctttttatcctaatttttatggaaactggattagtgattttcccatggtttcctggtgaatcactcgtctttttaacttgttctttcattgcttttaacccgatcttaaaaatggaaatcgtcatccccgtcttcttttttgcggcgctaattggtgacacagttaattattatattggtcattccctttctcattggcaatggctcaaaaaaagaatggccggtccccgttttgagaaagcacaagaatttttagcccgtcatgggatcaaagctgtagcattagggcgatttgtaccgctcattcgtacctttgtccccttaattgctggaacaatgcagtttccgttccatcgtttcacagttggcaatattatcggcgttactttatgggtagcgattggtgctggatgtggatattactttggaacaattccgtttgttcgtcagcacttctcacttatcatcttagcatttgttgtgtgttcactgttaggagttggcttgttagcacttatcaaagcgattcgtcaacgaattattaagcgaaaccgaatgctataattgctttttcttcagcgaaatcatgttaaaatgtaataagtatttttatttcgcttaaaggagtgctgtaactatgacaatcaacgtttattttgtacgccacggacaaacctatcttaatctctacaatcggatgcaaggttgggctgatggtccgctaacgccaaagggtgaagaagacgctaaacgagtaggacgggcgcttgctcctattcaatttgattatgtattttgcagcgacctcgcacgaacagtttcaactacccgtttcttgcttgctgaacatcctggtaataatccaacgccaattccagagccagcgtttcgggaagaattctttggctactttgaaggagaagatggccaacattttgctgactttcttggcggcccagatggttatcatagctttgcagaaatggttgccggttggggtccagacaaattaaaagataagattgcagccgcggataattatggtactgctgaagaccatgttactttctggaagcgggtagataaaggttttgaccgtttacgagcattgccagacggatcagaagtactagtagtttcacacggagccactattcgttcaatcgtccaacgctattctgacgcttacgatccaggcgattcaccacgtaacggaagcatcactaagctaactttagataagaataatactactgttgatttttataacaaacttgaattaccagaataatatccataaagggggaacactattcttcaatggagactaacatacaaactgcagaaccagtaattatcactggcttaaataccggtcaagaagactttgactactcaatggtcgaactggctgaactagcacaagcaaatcacatggaagttatcgatcggattgatcaagtcatcgatcgtcctaatcctgctacctactttggaaaaggcaaagtcgaagaaattcgtgacgtggctgatgctaatcacgttcctactattattactaatgatgaattatcaccaagccaattacgtaatcttgaagaaggaaccggatgtcgtattctagaccgaaccgctcttattttagagattttcgcaacccgtgcgcaatctagagaagccaaactccaagtacagatcgctaaactgcaataccgtttaccacgattgcaaactagtgcaagtgagcggttagaccagcaaaccggtggaggaagcggctttactaaccggggtgccggagaaaccaaacttgaaatggatcggcgaactatccaacatcaaatttcccaccttcgtcaagaactggctgctattgctaaatctgaacaaaccaagcgaaaacaacgagtaaagagtgcaattcccacagctgctcttgtcggctataccaatgctggtaaatccacgattatgaatggcctcgtaagaaaatatggagctgctgaagaaaaaactgtttttgaaaagaatatgttatttgccacccttgatacaagtgtccggcaactaacacttccagatcaaaaacgcttcttactcagtgacacggtcggttttgtcagcaagttgcctactcaccttgttgaatcatttaaatcaacacttgcagaagccgctaatgctgacttactaatccaagttattgattattctgatccacattacaaggaaatgatggaaacaactaacgagactttaaaacagattggaattaatgatattccaatgatcaatgtgtttaataaagcagataaaactgaaatagaatttcctatcctcgaaggtgacgatcaagttgtaatttcagctaaacaagatgcttcattagatcttctcgttgacgttattaagaagcatctctttaaagactatgttactaccacgcttttaattccatttactgatgggcacgtcgtttcttacctcaatgaacacactaatattttagatactacttatgaaagtgatgggacattattaacggtagaaatgtcagttcaagattatcaacggtttggaaagtatgaaaagaactaacataaaaagcagcgatcaatttttggccgctgctttttatgttagtctatctctctgcttttactccgaaaatcaaggagacaatcattactaagattactgctccaataatagatggaataattgccattcctgctacttgtggtccccatgcacctaacactgcttcaccgattgacgagccaaccagtccagctacgatattactgataactcccatcgatccaccgcgacgggttaatgcaccagcagcaagaccgatcaatccaccaacaattaaaacccaaatccaatgcataattatccctcctttttatcttccaatgtctctttaagatcagttgccttatccttagcttttcctttagctttctgcaactttccctcagtttcgcgggtcttgtagttggttattttaccttcaacctcttttaatttacccactactttatctttaattccatgtttatcgctagccaatatcatcagtcctttcatctattcttggctactagtggctgacaacattttattaatttcgctcccttctataatgactagtgctttcaacagttttaagtttaacagtctcccaacaagaaagcgatatcttaataggttacttaagttttctttaataattttatttatgtcttaattaaaaagaaactctaccttcataaattggtagagtttctttttattcttgaacttaattacattcttatttcatttcgtgaatgtttgccttctaaaatcgtaacagcatcattcaaactaatctcgaccatattgcgaatagatgtttcggttaggaacgcaacgtggggtgtaacaagaacatttggcattgccgctaatttcttgtaatcatctggaatttgatctggtgtaacttgcttcccaaagaaagaagtttcgtcagctaatgtatctaggccagcacccgcaatttctttattttccaatgctgaaattaagtccgcggtatttaccagttttccacgagccatgttaatcaagtaagcattgtctttcatcatcttaaattgtggtgctgcaatcatgttttcggtacttggtaacaacggtgtatgcaatgataaaatatccgcattcttaacaacagtatcgaaatcggtatattcaacgtatggttcatattcgacattatacgatgggtcatacgcaagaacttttgcgcctaatgctttataaatctgagcagtggccccaccaatattaccaaggccaacaattcccacggttaaattgtaaatttcattactgatcaagtcatcgctccaccgaaagtcgccatggctcatgcgttgttcgaattcaccaatccgtcgtaacaagtacatcgcctgtgtgacgcccatttctgcgattgcccgtggtgaataaatagggacattcgttacaatgatgccatttgctttacatgcatctaaatcaaaaatatcaaccccaaccattcgagcagctaattgctttattcccatggctgctaattgttcatacagttgttcatccccaagttttgttgtttgctgtaaggaaattccatcatatccctcagcaagcttaactgtattagcatttaatggttcagtaaccatcttgacatcattgtctgtcttctttgcccatgcttcaatataaggcttttcagtatcacgaacgctatacattattaatttcatcagttttcccattcctttcataaaaactgcttacattaatagcttagcactcctttacttaattatcagtatttaagcaacaaaaaagggtctgtgacttaagccaagttactttcataaaagacaaatggcgcagtacaacaatggcctccaacgcccggtaaaaccgaacgttggaggcctactgttgcttgcgggggctcccagaggctagcttcgcgtcgaaaaacgaagtcacgagtgacttctgtctcgctccctctgttatctttaattattgttcaccgttgtctccttggtttgggcgacgttgttgaaggtgcatgccgtcataatcgccttctggtccaagtagttcttggttattatccaattctgagcgaccagcatagtgatggtgttgtaaccaaatcatgccaactaataacaatgcatagaagacaattgcgattacgatcagaacagtgttacagaacatcgtgtaatgtgctcccaaaccaccagaaattgaatcacggagtcctaagattgagtaagtcatcggtaagtaccagtgaattacattatagaacttcattgtaatttccattgggaaggtaccaccagatccacctaattggagcattaagagaaccatggcgaagaatcgaccggggttatcaaagagcattgaaaggaacataacaattgccattgaagctaacccaaagcatatggttgtcgcaaagaatgcaactgggtgaataactgtaagtccacaagccatcataattgcatcttccgcgattgccattgcagttactaccagtgatccaactgttaccttacttgcccaccaagcgattggagctttaccaaattcagcaacccgacgaattgggtaaacaaagttaaatacaagtgccccaacatagattgctaatgatagaacgtatggtgctaaggcgtgaccatagtttggtacataactgtaatccgtgtgcttaagagcagttggttctgcaaacatcttggcagtccgtggtgaagtcttaataccgttgatttgctttgcaccacctgcaagcgatgtagccagttgagaagcaccagcattcaaccgcgcaattcctgaaataagagcaggagaattatcttgaagttgttgagttccggcagctaattggtttacaccagcaataagagcaggaacttgaccgtttagttgaccaagcgcaccagctaattgagctgcaccagaattcaaggccccgctattagcgttaagctgggcaattccgttacccaattggccaactccggctgtatattgaccgattccgctagccaattgaccagctccggctccagcttgggcgaccccagctgtgtattgaccgattccgctagctagttgattagcaccggctccagcttgagcaaccccagctgtatattgaccaattcctgaattaagcgtaccagcaccggcagcagcactatcaacaccattagtgtattggtttacaccactattaagcgtgcttgctccagaagaaatccgacttgttgcttgtttaagttgatcaacagctcctggcattgccgctagggtacctttatagccatttaaggttgctaataatgagttaatagtcccatctgcattatctaacacagcagacatttgtgagagctgacctaattgttgctgcataccactcaagcttccttgaagattgtttaattgaccaagagttccacttaatccttgaatagcagcaacgttagcactagcattttgtacaatttgttgagcggccttcttagattgatcactagctttatcatcactaagaatttgttgtgctaatccagcaatttgaccatcgttaattgcaatacctttaagcttgtcaccagcaccggcagcaccagataatgctcccgaagcttgttgaagactagcagcactactttgaacaccagcaagagcattcttggcagttgccaaaccggtctggagttgacctagtccttgctgaagattttgtgcttgatccatggcccccataatcccgttaaagttaatgtttcctaattgactgttaacggttgaattcaactgattagcaccggatgctagttgaccagaaccgttccttaagttctctgaattaccacttaacgtattcaaaccactgcttaattggttagcaccggagctcaatgtacccgagttagccattaaagtatttaacccagcattcaactgactagcaccaaaatttaacgcaccagagttagccattaaagtgcttaagccactgctcaactggttggcaccggaatttagtgcaccggaattagccattaattgaccaacaccattgccgaggagactaaccccaccagtatattgcatgataccatttgctaaggtttggctcccggtagcaagttgttgagcaccagaagctaatggtgcaacactaacacgcaaggtttgaaccccgttatttacttgggaaactccggcaacataacgatttacaccatcacttaatgtcaccattccagtaccaatttgttgggcaccatcagcggccttgttcatccccttacctacaacatgcaattgcttaaacattaccgttgcgtaagcgttagtaacttgggcacgaattttttcatttagccgtgtcatcccagtttggacaattacctgtccaatgtagtttaaagaaccattagtttgataatgtaacttcatcgtcttgggatgtttttgtaaaacagtcgttgcattttcagagaaatccttaggaatcgtaacaacagcatagtacttacgatggctcataccatactttgcttctttagcggatacgaattcccactttaattgatgatttttcttcaattcatcaacggtctgtttcccgacatccattttccggccttggtactcaaccggaatgtccttatttaccaccgcaaccggtaagtttcgtgtacttccatacgggtcccatactgattttaagaagaaaatactatataggaaaggtatgaagcaaataaccgttactgatagaagcagtaaacggttatgaataatatgacgaaattcgcctttaatcatgctccacatttaatacttcacctcaaaatttatcctttcataattttagtttgttaatgacttggtagctgctctcgcaaaattaataacgtcctcagttggtacatcataattattgccttgccaccagtaaaaggtcccgataatagcgccactcaatacataagcaagcatctcgggattatcagacttttgcagcgccgttacaattggatcattagtctcaagattgcgccgctctagaagaacctgacttaaaatatttaaaatttcggtatacaaagagctccgtgcactattaggtgctaaatgacggataacatctttatttttatcaatgtatgataataattgcttaataatgtcatcttcagaatctgtattctccgtcaatttattaatttgtgcatttaacgtttgctctaagagatcgtacttatcactaaaatagcgataaaaactgctccggtgcatcaatgcttctttacaaatttgatcaaccgtcaaactttcaaaagaatttttctctaataacgttatcaatgcattttcaaagtcacgaatagttctcgtaacacgcataactcttccctccccaaataatacaaatttaacatgattattctaacttgttgcaattcagtacaacaggggtaattaaagataattatttcatagcgagacaaaaatgaccatttgtccgtaaaaagacttttgtttgtatcttaatcaaacgaaaacaataatatgctcctaaatttaaatggtcaagcacggcagtaataactttatcgctcttttatagtaaaacgtattaaataattattaacttgctaaatctcttttctaaaatacggtataataaaagtattaaagctatgcgattggaggcttcataatggcaaaaactaaaaaacatttaactaaatccaaagataaagtatttcttggtgtctttgggggtatcgctgactactttggtcttgacgaaaccctcgttcggataatcggaattctcattttcgtctttactggctttttcccgctaggagtcttctacctcttagctgccctcgtaatgcctgaatataatggcaataagacaaacaatgatgacaatatcgtcgacggtgaattcagagaaaaataatgttgattgcagcaaaaaagggactgtgacataagttaagttactttcataaaaagcaaatacgcagtacaacaatggcctccaacgtccggcaaaaaagccgaacattggaggcctattgttgcttgcgggggctcccaaaggctagcttcgcgtcgaaaaacgaagtcacaagtgacttctgtctcgcttcctgaactaatcttaggttgttttttaagcattatttcgttgtttataagctacttgaacttgtagtccataatcttcttccgttaaaattgttgagccgcttcgcccagcaatcttattcgggcccccagtaacaactactgttgcaagatacaattgatacttatcatgagcagtatggacatcggttaggccgattttggtaatatgaccaactgggcgccgttccatttggttcatcccgatgtagatttcaagacggtgttgcaactcatcatgaactaattcaaagtatggcggaacagattgtgaattcaaagccgtaactggtttttcagttgcttgatactgttcaacgatttctttttcacttagaccatcatagccgttaacaaacacaccttccattaatagttggtcaacaacacggtgtaagttatgttgttcatgttcgtcaattgctactgctgctgggatcgtgtcggcattagcaaacaagccatttgaccggtttgccaattctgccgctagtcgttgttgtgcatcaagaggcgtcttagctttgccgtcctcaaatttttgaccagtaatctttgcgacacgcggtgaaataaaatcaaatcgtgaagtcttttcaagaaagtaaaagacgaaattaagatagataaaatatgttaatccaatcactgctaagcaatataacaatgcccgtagccaaacatgattcataaagagtcggaacgtaacataaactaaataaatatcgcccagaaaagcaataatgatataaatacgactctttaactttacgtcaaggttaaagtaactcaatgacgagttaatcatatcaagaaaactaaacattaataacccgcctccttattattcagtcgtagtcgttccggtagtattaccaccagtcgtgtcttgtgtcgttgtattattgttagttgttgtaccagtcgattgtgaggtactgtttcgattagcactcgtactttcgtttgtatttgctgatcgatttgtcgatgcttctgtgccagtgtttcctgctgaccgtgtaggttgattagtatccccagtatcgtccgttgtattgttgctattacttgtccgggtagttgatgaattacttgcactctcatcattatcatcacgatcgctttgtgaattccgacttgattgattgctttcctcatcacccgattgctgaaattggcgacttgttgatactgatgttacttttgcaccctcagaagtatgcgttgctttattaactactacattggtggcacccaacgcaagtaccaatgatacaagtgcaaatggggttactaatggcggtatctttgctcccatgtctcattctccttttccagagtatataatacacgaaaactggcccaataaatatgaatttattgtaaagattttttctggcattgggcacatatcccgtgcaattcaaaccgatgcccagtgattttaactcctggcaactgtttctcaaagaatttcttatcaattggtggcatttgaatttcttgaactcgtccacaaatatcacaaataaagtgatggtgatgagtaaaatcacacgaatatttaacctgcatctgatcatgatgttgacgcaattcgacaatgcccaatttctcaaattctttaaaattccgataaatagtatcgtgacttaatccagggaattgttctcgaagatattggtcaatttctacaatattaaagtaacgatcagggtgtcgcgcaactgattcaatcatcattttacgttgcttagtccaccgcaaatgatggtctttaataatggcctgtgcttgatcaattaatttctccaatcttttttcctcccgattaaagatgatattgtatcatattttaattctttttggataatatctgcctaacaattatatctatttgttgtttagtatttttccattgatcattaactacaacatgagcgatcccttttaaagccgctggtaaagcaagatcacggtgatactctttgctatgtaaacgagaacgaatcgcactcaatttatcgccccgcagtgtcattctcttagctaaagaagccatatgggtaacggtcaagaaaataatcactgcttgagcatcaagttgttgatggtaagtaatcgcaccagctgtgtcaagaacaatcacatcattttccccttgtttccatccttcttctaaaccttctaatgaagaaccatattgaaactggtcataagttacttgctcaagtaaatggagttttttcagggaagtcggtgtttcaaaatgatagtctaccccatcttgttcccctgaacgtggtcgccgcgtcgtatgggtgattacccggtgcatatcataatgattttgaagatagttagcgatagttgttttacctgagccagctgctcctgtcacaataaacacatacttattatttttcataattgcttattttaaatgatcgttaacttgatccaataattcttttaaattctcgtaggttaaccgttcacgagcatcttgatagttgaaccatccacaattcttaatctcttctgcttgcagatgaatgtcttccttgttatctaactcggcagtataaagggtcatttgcttatgattgccatttggtaagtcgtattcggtatacaccttaaaacttgtatcaattggtaattctaattgcgtttcttcctttatttcacgaattgctgtttcttctagtgattcattgccttcaacgtgacctttcgggaatccccagaagtgtcccttattttgactctctaagagtaaatactcaattccattttcaccttgacgatatacaactgcgccactagtaacttcaattgccatttttatccctcttttgtaattaaatttttctaatttacttttaatattaactacggtatcattattaattataaacgtggcgaaccatttcggcacgtacaatttattatagcaaaggtgggttaaagatgagcttaaacattatgcgaaaagaaagtcttgatcgatatcttggtgaagacaagcttttcgttaaatcaatgaatgctcgtgatctcatggcaattgggatcggtactgttattggtactgggattttcattctccctggaacaattgccgcaaattcagctggaccaggagtgtcattgtcatttctgttttcagcgattgtctgtgcgctagctgcaatgtgttatgccgagtttgcttctgcattaccggttgctgggagtgcctactcatacggaaatgtagtgtttggtgaattccttggctggttgctgggctgggcgttggttcttgaatacatgttagctgttgcgtctgtttcaacaggttgggcagcctacttcaatacattgcttgaaggatttggtattcatctccctaaagcactctcaggtccatttgatccagctcatggtacctacataaatatcgtggcggtcgtaattgttcttttgattacagtaatgcttgcacgggggatgcaatcctcattgcgtatcaataacattgctgttttccttaaaattgcaattatcttgatctttattattgttggtttcttcttcattaagcccaaaaattaccatcctttccttccataccacatgaagggtgtgattcacggggcaacgatcggtttctttgcttaccttggtttcgactgtgtttccagttcggctgccgaagttaagaatcctaaacgaaatatgcctctaggaattattgggacacttgctgttgcaacaatcttatatactggtgttgccgtagtcctaactgggatggttaagtacaccaaacttgacgttgccaatccagtggcgttcgccttacagatggttcatcaagactggttggcagaattattgtcaattggggctttgatcggaatgttcacaatgatggtttcaatgatctattctagttctcgtttgatctatgcaattggtcgtgacggtctgcttccttcattcttaggaaagcttgataaaaagagccactcgccacaagttgcattatggatcgtggcgattattatcgctatcatgggcggacttgtttcccttgatcaacttacaagtttagttaacatcggaaccttgtttgctttcatgctcgtttcatttgggattattccgcttcgtaagcgaaaggatatcggtaatcgtggaggctttaaggtgcctctctaccctgtgcttccaattctttctggtctcgcctgccttggcatgatgacccagttgcaaaaagaaacatatattggagcagcaatttggtttggaatcggaattatcatctacttcacttacggctactggcacagtaagttagcagataagaattaatagcgtgaactactcggccataaatgaccgagcttctgggaacacgaagtagtatttaggatattacacaagtattcttgctacctaacttacagaactccgttcttttaccaaggctagttcctagccaacggcttttaatcctttttgcaagatgttaactgccgcattaacatctcggtcgtggtgaacgccacactttggacaagtccattcgcgaacttcaagtggcttcttgccactgttaaagccacaatgcgaacagatttgactggtatagtttggtttcaccaagactagttgtttgccataccaagcacacttgtattccagcatcgtccggaactgataccaactagcgttagcgatcgacttcgctaagtggtgattcttttggagattcttggctttcaaatcctcaataacaatcacgtcgtactgcttaactagagccgtcgttagcttgtggaggtaatccttgcgcttgttggcaattcgttgttgataatgggctttaacaagtcgggcgcgttgccagttctgataatcattgagtgctaacttggtatcttggtggttgtgattccattggcgaacggcaacggttgcccggtggcgccgcttgctgaatttactttgccacttcgttacttgatgttctaacaatttagcgttgaaggtaccgtacttgacaccatcagaactaatcgcaaggtcggccaggcctacgtcaagcccgaccatttgccccgttttcggtaaccgttcaacggttgtttcaacttgcagggagaggtagtaacgacccgtcgggtcataactgaccgtataacgcttaattttggcctcaccaataagagtcgttttactcgtgcgtatacttccgagttttggtaattgtaaccgccgcttggcaagtaccttgcacgttgatcggccagtgtaggcctgataggccacatggcggctcttaaagcggggatagccaccttggtgcttaaacaatcgtttaaaggcctcggtaagattatggttcaccactaggaaactggtggaatcactttccttgagaaagggatattcacgcttgagctgtttcaagaggtagttcataccatactcattgacgaagtggctactgggattgttttggtaacgctccttagccatactgagcatttggttccaaacgaagcggtcattaccaaacatttgccataactgatcccgttgggattggttagggtacaagcgaagtttgatccctttaatgaccttgttcattctagttccacctcctttttccgttgatcatcaatgtacttggcaacggcttgttcattaacggccccaatactttcaacatagtaactgggcgaccacaagtgacggccctcctttttccaatagcttcgctgtaattccggacattcccgaaatagctgataggcagtaccgcctttcagccaacgaacaatattcgtcaccgataatttgggtggtgcactcactaacaagtgcacatggtcgtccttcccaatttccatgtgggcaatttcaaagccatatttagcggcgatctcatggataatccgtttgaaggcgatctcgacccgaccggtaaggactttgtttcggtatttggttccccaaataatgtggtaattaaggttgtagaccgatgttcggccatatgtaagtctgtttgtatctttcataccaacgattataccataattcacgtttcccatatacgcccgtcgggcgtaaaaaaggggggcaattcatcacgtccttaaaagaacgtgtttccttgccccttttcaaaaaatttaagagttacgtagagagtgagaaaattatttttccactccctttttatttaagatagtaatttgcattaaataccattttttgttaaggtagtattacttacttttttattcacaaggaggaatcaattagttaggccaaattttgatcacatacgcctaattttttatggaatatacaaagaagaattacaaaaaagcacctttatcatcaattcattttcgaatatattttgccttggctcttggacaaattgcttgtggttttgctcttggaattagtggaactgccctttcccaagcaaccgattatatcaatattaccgacttttgggttggcctaattggtgctgggagtttaattggactcgctgggagtgctttaatgggtaaaatcgctgaccaatttggccggcgaagaatgttgatgctcgatatgtatcttttttctatattttctcttttacaattagtaacaatgaatcttattatcctgtttatcttacggattttaattggtttaatgattgccattgactatactgttgggaatgctctattggtagaatggttaccagcaaaagaaagcggacgcctacaaagccaactaatcatttattggacaattggctttattacttcatatattgctggaattttagtaacagggtttggtgttcataattggcaagttatccttgcatcaagtgtcgttccgggactgatggctgcaatctatcggtcaatcttccgaattcctgcatctccgagctggttagcaagtcaaggtaagaataaaactgctcaaaaactaattcaaaaacaccttggaaaaaaatggggattatcattaaaacaaattcgtagtaaaaagccaaaagctgtctctcttaaaaccctctttaatcccccttatcgccgaaaaaccattgttggtggtttattctatgcttgtcaggcattttcatttttcggtatcagtatcttcttaccaattctcctaaaaagtatgaatcttggtaataacaacctctctgggattatctataatagttgcgtccttatcggtgtaattttcggtagtttaatcttcaagattcttagtaggcggatgtttttggtaagaacatttttcctttcagcagcagccctcattttattaataattggcaataacttttcacctttcttccaaattagcgtttttgcgatctttgcgatagtcttatcctcaggacttgtccttgattatccatatccaacagaactatttgatgttaaggttcgagctagtggggttggtacttgtatcactatcagtcgttttggagctgctagcggaacattcttattaccaatcttaactcatctcggcggtccaattttagcaatgctaatttgtactcttgttttacttataggtggtactatctgtcttttatgggcacctgaaacttcaccaaaatatatttaacattaataatagaatggtcgggaaaattttaaatttttcactgaccatttttagttttaaacatcaatccaatagactaatcaatttttaacaattgaactactcccacttagctaaacctacggtttaatgcttgaagtgggagattctggaaacatcgcatacttaccctaccgattctgaacgaaccttcaagcagaggttacgactattagccaaggctcgtcccgagcctaactttatctatcggatagctaatcctttttgcaagatgacttgtgcagcgttaatatcacgatctaaatgtttaccgcagtttggacaatcccactcacgtaccgctaaccattccgatttattcaatcctaaccgatgattattcttcccacaattagcacaaatttggctagtatatgacggattgacctgaataagctttttaccgtaccagtcacacttatattgcaacatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgccgatacttcgccaccataatacgagctttctgataattcttaaaatcatctaattgccgtggaactaacactttattatgatgatcccaggcgatttcctgctgagcctttaagaaccgacgactacgtaatttctcccaacgatacaactttttatggtatttgtcttcaaaatgattgatcggttccttgcatccatctgaaagattaagtaatgacttaagtcctaaatcgccaccaatatatttacttgttttaggaagagtttggttttcactttccactaaaacagtaatgtaatattgaccagcaacgttcagacgaacagtgacattcttaattttacccattggcaatcgaccagctctaaaatagacgataccgagttttggtaactttatatgatggcaatctaaaactttaatattgccattaacgtactttgaattgtagctctgagaatattttctggatttaaatcgagggaacttattttgacctttaaaaaagcgttgaaaagcatcggctaaattgcgattagcactttgcaaagcagttgattctgcttgtttcaaccaaggatactcaaccttaagttgtttcaacagattattcatcccaaaggcattcacaaatttagcttccggattattcttgcgccgttcaatttgcatattaagcatttgattccatacaaaacgaacacaaccgaaggtttgccagagctgattttgttgtgctgaatttggatagatgcgcattttaacggcttttagaaccattattttctcccttgactttcaatatatcgttttacaacttctaaaggcgctccaccagtgctaattaagcaatagctttgtgtccaaaaggctgatttccaaagatattgcttgatttctggaaattgttttttgaccattctggagctagacgatttgtaagcatttaaaaatttagccatttccgtatgaggcgttgctctaaacaaaacatgtacgtggtcctgatcataattccattcttgcaaattaatgccgtacgcttgtcccacaactacaaaacgatgtttaagatattcagatatttcatcgttaattacttttcgacgatacttaaccaccattaccaaatggtaattaagcaagtatactgaatgctgatttctatctaattctattgttatcaccacattttatagatatatactaaatatatcatagaataaaagaaaaagcactaacgtactttaagagagcgattcatcccctacttatagaagtgggggatgaatcgcaaatttatggataaaataatttgattacaaagcgaaccaaatacggatagtttttgattaatactgctatatttatcgggaacttgttttcgtgcccactcctaataagatggcacaaaagactgttatagcggttccaagcaaatataggcggtatacgttaagaataagccaagagtaagacagataagggtagtcttatagcgagtagttaatggaatcttttgcaatttaggactcaatgcgcctactaacattcccgaaagcatcaattcgataaaaacaatgaaaatccaataagctttattctgttgaaaagcaaatagtaaagtatagataatgacataattcttgatcgctccgagccaaatacgaaatagtttaaaaggttgttccagaatatttcgtagttcaaggataatcccaataattgctagcacgattagggcctagccaaaatcagaaatttgacccgtcttcttaaagaaactaataataaaaaccacggtaagcacagcgatggcaggaaaagccgtttttaaattaaaagagaattttaaatccaatggtgtcttatctcgtttaacaacaacgtaagcgtaaataacttccaagcccaggaaaaaagtataaaaaacaaaaccgacaactaacggcagcttcatcagtaaaatcccgagggcgatcagtccgataattacactaaagcccgcgataacatttactcgcttcaaatcaatcccggaaatttccttattgggatcgccgagcaattttaatcctgtcacgccaaaaccgatcaagatcgccgccaatctagcaagccactcaaagcgaaaataaattccaatagaagcaaggactcccccaataaaagcaataactgaacaaaacttagtaacacctgaccaagaagctaaatttaggcgcccatcgagaataaaaggcattactttttcaacggtgtaaacaaaaatgaacggccaaacaaatgtgattatatttgcatgggcaatgatagagaatgcaaatagtaacgttggaaatagaatatagcttcgagctacaaattcatggttaattgctaaaatcttcttcataagcagcctccgatcactttaccttttatttttagtaaaccacatccccttataaaagaaaaataataggactcctaacatgatttttaatgctagaagtcctagtagctttttatttagcaaacatcttaaattctaaaaataaatcattgtattcacctaaaacgcgtaatggcaaatcacgatatacttgcaaatgcttcatcgttgtttcaggaggatagaaagctttatcatcggtaattttcttgggtaattcttttttagccgctttatttggtgttgcgtatccaacgtattgagcattttgagccgcattttggggatctaacataaagttaataaattcgtaagccgcctttttattacgtgctgctttaggaatcaccatgttatcaaaccatatattgcttccttcgcttggcacaacatagtgaaggtgcggattaatattcatcatttcgcgcgcgtcaccagaataggtcacacccacggctgcttcattttgctccatgtacatcttcatctcatcagcaataatcgcttttacattgggcgtcaactgctttaaatgggcctgcgcaagcttcaattgatggtagttagtcgtattaacagaatgatgctgggtaataagggcaaccgcaaacacatcccgcgcactatcaatcagcatgacattattctttaagcgcggattccaaagttgttcccaatgctggacgtctttgccatttactttttgatcattatagataatacctaacgttccccaaaagtatggtacagaataacgattgtcggggtcaaaagaacgatttaaaaattgcggatcaatatacttaaggttaggtaatttctgatggttaagaggtgcaattaaatgctcctttttcatccgttgaacagtgtattcactcggcacaacaacatcataattagtcccgccttgccgaatcttggttaacattgattcgttgctatcaaaggtttcataatctacatgatagccagtttgatgttcaaatttcgttatcaatgctggatcaatataatctccccaattgtaaattgtcagagtttgttttccaccaccagttttttgctggttgaaagcaacatccccaagcgctagcaaaatacaaataacgataattgcaaggaatgcagtaaatatctttttcattgtgcatccccctctttaacagccacaatccgtgtccgtcgaccgccccgtttactaataaggtaatagccaattactaacagaagcgaaacaataaacatcaacgtagagagggcattgatttcaaggttaattccttgccgcgcccgcgaatatatttccaccgataatgtcgagaagccatttccagtaacaaagaaggtcacagcaaagtcatcaagtgaatacgtaaaagccataaaatagcccgcaaaaatacccggggcaattgacggcagtactacccgagaaagaacttgccagcgactggcccctaaatcataggcagcatctactaatgttggggacatttcatttaattttggcaacaccattaaaacaacaattggaatacaaaaggcaatatggcttaagaggactgagacaaagcctagtcttacccccagcatggtgaaaaagattaaaaagcttgccccaataattacatcgggcgagaccattaaaacattattcaaagataacaaactattcttccacgggcgccgtgcatccttaattgccaaggctcctaatgttccgataatcgttgctaatagtgacgccaaaaatgctactaacaaggtattaataacaatggtaatcattcgcgtatccgcaagcaaatccgcatagtgttgccaagaaaagccatggtatttttccattgtttgtccgctgctaaaggaaaaaacaactagatacaaaattggcgcatataagatcacaaaaactaatgccaggtacgcttttccccatgaccatcgctgctttttcattaatggcgtcctcctttctgtttcttatcaccagtcataaacataataataaacattgcgataatcagcacgaccccaatcgttgaacccattccccaattttgcgttgtgaggaaatgttcttcaatcgcagtccctaaagtaattacacgatttccaccaatcaaacgggtaatcataaagagggagagcgatgggatgaagaccgcttgaattccagcttttacgcccggcatagaaaggggccaaatcactcgacgaaaggtttgccaatgagtagcacccaagtcatagctagcatttattagtgacgggtttatttcagccaggttattgaaaatcggcaacaccataaacgggatttcaatataagcagccacaaacataaaactggcatccgtgaacaaaagctgatgactcccaaggcccataaactggaggaaaccgttaattgtccctgttcgactaaacaagccaataaacgcataagtcttcaataataagttgatccatgttggcaaaatcaccagcaatagccaaaactgcttattaggcaatctattcaaaacataagctgtcggataactaatcaccaatgtcacaagggtaatcaaaaaggcataccagacagagttaagcgtcatcttaagataaacacccgatgtcaggtattcagcatagttattaagggtcagctgaccattgatattaaaaaatgattgataaaagatcaataccaatggcgcaatcacaaataggataatccacaatgcatatgggacgataaacatcgctttttgccgcattagtctccctcctcgtagctatcaaggcgagcatcaaaatcttcttcgctttcgttataccgcataacgtgaatatcttcgggatcaaatgtaatccctactttagcccctacctttgttttatgaatagaattaatcttccacttatggttacgttggtcaatcaccgtaatttgataatcaacgccacggaaaagctgcgtttcaacagtgccgactaattttcctttctcaaccgtcgtaatgtcaagatcttctggtcggatgacaacttcaaccttttcgtttggtttcatccccgcgtcgacacaatcaaagtcttgaccattgattgaaactacatagtcttttttcataatgcctgggacaatattgctttcaccgataaaatcagctacaaaatggttaagcggttcatcataaatatccacgggcgtcccactctgctgaatcttaccatcattaataatcataatctggtcactcatggctaatgcctcttcttggtcatgggtaacaaagataaatgtaatccctagccgccgttgcaattgccgcaattcagtctgcatttgaactcgtaacttatggtccaacgcagacaaggcttcatccaacaatagtactttcggcttattaactattgcccgggcaatggcaactcgctgtctttgcccaccagacatcgcggtaatttcccgatcatcatagccatctaattgaaccaggtgcaaagcttcttttacgcgttgtttaatttctgattttttgacacccttaatttgtaatccaaaggcaacgttttctgccacattcatatgagggaaaagggcgtaatcttgaaagacggtattgacttgccgttgattggctggaatatcattgatttgctttccatcaaaataaatttttccactactaggatgatcaaaaccagcaattaagcgcaaaatcgttgtctttcctgatcccgatggtcctaataaggtatagaatttaccggcctcaatttcaaagcttatatcacgcaacacaacgttatcatcatactgtttgcttacatgctgaaattccattatgttttttaccatcagcgtttccccaatcatcattttttaaactaagtcttagtataaagtatacgccttaaatcgcaacactgtttatcctaagcaaattattttgaactactcccacttagctaaacctacggtttaatgcttgaagtgggagattctggaaacatcgcatacttaccctactgattctgaacgaaccttcaagcagaggttacgactattagccaaggctcgtcccgagcctaactttatctatcggatagctaatcctttttgcaagatgacttgtgcagcgttaatatcacgatctaaatgtttaccacagtttggacaatcccactcacgtaccgctaaccattccgatttattcaatcctaaccgatgattattcttcccacaattagcacaaatttggctagtatatgacggattgacctgaataagttttttaccgtaccagtcacacttatattgcaacatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgccgatacttcgccaccataatacgagctttctgataattcttaaaatcgtctaattgccgtggaactaacactttattatgatgatcccaggcgatttcctgctgggcctttaagaaccgacgactacgcaatttctcccaacgatacaactttttacggtatttgtcttcaaaatgattgatcggttccttgcatccatctgaaagattaagtaatgacttaagtcctaaatcgccaccaatatatttacttgttttaggaagagtttggttttcgctttccactaaaacagtaatgtaatattgaccagcaacgttcagacgaacagtgacattcttaattttacccattggcaatcgaccagctctaaaatagacgataccgagctttggtaactttatatgatggcaatctaaaactttaatattgccattaacgtactttgaattgtagctctgagaatattttctggatttaaatcgagggaacttattttgacctttaaaaaagcgttgaaaagcatcggctaaattgcgattagcactttgcaaagcagttgattctgcttgcttcaaccaaggatactcaaccttaagttgtttcaacagattattcatcccaaaggcattcacaaatttagcttccggattattcttgcgccgttcaatttgcatattaagcatttgattccatacaaaacgaacacaaccgaaggtttgccagagatgatttcgttgtgctgaatttggatagatgcgcattttaacggcttttagaaccattattttctcccttgactttcaatatatcgttttacaacttctaaaggcgctccaccagtgctaattaagcaatagctttgtgtccaaaaggctgatttccaaagatattgcttgatttctgggaattgttttttgaccattctggagctagacgatttgtaagcatttaaaaatttagccatttccgtatgaggcgttgctctaaacaaaacatgtacgtggtcctgatcatgattccattcttgcaaattaatgccgtatgcttgtcccacaactacaaaacgatgtttaagatattcagatatttcatcgttaattacttttcgacgatacttaaccaccattaccaaatggtaattaagtaagtatactgaatgctgattcctatctaattctattgttatcaccacattttatagatatatactaaatatatcatagaacaaaagaaaaagcactaacgtactttaaaagagcgattcatcccctacttatagaagtgggggtattctcgcaaatttatggataaaagtgcgataattaatatatcaaattttatacgaggtgttccagatgaaaatcaatcaatttagtattacttcgactacaccacaggcacggcgccaagaattaatgcagattcacttgcttcggaaaaacgaagaacaaaatttaacaccgaacgcaatgtttgaaatcttcttagcacgaattcatatggcaagtgcccagccgatcatcactaaacagtggcttcatgacctattagctactcctgaccttgctcttgatgattggtttgaccagaatcaaatattaaccgatgaagtattttacctcgtcgctctccaactactcgattttgaggccgcagttgattttgatattacagatccccttgctacagttaagaaaattggcttgccagtcgaatcacatcaaaaatggacaaccgcaaacgttaccgatgctttttaccttcttttaaatactcataacaaaaatggtcaatcgcttattgatcatttaacggcagagggctttatggcttggagttaccagcttccagctgaacaaaaaccactctttttcaatggaaagccacttgctagttttgaccctgctaaattcattcgtgaggttgtttacattgagaccgatatggatactgattttgatggtaaagcagatttagttaaagcggaaattatgcggccaatcgaatcggaccatggactaaaagttcccgttgtctttactgctagtccttataatcaaggaacaaacgatgaatggggcgaaaaagcaacgcataacgtcaatcttcctttgaaacataaggatcctgattatcaggccccgactgaagaaaaatttccgactgacttttcacgccaaaaagttactggcgaaagccggcaagctactgagacatttagtaccacgccagcctacacactaaataattacctcgccgcccgtggttatgcggttgtttattcagccggaattggtaccaaagattcggatggtctgcaaacgtgtggttcttcagaacagactgatgcgatgaaggctgtcatcgagtggcttcatggtgatcggcaagcctttactgaccgtcatagcggtaccacaatcaaggcgacctggtgtaatggtaaagtcgcaatgacaggacgctcatatctcggcactctagccaccgctgtcgcaaccactggtgtacctggcctcgaagcaattattagtgaagcggccatttccagttggtatgactattaccgggaaaacggccttgtccgggcacccggtggctttcaaggggaggacgcagatgttttagctgacgaaacattcagtcgaaccaaacgtccagcagactaccgccgaattgaaaaagtaaatgataaatatattgctaaaatgcaaggagcaatggatcggacgtctggtaattataacgagttctgggaccaccgcaattatcggcatgatctcgaaaacatcaaagctgccgtgatgatggtgcatggccttaatgataccaatgtccgtcctagtaacgttaaagcactttatgacggcactcaaagtttgccgattacaagcaaactcatccttcaccaaggacaacatatttatatcaatgcctttcgttcattagatttctctgacatggttaatctctggcttgctaataagctctgggggcaagaaaatcatgctgatgataccctgccaagtgttcttgtgcaagacaatagcacccccgaaacttggaccgcatatgatcaatggactgcaggcgaacaaaaacagtaccaatttaacgaccatcgcctaacgaatttgcccggactaggaatccaaagctttaatgaccaacaaccagaagaaaagtaccttcaatggtgtaaacaaccccaagcatgggcaaaggcactcgtgaatgataacggtcaatttagtcggcgcttcgtaactgctgtatttaataatgatacgcttctccgtggaactccgactgtcacattaaaagtagcttcttcgaaaaattatggaatgattagtgcccggcttgttgacctgggcagcagcaaacgccttacaatgtcgcctgttttgtttaatcgtaatggtcttgagctaggttatcactggaagacagatgaccttcgtgaatttaaattagcaaaagaaataactaattataaggtaatcgcaagtggacatattaatttgcaaaatcgaaacaatccagcacagattgacgaattagccgctaatcaatttgtcaccgttaagtttgatcttcaaccaattttccaccgaattgtagctggccatcaattagggatcattatttatagcactgattacgaatacacgcttcgtggcaacgaacggattgaatatcaattagagctgaatggctgtcatcttgacattcctggcttcagcgttttagcttaaaaagacagcgcgttaaaactagttttagcagaattcagctaattgcggtagaatagttagtattaccaataaaaaggagagattcgagaatgaaacaaggcactaaaattattacccttgataacggctatcatctgtggacgaatacccaaggtgaaggtgatattcatttattagctttgcatggggggcctggtggcaatcatgaatactgggaagacgctgctgaacaattaaagaaacaaggtcttaacgttcaagtaacaatgtatgatcaattaggttcactatattctgatcaaccagatttttctgaccctgagattgcgaagaagtaccttacttacgaatatttccttgatgaagtagatgaagtacgaaaaaagcttggcttagacaatttctatcttattggtcaaagttggggtggccttttagttcaagaatacgctgttaagtatggccaacatcttaagggcgcaattatttcttcaatggttgacgaaattgatgaatatgtcgaccgggttaatgaattacgggaaaagactctttctccagaagcagttgcctttatgaaagaatgcgaagccaagaacgattacagtaatcctaagtatcaagaatacgttcaagtaatgaatgaacaatacgttgaccggaagcagccatccaagctttatcatcttaaagaccttggcggcacagcggtttacaacgtcttccaaggtgataacgaatttgtgattaccggtaagcttaaagactggcatttccgtgaccaattgaagaatattaaggtgccaactttaattacatttggtgaacacgaaacgatgccaatcgaaactgctaagacaatgaatagtctcattccaaattcacagttagttactactcccgatggtggtcaccaccacatggtagataaccccgatgtttattacaagcacctcgctgacttcattcggaatgttgaaaataatacgtttaataattaataaaaagaccgaggaaacgtttctcggtctttttattaattattcatgaatcatattttaaaaatatcttaactagaactaaaatattaaatgaatatggtacgatatttatacgataaatacgaaggaatgattaaagcaaaaacttaatacggcttcactgatgttgttcgcttaaggtgtgggacctttaagcattagttactttactcaatttatatatttaaggggaaaaatgaaagaaaattatcaactaacaactgacgaaataaagaaagaataccaattaactgattttactcacggcctatcaacccaagctgtcgaaaaacggcttgccgatgaaggacgtaatatcattgaagtaaaaccaacacccaagtggaaactattcttacgccagtttaacaatattgttatctacattttattagccgctactttactgaccgttttaattggtcactatactgatgcgattgttatcggggcggttgtcattctaaacgcgctcattggttatttccaagaatcaagcgcagcgaatgccctcgccaaaattaaagagatgatggcgcaacatgccaccgtctaccgggatggtaaacgacaagatattgatgccgcggatcttgtccgtggggatgttgttttcctcgaagccggtgataatgtaccagctgatttacggattgtctcagctgataacttacgaattgaagaatcggctttaaccggtgaaactaattcggttatcaaaactgatgaagcaattaccgaccaagacgttcctctcgctgatcgtgttgatatggcatatgcttcgacttcagttacaagcggaagtggcctaggagttgtagtcgcaactggtgaacaaaccgaaattggtaagatttcacaagaagttgcgcaaatcaaatcaaagaagaccccattaactaaagaaattgaccatgttggaaaggtcgtttcttacattacaattactgcttcagtgattgttttcgttgtcggtttcttcctcgaaatttactccttgcctgcccttgcgcttgcagtcgtggcaatgttggttggtgcgatcccagaaggtttgcctgcaattacctctgttatcttagcctttggtattagcaaaatggccaaagagcatcagacaattatcaaatcaatgcctgctgttgaaacattaggctcggtcgatgttattgctactgataaaacaggaactcttaccaaaaacgaaatgaccgccattgagttatgggtcggcgataaacactacacggttaccggaactggttatgctcctaatggtgagattctcttaaatggcaaaccagctcaactgacagatcagctcaaacttttcttagaggctggataccaagcaaatgatacggctttaactgatgaagacggcacctggcatattaatggtgaaccaactgatggagccttcttaactctttatcacaaagcgtttggggctaaatatcaatcgccatataaagctgttgacctccttccatttgattctgattaccgttacatcgctgaattaactcgtgatccagaagataaacaacaagtaatctttgttaaaggatctccagacaagctctttgaaatggccgcaaaggaagatccacaatttgatactgccaagtggcaacaacgggtagatgactggtccaaagccggaaaacgagttattgcggttggctatcaacctgttaatggcaaaaatctaatagaagtcgaacatgaccacctctacaggggaattcacttacttggcttagctgctcttcaagacgcaccacgcgaagaagtgattgttgcgttaaagcaaatgaaccgtgctggtgtttccattaaaatgattacgggggatgacccgcaaaccgcccgtgcaatcggtaagcaactaggcttatcgacgggcccgatcaacgcaatcacaggtgcagaatgggataaactttctgccagtgaacgagaagaggccgctttagataaccaagtctttgcgcggacgactccacaaaacaagcttgaaattattgaagcgctccaaaatcggcaaaagatcaccgcgatggttggggatggagttaacgatgcacccgccttaaagaaagccgatattgggatttcaatggggatcaagggaacggacgtcgctaaagatgctgctgacatgatcttaggaaatgataactttgcggtaatggctgctgttatcaaagaaggtcggcgaatttacgacaatatcaaaaagagtatcttattcttattaccaacctcctttgctgaaggattggtggttgccttctccattcttactggtcagcaagttcccctccaaccagctcagctattgtggattaacttaatcgccgcaatcactatccagtttgcgttcgtctttgaaaaagcagaaaagggcatcatggatcgcaatccgcgccctgtgacccaacgattaatgaatcgacatgatttaatccagatgggttatgtctcagccttaatggcgctgttcgccttaattggttacgaatggttcatcagtgctggggcagacgttgtcaacgctacaacaatgatggttaataccattgttattagtaaggccttctacttcttcagcattcgaactgaacgatatggactaaaagaagttggaaatattggcaagaaagcctggggcgttattggattgatgattcttttccaattgatcttcacctacgttccatttatgcaggctgccttccacgtgaccggaataagtttactggaatggctagcagtaattgtcttctcttgcttaatcttcttatgtactgaatctgataaaatgattcgtttccgtctaaatcgacggtaaaattaacgccactgaatgagatttttcatcttcttcagtggcattttttaattcataagctttcgtaatgttttgaccaaatctatgtaagcgtattccaaaatctgatataatatacctaacacatagaaaaggagtcttatcatgaaatatcaagaaaccaaagaaacacttaatcaattagttgctgatctgagtcaaatggcaatgataattcatcaaactcactggtatatgcgtggcactaactttctaaagcttcacccattaatggaccaatttatggatgaaatcaacgatcaacttgatgtaatatctgaacgattattaactctcgacggtgaaccttattcgacccttaaagaagtcgcaacccatacgaaaattaaagactggccaggaaactttgataaaacaacgccagaacggcttgcgcatttagtcgctggttatcgttatcttgaggacctttatcagcatggaattgaagtgactgacattgaaaaagattattctacccaagatatcttcattggatttaagacggcaattgaaaagaaaatctggatgctgcaagcagaattagatcaggcaccagaaattgacaactaataatgaaatcggcaccaaactaatcgagattcgaacgtttggtgccgatttattgtctaaaaattattttttctgattatctaggagtccttctttttcatcttttaatcgcaagtcatcaagccattctacatgcttttcttcataactacgatctttcttgataaagaagtatgctaccgcggcaagaatggcgatgacagttccgacaagcaaggtcttagccgtaaaattagtaaccatgtaacaagaaactaacaatgcaaaaatggggataagatatttcctgggtaatttgaaaccatgtgttggatattcgttactatgttcaaatttaatgacggcaagaattgagggaacatattgaatgaatgaagctaagactgtacaactaaccaagaagagataactctgggtagcgaataaagcagaaaggatggatgttaataaaattccgactcatggggcatcattcttattcttcttcccaataaactttggcaacatgccgtgctcattggccattgaagtaattaacgatggcgtgttaaacgaagatgaaaaggcaaccccaaagatacttacaagcatcccgaaaataataaaggcatatccccacttaccaatagtggttccgagtcctttcgcaagggcacctcccaaagcattagccagtggtgtcgagtagccgcctaatttagtcccggaaagtccaacggcaacggtcatcatcaatgcatccaaaatagttacactaaccatgactgcaattaacacccgaggaatattcttttctggattcttcatttgcttagcagcaattggtaaaaatgaaaaaccagtaaaaagataaaagatcggggtaaaggcttcaccaaaatgatgaataaatgacattggtccctttaaagctgcttggggaatcactggtgagaagttagctttatggatgaagaagaccccaacgacaataaagatgatcagcgtaaggatcttcgcagccgctgatacattattaaccagtttaacaaggccgtggccgaagaaattaataactgcaaagagcacaattaagccaaaagcagcggctccatagataagcggccgattaaagattggcaaaaagttcttgagggtagttaataaggcaacaatttccgctgaatgggtacagcagcctaagaaccaggtaaaaatccctaactcataaccggtaaatcggccaaatgcatgataagaataaagccatgctgcacctgagccggtaaaacgactagaaagatcggcataacatagggcgatcaatgaaacggttattgctgtacatagcaaaactgctacagccgataagttcatgtaccgataaataacagatggcagtaaaaatgttcctgaaccaattactccattaattcctaaaaagtaaatcgaaatgaatgatagctttttaggtactgatttttgattactgataatgaccaccccacataaaatttataattccatttatattgtagtcttttcaaataaaaaggtaatttatcagctattctaatctcaatcttttctgaaattgttatacaattaagaacgtacttatattttataaaggatgaataaaatggcacagaagattgagaattttatttttgatattgacggcactttaattgatactattgatatgtatatgccagcaatgattgatgttttagctcaacatggtcacccagttgcacccgacaaagtagagcaaactaagcatgacttatttggtattacgggacaagatgccctccgtcttgctggaattagtgaggatgaaattccggcgatccaacaagactggtttaagctggcttatcaacgtgctgatcaagtaaaagtgattgaaggaattccggaaatgcttaatacccttgccaatcgtgaagatgcaaggatcgccatcgcaacttcaaaactcgctgacgaataccaagaatacttcgttaacaaatatgactttgcaaagttatttaaggttgccattacgtctgctgatactaaaaagcataagccagctccagatcctattttagcggcaatggataaaatgggagcagatcccgccactactgtttatgttggagacacgatcaatgatatgaaagccgcccatgcagctggtgccaagtttgcaggcgccctttactcttctgcaaatcccgatagtattaaagatgcggacttcccattaatgaagcccgctgatctcttagaaatttaaaacaaataaggagtctctggtgtttagaattcaaacgttagagacttcttttaattgttattcatgtccaccttaagaattttattaataatactactttggagtctttacatgctctgcaacatattcttgagccgttttttctggcatttggtaaacattaacgagagcgaccactatttctgacggtgcagtcttttgactggctaaaaacttaactaatttttgtttcgactcttctctttcttctcgccgtgcgtccattaaatcaagctcgaacttcataaagcctcgtctcctctctggctcctgcttaatcttaataatctcgtcttgaatcttaataataaacttactcttattgtctactcgactacgcattaaagcaaggaagttcttaatcggctgctcatctttagtaaattctttagccaaggcattaaagatcacaactgtccgttggtcgcctaatttcaactgatgattacaagtacacgccatttcaaacacataacgggcccaaccatagccaaaataatcaaaatcacaaaacatgagcacataggtcggatgaagacttaaatcgcgataatccttgcccggcaagagtaatccatgatctatttgctcttgacaataccgcaagcgataaggcaaattctgtcggtcagctacctgcatctcaataacaataatgttgccatcttcatcctacacataaacatcataacggacgcgccggccagctacgacattaatatccttttgagttgttaactggacgatttgagttgcctttaaatggggtaatgcacgattaatcaattctaaacaaatttctttattctgcataaccatcccgaacattggatcactcgtaatagtcatcttttcccacttttcgagggccttttcatagttctctggcaatttcttacacatttcctcaatcctttcacttctacctcactataaagatatatacgtaaaaaattgccttttgcactaaaaatccctaagtcagtattgctaccaacttagggacttcaactatccaactgaaatatacattaattgccggccttcgtaatctacggattatcctcgccagctatctcttcattcagcagaatagccagtcagcaaatcattctgttacacaagaaataattattcattaagaaaagacttaagattaagctctcataacttaatcttaagtctttttaatagtcgtcaattatagttatcaatcaaaattaacgtctgaattttgatgaattttacttgtttattgcctttgaccacacaagagtccctttctcgttggtaaatcttatcatgtctaccaggattcatagaaatcgtcttggcaccatctcttataattaccctttggggaccatttactattgcatccctttttctaacttgaactactcccacttagctaaacctacggtttaattgcttgaagtgggagattctggaaacatcgcatacttaccctaccgattctgaacgaaccttcaagcagaggttacgactattagccaaggctcgtcccgagcctaactttatctatcggatagctaatcctttttgcaagatgacttgtgcagcgttaatatcacgatctaaatgtttaccacagtttggacaatcccactcacgtaccgctaaccattccgatttattcaatcctaaccgatgattattcttcccacaattagcacaaatttggctagtatatgacggattgacctgaataagctttttaccgtaccagtcacacttatattgcaacatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgtcgatacttcgccaccataatacgagctttctgataattcttaaaatcatctaattgccgtggaactaacactttattatgatgatcccaggcgatttcctgctgagcctttaagaaccgacgactacgcaatttctcccaacgatacaactttttatggtatttgtcttcaaaatgattgatcggttccttgcatccatctgaaagattaagtaatgacttaagtcctaaatcgccaccaatatatttacttgttttaggaagagtttggttttcgctttccactaaaacagtaatgtaatattgaccagcaacgttcagacgaacagtgacattcttaattttacccattggcaatcgaccagctctaaaatagacgataccgagttttggtaactttatatgatggcaatctaaaactttaatattgccattaacgtactttgaattgtagctctgagaatattttctggatttaaatcgagggaacttattttgacctttaaaaaagcgttgaaaagcatcggctaaattgcgattagcactttgcaaagcagttgattctgcttgtttcaaccaaggatactcaaccttaagttgtttcaacagattattcatcccaaaggcattcacaaatttagcttccggattattcttgcgccgttcaatttgcatattaagcatttgattccatacaaaacgaacacaaccgaaggtttgccagagctgatttcgttgtgctgaatttggatagatgcgcattttaacggcttttagaaccattattttctcccttgactttcaatatatcgttttacaacttctaaaggcgctccaccagtgctaattaagcaatagctttgtgtccaaaaggctgatttccaaagatattgcttgatttctggaaattgttttttgaccattctggagctagacgatttgtaagcatttaaaaatttagccatttccgtatgaggcgttgttctaaacaaaacatgtacgtggtcctgatcatgattccattcttgcaaattaatgccgtatgcttgtcccacaactacaaaacgatgtttaagatattcagatatttcatcgttaattacttttcgacgatacttaaccaccattaccaaatggtaattaagtaagtatactgaatgctgatttctatctaattctattgttatcaccacattttatagatatatactaaatatatcatagaacaaaagaaaaagcactaacgcgctttaagagagcgattcatcccctacttatagaagtaggggtattctcgcaaatttatggataaagcgagtaatgtttgttttgacgatataattttttggctttctttaagcttactactttaagtggtcgggctccctacgcgtctcttccgatatatgcaatactgaaatgttggcgcaataaagtgtttgtagcgttaaaaatataataataattatagagcacttttttatctttatcgaagtatctaaattctagtgcttcagtcttatttggagtcaatgaattactggcgtttttggttcctaaataagtaaataaagcaattgaaaggccaaaagcgatgagggcgatatacccccaccgcttattatttttttctgggtgtaattttgcgtgaaactagccgatgattaccttgacttagcttcgtatgacatactgaacattctcgtgaccctaatgcattaacttttccacaattaggacagactaaggcaagcatctgtcctttaagggatttcccacaattctcacagacttcggcatcgtctggatttaatgtattacagtagggacattttttcatttagtaatccccattgaagagctgtgcattgccattcgcttatcgggatagagtttcttagctagggcggttaccgctgtcggtgcttcaccaaagccggccgcaatcaatgcgactttccccgggtaggtcacaccatccccgatcgcatataccccttcaacactggtctccatcattgaatcgactttgatcaagttgcgctctgctgctaagtcaagggaccactgatttaaggccgcattgttagaagtaaagccatagttaaccacaatcttatccacattcaattgtgcttcgtcgtcactacgcatcttcttaagatcaagcgttaccgtttcatcgtcttccaccgttaatgcgcgtggtaagaaaggcgtatctagttgtacagatgactgtttaagctgagttacagtatgctccagaccgcggaactggtcccgccgatggacaaggtggacttccttagcaacgggttcaagcatcaaggcaatatcaatcgcggagtcgcccccaccaagaatggcaacccgcttgtccgcataatcagctttatgattaacaaaatatgaaagctgcttgccttcaatctcagctgctccctctaaagcaagcttacgcggagtaaacgccccgttaccaagagcaatgattactgctcgtgaccgggatacccgctttgctgatttgatggtaaaggttccatcgtcttttttaatgacgtcctcaacagtttcaccgaggaattggtcgatcggtgccactgccatttgctcttctagcttagcaattaggtcatgtccagttacacctggcattcccgctacatcccaaacttgtttttcaggatagagtgcccctacttgtccgccaagttgtggaaggctttcaattagctgggcatctaattcatgaaggccgcaataaaatgaagcaaacatccccgctggacctccaccaataattgtcacatcgtaaattttctctgccatttctcctctgatcctttcattttcatctctagaagtattatatcatctttatttttctaaaatttagtaagcggtctcaaattttaattgtaattattcaaaatttaaattaacatattatatacagagattgattttgcttaaaattggaggaataaatactatggcaaaacgtaaaatgattcttgatttagatactggtgttgatgacgctttagctattgcctatgcgctcgctgacccagaagttgatctaatcggaattgtaagttcatatggtaacaacctattagatgtttgtgccgaaaacagccttaagttattggaattattaggtcacactgatattccagtatttaagggtcttccacattcatgcactactgaacactttgatgtaatgcaagtttcaaaggatatccacggtgataacggtatcggtgatgttgaattacctgcgccaagtcgggctcttgaagaacaatccggtgttgatttctacatcgaagccgctcacaagtatggcaaggacttaatcatcatccctactggtccaatgactaacttagctgctgctttgaagaaggatcctgaaattgctgacttgattggtaatgtcacattcatgggtggtgccttaactgttgaaggtaatgttactcctgtcgcagaagctaacattaaccaagacccaaaggctgccgatgaagtaatgaagtccaatttgccacttacgatggttggtcttgatgttactcttcgtactcttcttactaagaacgaaacaaagcaatggcgtgaattaggcactgcttccggtaaggcttttgctgatattaccgacttctacatcgacgcttactacaaccttgatattgataagcgtggttgtgccctccacgatccattagctgttggtgttggtattgacccatcatttgtttcaactattagcttattcatgaaggttgtttaccaagaaggaccttactatggtcggacaatcggtgacaacgctaagttaaacgatcctaaccctaatgttaaggttgccgttaacgttgacaaagaacgttacctcaaggccttcatggaccacctaaacaagcttttcaaagaaaattaaagtaagtgggaattaacctcctcgacaaggcggtgggctaaggatagaacggtgattagcacggcacaggctgattatcgttcggacttagacttgagtcttgtggttaatttccacgatatcttaacaaatattcgcattaagaggctgttgaaaataattctccagtctcttttcattttacaaggcgttattctcctgtttttcttcgatagttgttatattgaactactcccacttagctaaacctacggtttaatgcttgaagtgggagattctggaaacatcgcatacttaccctaccgattctgaacgaaccttcaagcagaggttacgactattagccaaggctcgtcccgagcctaactttatctatcggatagctaatcctttttgcaagatgacttgtgcagcgttaatatcacgatctaaatgtttaccacagtttggacaatcccactcacgtaccgctaaccattccgatttattcaatcctaaccgatgattattcttcccacaattagcacaaatttggctagtatatgacggattgacctgaataagctttttaccgtaccagtcacacttatattgcaacatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgtcgatacttcgccaccataatacgagctttctgataattcttaaaatcatctaattgtcgtggaactaacactttattatgatgatcccaggcgatttcctgctgagcctttaagaaccgacgactacgtaatttctcccaacgatacaactttttatggtatttgtcttcaaaatgattgatcggttccttgcatccatctgaaagattaagtaatgacttaagtcctaaatcgccaccaatatatttacttgttttaggaagagtttggttttcgctttccactaaaacaataatgtaatattgaccagcaacgttcagacgaacagtgacattcttaattttacccattggcaatcgaccagctctaaaatagacgataccgagttttggtaactttatatgatggcaatctaaaactttaatattgccattaacgtactttgaattgtagctctgagaatattttttggatttaaattgagggaatttattttgacctttaaaaaagcgttgaaaagcatcggctaaattgcgattagcactttgcaaagcagttgattctgcttgtttcaaccaaggatactcaaccttaagttgtttcaacagattattcatcccaaaggcattcacaaatttagcttccggattattcttgcgccgttcaatttgcatattaagcatttgattccatacaaaacgaacacaaccgaaggtttgccagagctgatttcgttgtgctgaatttggatagatgcgcattttaacggcttttagaaccattattttctcccttgactttcaatatatcgttttacaacttctaaaggcgctccaccagtgctaattaagcaatagctttgtgtccaaaaggctgatttccaaagatattgcttgatttctggaaattgttttttgaccattctggagctagacgatttgtaagcatttaaaaatttagccatttccgtatgaggcgttgctctaaacaaaacatgtacgtggtcctgatcataattccattcttgcaaattaatgccgtatgcttgtcccacaactacaaaacgatgtttaagatattcagatatttcatcgttaattacttttcgacgatacttaaccaccattaccaaatggtaattaagcaagtatactgaatgctgatttctatctaattctattgttatcaccacattttatagatatatactaaatatatcatagaacaaaagaaaaagcactaacgtgctttaagagagcgattcatcccctacttatagaagtggggtattctcgcaaatttatggataaaatttgtataagattgttttgattttactaaggaagtgtcttatcaatgggtcgtttagataataaagttgcaattgttactggtggttctaaaggaattggagctgctgtcgcaaaaaagtttattgaagaaggcgcaaaggttgtttaaccgctcggaagatggatgaaggacaaaaagtcgctgaccaattaggtgacaatgcgatctttatccaacaagacgttgctcggaaaggagactgggaccgagtaattcgtcaaactgtccaagtcttcgggaagctcaatattgtggttaacaacgcggtaattgccgaatacgccgatgttgaaaagacacctgctgaaatttgggataaaacaattgctgttaacctcaccggtacaatgtgggacactaagcttggtattgaagcaatgaagaacaacggggaaaagaatttgatcatcaatatgtcatccattgaaggactaattggggatcctgatctctttgcctacaatgcttctaagggtggtgtccgcctcttaactaaatccgctgcgcttgattgtgcccgaaaaggctatgacatccgtgtaaatacaattcatcctggttatatctcaactccactagttgataatttggttaaggatgatccaaaagcagaaggacacctagaaagccttcatccccttggccgtcttggaaagccagaagagattgctaacctcgctttataccttgcctcagatgaatcaagctttagtactggtttggaatttgtcgctgatggtggctatacggctcaataatattcataaagggagcgatcgtgacttcgtttttcgacgcgaagctagcctctgggagcccctgcaagcaacaataggcctccaacgttcggttttaccggacgttggaggccattggtgtactgcgccatttgtcttttatgaaaataacttggcttatgtcacaatccttttgtttcacattaaattccgaattaccaatgaaattgccaaaatcaatgatccaatcccgacaattatttgcataagacggccaggcaggtggcgaacaataatcggtcctaagtaacccccgattacatttccaatcatcaacggaataacataattccaataaattgtcgtctcaagggcgaacactatccaggatgttgtatttgtaacagtcatcgcaacattttttagcgcattattaactgcaaagctcttttgccgattgatcactgtcagcaaggttagcattaacactccggcacccgcattaaagaagccggaataaatcccaacaataaaaataccaatgattgataaaaattggccgatccgtgacttaccaaataatttactgtttcctgccatcgtccctgtactttgcttcggatgatggggaaacaacaagataattccggctaacgcaatgcataatggcaccagttccgcaaaccacttactggggacagcaaatagcaaaaaagccccaataatggaaccagcaaataccaatggcaaaataatccataattgtcgccgattatgctctaattccttaaacgatgaaaagaccgaactatagttaccagtgactgtcgaaaaagcactcgttacgtttgccatcactggcggtaaccccaatgcaagcagtgaaggataggagactagtgatgctaaaccagcggctgcactaataatccccgaaagaattccaattcccagtaataataaaacaaaaactactccactcatttttgaaccatccctttaaatgctagtactaattgtaaaccacttttctaagataagtaacctaattaacgatttgcattctgttataatattagctatgataatagagaataaatctggggtgccaaacggctgagataatacccattgaacctgctctggttaataccagcgaagggagattcagtgatattaacttaatgattaactccatgattttttgtcatggagtttttttgcccttatatcttaaggagttttattatgactaaacgttcattacatttgcgtgacattattttgcttgccctgattggaattatttttggtgtaatttattttgcagccagctttgtctataacgggctaactgttctactgacaccaattggttatggtccaatggctaacgatttaacaatgggaatctggtgtatggctggaccgcttgccggctttttgcttcggacaccgggagcggctttccttggtgagtttttgggagcagccgttgaaatgcttctcggcgatcagtggggagcagccaacctaatttctggagcggttcaaggtatcgggtctgagctaggttttacttttacgttctataaaatgtataactggttaaccctcctcatctcatccctcacccttacatttgttacctttggctgggattggttccgcaatggctataaccacttcagcggacaaatgctaatcattatgctcatcgcccgtttcatttcaatgtttgtcttctctggaattctggttaaattgattactaaccttctccaacgagcccacttaattaaacactaagactatgaaaaatatacaatttaatgatctttcatttaattttgatcagcaaccgattcttaaaaatatcaccgccaaattcactgttggaaagattcacttacttaccggggtttctgggagcggtaaatccaccattctcaagttaatcgctggtctcctgcctaaatatggtggtgaaatagttgctggagcagtcgatgtaccaacagatgcccatatcgggatggtattccaagatccgttaatgcagtttgctcttgatacgccacgccacgaattagaattcactctggaaaattgccaagtcccaactgacaaaattccagaacgcgttaaagaagctttacaattcggtaaagttgacgaccttgctaaccggttaatcaccacgctttccggtggacaacaacagcgcgtggctttagcagcagctacggcaatgcaaccgaacgtgcttttattagacgaaccctttgccaatattgacgaagaaaaccggcaacttatccttaaacaattagtccgcctcaacagtgactatcacacaacaattatcattactgaccatgatttgcatggttacgagcgactacatccattggtttggcaattaactaaggggcaccttgctcaactttccagtaaaaatagtagccaacttttaacagcgagcgcgactccccaaattaccactacccttcctccgtcaaccttgcccacgattatcaaatttgatgaattagcaataaaacgagagaattattccttacttttaccaaccaatttaggcattgttaaaaataaaataactttattaaccggaccaaatgggattggtaaatctacccttctaaaggcaattgcccgacttttgaaatatgaaggaaagattgactatgcggaggaaaacattcaaaaaatatcacctgggaaatattacaagcatctgggattgattttccaacatgccaacgatcaattcctaaatgtaaccgttggcgaagaactggcattaggctttaaaacttgccagaacccctattttaatcaacaacaagtcaacgaagcattagcagctcttggtctgaacggaagagaagatcaagttgtttattctttgagtggtggtcaaaagaaaaagctgcaaatccttctgatgttaatgcgcggacaagaaaccttattgcttgacgaaccatttactggtttagatccaacatctttaaagactgtcctgcaactaatcaaagcatcccaaaaagaaaaaccacaaactttgttgattgttagtcatcaattaagcggacttgatggtttcattgattatcatcttacaatgaatcatcaacgtcttaattatgttggagggagttatgaatcctagtttaaaattattacttgttattttgctttcacttgagctgacttttgtaactaagctgtggattaatctgattgtcattgtaatgtgtttgctaatccttattcatcagcgatttcactggcgacaattttgctggttggcttttgtccccctctttccggcactagctatttttattacaattgtcttcttcagtcctagtcacagtttctttgatggaactgttctttttagtcgactttacgtttatgtctgccttggaacggtctttacatttacaaccgataccttaacgcttgctcgctcattagaacaaaattgtcaccttcctagcaaatacgcttatggggtgctcgccgctcttaatctgattccgaaaatgaaacaagccgttacaactatttatacgaccggacaaatgcgggtgttaatttacattggtggtcaccaacgctctacttcaaagcgattctggttgctattcaatggtcggatcaattagcgcaagccatggaatcacgcggtttcgtagaaggacaagcacgaacagctaccgtgaatatcccgattaccagccacgattggctttcttttttaagtattatttgccttgtacagataattgtaattgcgctcccttgagttttcatgcgataataatataaaagaagggactgatatagtgaacgataataatttaacggaccggatcgttaatgctttatcctatttaagcatcttatttttaccagttatctttccactaatcgtgtggataattgcaaaaagcagtgatcgaccaactattgctaaaaacgctcgctatgcattttggagtcaaattttcccattgttatatgtaataggcgcaattttagtctttagtgtcttttcattaacccccgctaacttccacgggggcgcattgtttggaattctcctaacatttgctcttttattagcccttttgttatttatttatatatttgccatggccgtgaaaatgctgattggccgtgagtaagctaagagagtagtaagtgggaattaacctcctcgacaaggcggtgggctaaggatagaacggtgattagcacggcacgggctgattatcgttcggacttagcctcgagccttgtggttacgacgcgaagctagttccacgatatcttaacaatgttcgtataaataaagaggctgttgaaaaaaataaatttttccagcctcattttttatccaaaatatcaagtgaggtgattaatcgatggaaatgattttaggcattgttcttctattgactgctgttgttgcagctaatgttgttcatcttgtttaccctaagattccactatccatctatcaaattattgcaggaattcttttagcatccctgcctactgaggccactaactttaccatgcatccagaattattcatgatggtgatcattgctcctttaatgtttaatgacgggcagaaccaatcattccgttatctttcaagcaatattaaatcgatcctatcaatgactgttggattagcacttgtaacggttttgattactggtagttttttacattggcttcaaccaggaacgttctccttagcactcgcctttatgttggctgcgattgttacgccgactgatgcggtcgctgtaaagtcaattactactaatatgaaagtaccgaaaaacgttaatggtgctctggaatatgaatccctctttaatgatgcatcgggaattgtgcttttagatttggcgctggaaacctaccgttctggacaattttcgcttggtcatggaatctggatctttgtttatgttttctttggcggaattatcttcggagcagtgttagggagtctgttaattagtctccgtactagtttgatgcgaaaacatgttgatattggctccatcgttattccgatcaacgtaatgactcccatcgttgtttactggttagctgaagaactacacctttcaggaatcctagccgtcgttgcagcaggagttgttcatagtatcctctatgatcgaatgcggcttacatctactaaagtgcaaatgtctactaccactatttggaacatcattagcgatgcgttaaacgggttagtatttgttcttttaggggtgatgcttccgccggtacttggaaggacttcttggcaaaatctgggtgcaatcgttgccttagcctttgctatctatattattacaacccttttaagattcttatgggtccggtttaagctcgtcaacattcaatcgactaacctcaaccgtgatagtctcttaatggcgttaggaggaattcacggaacaatcactctggcattggctttctcgctgccagttctgattaacaaccatcaatttgcgttccgtaattcaatgatattgattgccgcaattgttattttgattagtattgctgttggcgcaattgggtatccaattattttaccgcctaaatctaagagttattcgaagagtgaatttcaaaaagaacttattaaaacagttcaatatgctattaatgagctacggacttcagaaaaatattccccagaaaaagccgttgttattgaccaattgagtagtcaaatgacgcaataccacgaatttaatcgtaatgtttatagtcaattaatgggtaaagctcatcaaattgaattagctaccttagaccgacttaacgaagaaggccgaatctctgacaaggaggccaaattcctcgttaattttgttacgcggtcgattttccgcgtaaataaacacagctttcttgaattatgggtcatcttatggcaccggttaaaatggcgctttattcgctaccgccatctcaaaaaaggctcccgctataatgtggggccaaaatatcaattaaccaaggaacagcgcgctgaaacagctgagatcctagaaataattaatcgtgaaatcgataaataccttcatttgattgaaactccacaaaatgcgaatgaagttgccatggtacgacggacgtacttccaacgaaaacgattcttcctccacgatatttcgatggataccgacctcattacttctttatttattgaggcatttcagcttgaacatagttatgttcaaatgcaacttgctgatgaccaattttcacaagaattagcaaacgcattaaacgaacagatctcaactgatgaattggtttatactcaatcattagactaaaaaaggaaattgctgcaaaatcttgcaaagcaatttcctttttatgtttaaagaaatgtaagtaaaaaagcaatcaatgctggtaaaaattgaattagaataatttttttggttgcagtaagtgcaccaaataatgcaacaaccatcacaaaaaccaagagcattcgccatactaatactaaggttgccccactaaataaccagtaactggcgatgatagctgctcctaaggcgccgttataaataccctggttagcaaatgaaacccgtgcttcatgctgttgcgtaaacttaagcggtaagtcaaacgccttggcttgctgtgccgggttaccaaagatttctaaggccataatacctaaatgttcgattgcaacaaacatcgtaacaataattgcaagcatctttttcctccaactatttaatatagtgatctaaaaattttgtcaaatggcgccgatactcgctaggatgggtcgcatatgacttcgcgtgcgctgctcctggcactacccataattctttacttccctctgttgcacggtaattgcgataaaccatttcagttggaacaaaattatcttttgctccatggataaatagcattggacgatgattatgatgcagcatatttaaggagctggcttcatgaatgtaaaaaccattcttcacccgattaattaaactcatcgtacttattaatggcacccgtaaaaacttcggaatcccatataaattaccggcttcataattcaattcatcattaagactcgtatatccacaatcttcgacaaatgcttttacttgtgacggaaggttaatgccactagtcatcattgttgtcgcaccacccatgctaacaccaaataagactacctgactatcttccccattatgccgaataagtttattaatccatttacgaatatcataacgctctggccatccataaccaatgtatttcccttggctttgaccatgagcacgcgcatccggcattagaacattataccccatctgatggaaaagcgcggcatattcgcccatcttctctttgtcacccataaatccatgggcaattaccacatttttagttgtcggtttagcagcagggatgtaatcagcaactagtttataatttccacttgccgatttaattgtccatttttcttttttggcatgcttaaaccacattttctgctcatacaatggatcatttcgtgaaattttagttgaattattaataaaatccttatgccccggtaccattgccaccgagaaaaaatagctactagcggcaaagattgccactgcgattacaactacaattccaatgagccatcgccaaggatgccactgtttcttttttgtctttgttttcaaaataattaaccccatgtcgtatcatttaatcaatgcgcctagtttagcacactttctgttattttgcatattcttttcattcaaaattgttatgctaatgttaaaatagataatgatatattaagggagtgaaataatgtttccagaacgcctacgagcacttcgcaaaggacaaaagataaccttaaaggagcttgctacccatctcaatgaaaaccttggccccaatgaaaagccaaacactgcttcgcaaatcggtaactgggaacgcggtattcggaccccgtcatacgttgaagcacgaaaactagccgaattctttgatgtcagtctggactatcttaccggaaaaactgatcgtgatgattttgatttagcaaaattatttttctcaagtaagaacctgtcgtttaatcaaactgtactttcaagtgatgatcgatatgaaatttttcaactaatcgatggttacttaaagggacggcataatcgccgggatacagacaccttctatggtaagcaagaacaactagatttaaaacttaaataaggagtttctgatgaatcctaaaaaattaaaacagctaaaaaagcgggtaaaaaaagctcatcaaattgttaatgagccttcatatattcaagaactaaatacttaccgtgacctattcgatgactttcctcctgtaaaatacctcattaataatgttttagaaagtgatcgactactcaaaaacggcttattgccacaacctctaccaaaattattattgccggataacattcaagataccattttcaaaaaggttaatgaacagttcccacaaggtgatccacgtggcgataaactttggaataaatatagtgaggcgttgccaaaattagataaggcgttgcgcaactatcgtgattatctcgaggaaacatacggaatgtggtcatacgtcaatgcaccttttgccaaagcactttctgattatttaggtggggcaccgacattagagattatggccggtaatggttatatttctaagggattacgcaataacaatgccacccaaaggatttatactaccgatagtcaggcatggataaaagaaaacgaaacgggcaaacaccctgtcactaagattgagaagttggacgctctagaagcaatcaaaaagtatggtgacgaggtcgaatatgtcattatgtcatgggctcccgataagggtgaaattgactgggaggtcctgaaacttcttcgttcaacattccctgaagtcaaattattagttattggcgaaaaagatggcgcaactaactctaagaaattctggcaagaagcccaattgagtcaagacgatgagttacagaaagttaatgctaacttgcactcgtttgatttgattgatgaacagatttatctagcaaaataaaaaagttgaggttaaaagagaacaaaagttttctcttaacctcaactttttatttaatcaattttagccactaattttccaactacttcatgatttttaatcgctgttaagcccttaataatttgatcaaacggaatcactttctcaatcaaaggctttacatccccattagctattaattttaacatttccgcattcattcggcccaaatcagcttgctgatttgggttgccactgagatgcgccccaccaagattaacgacatctatccctagaccgcgatcaaacattggaacattatcaagtgaaggaacgtcaacaatcgttactaagcgtccattataggctaaccgccacaaatcaagttctgcttcttttttacctaccgtatcaatgatcaaatcaatgccaagcccatcggtgagatcggctaactttttatccacatcttcagtttgatagttgatgattgtatctggagcaagctgctttacatagtcatatttactagatgaaacagttgtaaataccttacaaccatgaagtttagcaagttggatagcgatactgccaagcactaacgccgccttcaacaattttatagtcgaccggattaagcccagcagcatgcaccttaattagaacttcatgttcagccggcgtaggaactggggcttccgcaaaattcaaatcttgcaatgaacgatctgctgctttttcgactactaaggctttcattttttcgctctccttaattttataataattattataacactttgcctaggcattcttcatagccatcttattaaggtagtgccaaatttgcgaacgatatttccgtaatccgaataacatcacaagataaatgataattgctagtgaaatccaaacaggactttctgatataaaggcagcaaaaaccaatgcattcaatggtcgcgccactaaattaaaacttgttaccaggactaccccggttggaattgcaacgccatagtgggccactgctgcagtatagaccggactgagccaactggccgcatataagcctaaactaaaccacacaattcccgtcgcaattacttttaagatatttccacgagtcaccgcgacaattgattcaatcatgtacggaattgcaattaaatcaactaccggaagggtcttattgccaggaagaataaaagcaattaaaaccataatcgggattaaaatgattcctgaaattaaagtggctgattctccatagccaacgccatcatcaacagctaggaaccaccgctttttatcataacggctatttttattttcgccatgtcgttttttctgctgctcatcaatttcattcgcaatgggaataaatgcctttgcgaatacgtttgtaacaaggggaaagatcgccataacggcagctaattgaatcgcaaatttagtaatctgtccccaagcgcttattttccccagtgaagataaattacccaagatcccaattattaatcccaggataattcccattgtaattggttccccaaagacacctagttttttctgaaaatctttaggagtcattttcactttgttaaatcccagtaaattccataacggatctaaaataatcgctggaaccacttgctcgatattatgtaaggagtcgacagtggtattctcaattccataatagtctgcccaccgatctgcttgaatttccgctaagactagtgagtacaggagcataaaaaattccagccctaatgatagccaataattatgagttacataaaaagctagcgtgccccaaatcatatacccaaaattattccaaatattagaaggcagaaatactttggtaacgccaagcgcaaataaaattaattcagttagtaatccaaaaacaaaaaacgataaaccaaccgttgatccaaacgctgctaatgaccctgcttgccagccgatatcaaccactggtagtttaatccccgtattatcaaccatttggcggacaatcttagtcaccactggcgtaaattctgtgataatccaggtaaaaccagttaaaccgacaccagcatagaaagcactcatcattgctgtcttaggctgcactcgtagtaataaagcaatgataaaaattattattgggacaactacactcgcgccaaaagtttgaaaaatagcattaacttcttgaagcatgttttactccctccatcgaataaactgttacctatattttccctaagactggtctttttagcaaggcaaaaggtttatctgcgtttgctatagaaatctattcagaaatttgctacagtatgatgagtttaatctattagggagggtacattttatgaaatatcgtttacaagctattatttttgtcttcgttgcctttatgctcgggtgtaacgaatatatgattgtcggcgttttacctgatatcgctcacgaataccatgattcgcttggtaagttaggcctacttgtaactgtatttgccttggtttatgctattttcactccgattattacttcaatggcaaatcggtggcgacgacatcatgttttattagttctcatggtcatcttctttatcggcaatacgtggacagcaatggcgccaaactttatttcaatattgctttcgcggatcctaactgctagtgttgccggtgcgattatctcaatggtcctcgtaatggcgagctatgttgcgccgcgtgaaaaaagagcaagcctggtttcatgggtttttgctggatttagtatcgcttcagttatcggcattccaatcgggaccgttatcagcactacccttacttggcatgacagtttttggatgatttctggaattacgatcattgtttttggcgccttgatttggctcgtcccacgtgatacgcctcaatttaagagcacccttagtaaacagtttgtgttatttaaggattcacgaattattcttggtgttagtttcattgttgctgtttgtgcggccgactacacaatttatacctatattcgtcctttaatcactaacgaaatgggctttgataacacatggttgaattggctcctattcggaatgggaatcttctttattattggtaataaatttggtggatacttggctgaccgtggcggaattcatcgtctcagtggaatctacgcggcaatgacaatcttatttctcatctttggtcctgtcttaccattccagtggggtgccattattattgtggctgtcttatgtattgccttttcatgctatggttcttccacccaattaatgttccttgatattgccgaaaaacaatatcctcaatcacttgacttagcttcatccttaaactcaatttttgctaatattggtatttcactaggctcttttactgcctctcaggctgtcaccttcactgccatgaaaaatctcggttacgttggcgcagtctatgggcttattgcaacaatactagtcatagtcctgagtaaaaaatatacgggaatgcgcaattattaatcttaactttgagtacagatttttccatctgtgcttttttatttcccgggaaattaatatgcaactaatagtagcggggtgagcaattgttgttatctaaggattctattgaccttttgattagatccaattaaattctaaatatagattttgaaagggagctttttgctatgccgtattcttttccgcatcaactgctcaaattgcggactgaaaaacaattatcacaagctgaactagctacgcgtctattcgtttcccgccaggccgtctctaaatggtaaaatggggatgctgaaccaagtatcgataagctaattttgcttgccaaggtttttaatgtttcattagaccgccttatcttgggaacaaacgactttaatcaaccagtggtaaaacttaataatattgttaaaacttttaactcaccagttctcaacagccttgatttaactattcacaataatgaacgcattgcccttcttggtagcaatggcgctggtaaaacaactttagtaaaaataattgaaggtgctttgaaacccaacaaaggtactgttaaatggtattttagtaaaaatgattctttaaatatcatgtctcaagaaaatgttttaattccaaccctaaaagttaaagagcagattatcttgacagccgccataactaaggtcggttcaaagcaacgaatcaattatcttcttgatcaattcaaattatcatcccagcaaaatacaattattgcgaaattatcaggtcgacaaaaacgtcgcctttcgctcttgcttagtgtcctccgtcagtccaagcttctgatcctagacgagccaactgttgggatggatttagaatcaattgactatttttggcattttattgaaaaggtttcgggaagtattttagttattactcatgatttcaatcaaattgataaattcttttcccgtgttctgctccttaaagatggccaaatctctcaagacatccctgttaaggaaatccaccaacataatcagacaatcgaacaacggtatcgtcaacacaatcgttaggagttttcttatgagcattatagcaattcaactaaaacaagttttgcgcaatcgtcgtttctttctttttactattctactgccaggtatttggtatgtgtttatgattcaagttgctagtacatccctccccgccactggcaacttccagctcgctttacttttgcttgctctcctgatgggaatactcggtaattcgatcgttactttcagcaaacggatttgtagtaataaggacttctatattcttcaatcgcacattagccattattctctgtgaaactatttattttcgcaattaattacccaagtcatcatcaatttgttcatcaccatcgtaattatgattcttgctattttccttcatactatcgagttcaacttcattactatcactagtattttgttaaccaatatcatcggaatatatctaagcgtgatcgggtttgcaattgggctttcctttgacgcaccaactatcgatgccgctggaaccccaatcctatttataatcgcaacttttattattccgtggaaacacctcttaccagctaattcttttattgatttctttactaatgttcaaaagctatttccaacttattatctttacgacgaccttgaccatctatcggttagtcatcttggactactatttgtaactgcgattattactctgctaccttggcttagctttatctatcgaaaattaatcaactaaaaaaccggaatacctagtactaaacatactaagtattccggctttttcgtgtattgatattatctcaagtcaatcagcactgtccacatggccgattaactagacacctcacaatccggtgagttaatgtgtcccacttgtcaaaatgtcaatggtagctcttagggtcgctaccagacctctcgactcatcgcaaattataatttagcatatttgacctatggatgcaactcttatgctcttgcttccattatatctgcaaggtgttcggctacccattcttgagttttagtaatcaaatcagttgtctttccactttgatcggtttcatttgctaattcatcgatccgcaatcccgttttattaatatcttcactctccattactaaataaagattaacagggtactcgatctctttatccaataatttaacatctaatcgctctgcctcatccatcggtatgttgattaggttggtttctaagcgaaagctaactggatcaccttttttcattttaatgttcatcttatattgaccaaggtgtcccgtatcaagttgttcaatcataaaattaattgcagttgttaatactgttttttgctgtgattgggcagcagttttttcaacttcttctgtcacaacctgatcgctcgtcaactgtgacaaataatcagctactgacatcttcattttttcatttgctccttcattttttcaattttagcttttgtatagtctgcacgctgttttgcaccataataaacaccagcagctcccactaaaattccaacaatacttagtgcttgaataaataatccgtatgcactttctcgtggacttaccatttgaaatgcggctaaactagcgattgcaaaataaagatttactaaaatcgttgcatatccacaaaagcgcatctttaaaaacgataatccgttaacaatgattgctaaaacaataaagaggagcagccgcggccatacagatgatgatgtcagcgagtgaccatgctgaacaaacataaaagcatcaaggactaatgcaattactgctgctactgatgttacaataacaactttttcattatttttcatttattttgccaactttcttttttgctatccccgcggatgaccaatatttttacatcccttaattaacgaaaagtaagtgggaattaaccttctcgacaaggcggtgggctaaggatagaacggtgattagcacggcacgggctgattatcgttcggacttagcctcgagccttgtggttaatttccacgatatcttaaacaatgttcgtataaataaagaggctgttgaaaaaacaaagttttttctcagcctccattttactaaattaagttaaaaagctcaattatgcgagtaaatcagctacttcagcggttggaattcccgtaatatattgttgggttccttccgcttcaaggactttagcaatttcatcatggtcatacttaatcccttggagcttttctgccagttggttaatatcctgtgggccaaagaaatcgccatagaatttcacgtttttgattacgccatctttaatatcaaagcgggcatcaattgtccccatatcaaagtgtttccgccgcttaaccgtaaactctggcgacttaccatagacccaatcccagttgttatagtactgctcatagatcttatcaatttctttttgatcttcaggggtaaccatgtattgcttatccttaatctcctcaaggtcgtcaacatggaagagaccttttagcaattcatccctaaatgttggcacatcaatatcttggtacttttcatccaagtatggacgaagattcgtaacccgtgatcgaactgatttgatcccctttgaagcaatcttatcttttgccacatgaagggcatccgcgacgacacttaagtcaacatcaagcattaaagttccatgggagaacgtctttccattacgtgaatacatcgcattccccgagaatttcttaccatcaactaaaatatcattacgaccgctgacttctgcactagtagcacccatttgatgaagaacattaacaattggctgggtaaacgatttaaagtcaccgaattcttcactatcacttgggaccacaaaactaaaacagaggttccctaagtcttgataaacagcaccaccgcctgataaacgtcgggttacccggatattgtgttcctttacataatcatgattaatctcttcaagcgtattttggttccggcccacgataatacatggttcttcataataaaatagtactaaaggctctttcccaaaatccttattattcattaaatattgttctgtagctaaattcattccaatattatgagaagtcattgaaacataacgcataactagcaccctcttataaaaacatcaacataaatagactaaaaatttacttttgtcatttagtcatccatttgtagtgtacgtcttttcgtaagcgtttgcaatatattatcgacaaagcaaaaaatactttcttttttacatctttttagggcgaaaacattttataataaaggtataaactttcggaggtgtctattatgacagaaatttatccatacaaacacattctagttgctgtcgatggctcaaaaattactagtaacgtcttagaaagtgccattgattctgcactacggaatcatgctagccttgatatcttacggatcgttcaagtaacgcaactaacagatggctatagtaatgcggcccttagcaacgaagaaacatataacattgttaaaactaccaaggaacgactcgatgacttgaaaaagcgcgcggtcgatgcgggggttgaagatgttaacgttcatatccggtttggaaatccaaaacgtgttattgctcatgaatttccgtcagatcacaacaccgacttgattattctcggtgcgactggtgtatctggtcttgaacgctttgttcttggctctgttacccactatgttagtcggatggcaaaatgtgatgttcttgttgttcgcaaaaacgaccatgttaactaggtgaaaaaacggtgaaacaaattgttactggcatcgttgctcatgtcgatgctggaaaaacgactttaaccgaagcactcatgtatgaaaccggcgctattcgaaagctaggtcgcgtggataatggagatgcttttttagatcctaacacactcgaaaagcaacgtggaatcactctttttactcatcaagctgagctaacatataatgaccttgcgcttacccttctcgataccccaggacacgtcgattttgctagtcaaacagaacaagtcttaccagttcttgattatgcaattcttgtcgtttcagctactgatggcattcagggatacactcgcacattatgggatcttcttgctcgttatgatatcccgaccttcattttcattaacaaagaagatgtgattggtgctgatcctagcagtgttatcaaacaactgcaaaaagaattttcgccggcttgccttaattttgctgatccattaactgacgaagttcgtgaaacaattgccatgcaagatgataaagttttagaaaactacctcagtactggtagccttagcgatcaaacaattcagcaattgattaaacaacgtaaagtgttcccttgttataggggagcagccctaaagttaactggaatcactaatttcttaaatggacttgagaaatggacagttacgcctgcgttttctgatgagtttgcggcgcgggtattcaagatttcccatgatgacaagggtaataggcttagttgggttcgtgtattcggtggcaaaattccagctaaatcagttttactaaacgaagaaaaagtgaaccaaatccgaatatataacggggctaaatttagcccaactcaggttttaaacgcaggtcaagtcggtgctcttactggattaacttccacatcccctggacttggtcttggtaaaacaaagccactccctgcgccagtcataaaaccggtcttaaattatgccgttaaagttgctaaagaggaccttcatgcttgtctcaacgccttaaaagagcttgaagatgaagatccacaactacagatctcttggcatcctcacatccaagaaattcacgttcagattatgggagaagttcaacttcagatcctgcaacaattgcttcaagaacgttaccaattggaagttacatttgatgagggaaacgttctttatcaagaaacgattactaacaaagtcgaaggggtcggtcactttgaaccattacgtcactatgctgaggcccaccttcttttagaaccaggaaaacaaggctctggaattacaattaacagtgactgcagtcttgatattctggatcgcaattggcaacaccagatcttaactagtttacaggccaaagaacatttaggagttcttataggagctcctcttaccgatgtcagaattaccctcattggtggtcgcggccatattaaacatacagttggtggagattttcgtcaggctagttggcgagcggttcgccaaggattgatggaattgaaggaacaaaacgaatgtcaattattagagccttggtatgctttccaccttaaagtaccgaatgaccaagtaggacgcgcaattaatgatattcaacaaatgcatggtacgttcgcgcttgatgaagctaatagtcaagacctaaccctgattacgggaactgctcctgttgtgggcatgcgcgactatgtccaaagcgttcgcacctacactcacggccagggtcagctcgagcttgttgttgctggctattatccatgtcataatgctgaagatgttattaaagatgttaattatgatccggttgctgacctaaagaacactcctgattctgtcttctgtgctcatggtgctggtttccccgttccatggaatgaagtccccgcaatggcgcattatccgtatagaaaataggttgttgataaagagagaggctgagaaaaaacttcgttttttcaacagcctctttatttatacgaacattatttaagatatcgcggaactagcttcgcgtcgtaaccacaaggctcgaggctaagttcgaacgctaatcagcccgtgccgtgctaatcaccgttctatccttagcccaccgccttgtcgagaaggttaattcccactcactctcttttttcattcaattgtcaatagcaatccatacaatgcacctaataaattagcctcattgccaaactttgcggtcattatttctggcatcgtaacatcatcatgaagacggtaatcactcttctgcagaatcataaattgcttctttatttcatcaattaaaattttttgcgtactaatgccaccaccaatgagcacacgttcaaggtcaacaactgtctgaatatttaaaatcaaaacagctactcgccgacaaaacccttcaaataaggaccaaataactggattatgacaattaatttctttaaatactcgtcggccatcagttttatccttaatatcacaaatatcagccatggtttcaatcatcttaactgctgaagtagtagcccccattgtcgaatagtgaagttcaggcgcatcattatcaatgatcatggcacttaattcaccggcctgaaaatgcggtccatgcaagagctgattattaataacaatcccgccgccaacggaagttcctaatgtaattacagcaccattactgataccgttgagattgccaagccacatttctgctaatgtcgcacaattagcatcattaccaacatatactggacaatgagctcgtgattccagataggctgcaaagttaaaggtccccataaagccaagggcgccagtaaattttacctctccagtcgtcggattaacgactcctggaagactgacacaaatcgcagtaaccttttctaaaactggttcaaccacagcaaagattgcagccagaaacgcttctttttgatgaggagttgggacatggtttctctcaaaaatattaccagagtgatcaattaatgcactctttatctctgtcccaccaatatcaatactcaaatactgtcgttgcataactcctcacctcatttctcttatattatacacgactccgctgttgagggtaccaaatacaaatactgatgaataagcccaccagggtaaaaggcaaccaactaaagccaagttgatacaagggaaagtatttttctgcaaaatggattaatgacatgctaaatgtggtatcccgtaaaaccggtgggaaagtatttaccatatcaaaaaatgcaggaatcattgttatacctgtcgtgattcggtaaattaacgaagctcccttgaataggggcgaaaaaatacctagtaggatcaacacaatggctagcgggtaaagaaacattaaaactggtatcgaccatgaaacgatccggtccagtcccatgttagcaactagaaatgacaacaggcaattgccccgcaaaaaggctttataagaaatctgggggaaacgatagtggaagtcctgggcaaaagcgactactaaccccatcgccgttgtcatacacgtgattgtcgcaagggttaacaataatacatttccaaaatctcccatataataatgagcaatttggtttaatgttgttcccccattggctgcgattgtgaattgataccgactcgttgttcccaaataaattagtccaatatacaaaatcccaattcccaaaattccaatcattccacccttggtagtagcaagtgaaactgattgttgagatttaaaaccaagttggcgaattgcggtaataatcgtaacgccaaaaaccaatgctgctaatgcatcaatagtattatatccttgaataaaaccattactaaaggcatgattaacatattctggagttggttggggagtagttgtacttcccattggatgaacaaaggcgagaagaaagatcaaaaataacataataaggaaaattggatttaaaaccttaccaattatttcggtgatttttccttcacgcgttgcaaaaaagtaaacaattagaaaaaatgctccggtataggctaataatccccagccttgcatccctttacttaaatatggcgcaactccaatcgtataaggaacagttgccgtacgcggggttgcacataaaggtccaataattatttgaaccaggataaggaaaataagggcaaaccttttcccatttggtaaagctagttcatataatccatttgcatgtgtaatactaatcgcaagtaatgcaaatagcggtaaaagaacaccggaaagcaagaatccgcccgttgctgctatccactggttaccggctaattgtcctaaatgtacaggaaaaattaaatttcctgccccaaataacattccaaaaattagcgacccaattaccaagtaggttttacacgctgctttaattgagttcatagttaatcactcgctccttttctctcaatttaatctgacgctaaattataccatgaaatagtcgctggaacagaagtacattttaatcaaaaaggaccgttacatcctctcaaatgttaacgatcctttaaaactaattttttaaaaagttagctactagtttcaaaatttcttggcgtcgtgagccattaaacatatgcccttctccaggaattaaatgcaactcactgttaggcatgattacattatatttctttgatgcttcaggggaaaccacattatcagctaacccatgaattagcagtgtggggccactataatgttgcgctgtttcgtaaattggtaaaagctgcgccgttcggaagtagtcgccgccaacggtaaagccatgcatatcaaccgtttctggtatatggttaaggtcatattggcttccctgacaaacaccttttagtgcatcatcttttaaggttgcagcaggtgccagcagtactagttttgtaataatatcgctataataagccgccagcatcaaagcaactaccccaccttgcgaatgaccaattaggtaaatcttctttgcttgcatagttgtgtgagcatagtcaatgattttcattccatccagaatttcactaaaaactgtcatatccttgaattcaccatcactatgaccagtcccatcaaagtcaaagcgtaacgttgaaattccttgttgatttaaatagtgcgaaagagcatacagaattttagaatcatcatatcccagattgcccttaaagccatgcatcagaattgcgactgtatcgtttttaatcgtcgttgttccctcaagaagaccatatagagatcatctcgtttgattgttatttccatcaaaccacctcccacttattatacactgtttgatttaatgttttagcttctccaacattgcacggtggtgtgcctcgtgtttctcatccaccttgataaagaagtaagaaaccgcagccaatacggcaactacaacaccaactgtaatcgtcttaattgtaaaattggttctcatatagcatgagattaagagtactaacaccggaatgatatattttccgagaagcttaaacccgtgattagggaattcattagtatgtttaaacttaattactgctaaaattgatggaacatattgaacaaacgaagcaagcacaatacaagaaacaagaaagaggtaagattgagtaactaataacatcgaaacaacggctgtcaggataatcgctacccatggtgcatcatggcggttctttttaccaacccactttggtaacattgcgtgttcattcgctagtgagaaaattaatgacggagtgttaaaggaggccgcaaacgctaccccaaaaatactgatcaacattcccacaatcactaaaatgtaccccccatttaccgacaccagttccaaaagcattggcaattagtgtactatactttgacatcctagttcctaaaatacggattgctactagcatcattagcgaatacataatcgttacactaaccattacggcaattaatacgcgcggaatatttttctctggatcggtcatttgttttgcagcaattgggataaaggaaaagccagtaaacatatagaagacaacactaaaggctgctccaaaatgtttggcaagcggcattgccccggtggttgctgcatgagggattaccggtgaaaaattagcaaagtgaatacaaaaaacgccaataacaataaaagcaaggatcgtaatcatttttgcagctgaagagaggttatcgaccaacttaacaagcgtccggccgaagaagttaatgattgaaaataataaaattaagccaaaaacagaaacatagtatacccaatgagtattaaaaagtggtaaaaagcttcggagagttgtcaataaggctaccacttcggcagataaagtacagcatcctaaaagccacgtaaagatgccgagctcatagccagtaaaccggccaaatgcattatatgaataaagccaagccgcacctgatcctgtaaaacaactagaaaggtccgcataacataacgcaaccatgctaaccgtaatagcggcacagagtaagacaaggacacttgctaaatccatatctttatagataacttgtggtagcaaaaaagcacctgacccaataacaccattaatacctaaaaagtaaattgaaatgaacgataactttttaggatttttctttttcgtattgataagctccaccttctatcctttataacaaaaataatattatcttcatttaaagtctattcttattttaaaggctttacaggtaagcaagttaaccaatttttatatttctaaacaaaaagagaccgagttaaactcgatctcttttcttaatttattaagtgtttaattagcaatcagtagctgattacttaagacccttccaagtccagttagtaacttctggtaagtccttaccttctgaacggatgtagtggttgtgcttgttgatcatgttgtccatcttggcaacaaatgcagcactcttttgttcgtaaccaggaacactttggatagcgtccttagctaagtggaaccggtcaagttcgtttaatacacgcatgtcgaatggagtggtgatatcaccattttcttcgtatgagtgaatgtgaacgttacggttagcacgatcgaagaacaatgcttggatcatgtcacggaatccgtgccatgcaaagataactggcttgtcagtagtgaagtaacggttgaattctgcgtcagacaaaccttctgggttcttgtcttgcttcatcaacttcatgatttcaatgatgttgatgtaacgaatcttcaattcagggaagttgtcatgaagaatgtcaatagctgcaagagcttcttcagtaggttcagtaccagctgaagcaaatacaacatctggttcgctaccttggtcagtagatgcccagttgatgtagccaagaccattgtcaactaattcagtagcttcatcaatggagaaccattgtgcacgtgggtgttttgaagttacaaagaggttgatacattcttggttacggaatgccttgtttgatacagccataagtgagttagtatcagcaggtaagtattccttaacaaggtctggacgttccttttcaaataagtgagtcaatagacctggatcttggtgagtgtaaccgttgtggtcttgttggaatacagttgaagtatcaacaaagttcaatgctgggtattgacgacgccagtaaagatccttagccttacgtaaccacttcatgtgttgagtaagcattgaatcaacaacacgaccgaatgcttcataagttgcgaagaatccgtgacgaccagttaatgtgtaaccttcaaggaatccttcagcttggtgttctgataattgagaatcaatcatccgaccttgtggagcaacgttttcatcgtttggttcgtgaatgccttccatccattgacgcttttggttgtcaaggaatgcgtaaagacggtttgacttagattcgtcaggaccaaatccacggaagttagttgggttcaattcagccatcttgctgaggtacttaccccattcaagcatatcttgctttacaacagaacctggagtttgaacgtcaacagcaaagtcacggtagtttggtaatacaagtggcttaggatcgataccaccattagtgataggattcatagccatacgacggttaccttctggtgtgttctcttcaacaagagcaactgggtgaccgttttcgtcaaacaattcttctggcttgtatgacttcatccagtcaataagcatgtccttgtgttccatgtcatcttgtgataccggaataggaatttggtgagcacggaatgagttttcgattgggttaccatcaagatccttagtaggaccagtccaacccttaggtgcacggaagatgattaatggccattgtggtaatgaatcatcgttgttttcacgagcgttcttttggatagccttgatttcttcaacagccttatccatagtcttagccatttgttcgtgaacttccatgtgtggcttgtaaccatcgaattcaccatcacggtcagcttctttgtaagctgatacgaagtatggcttccagcccataccttcaaagtacttagtaagttcttcgtcactcatccgtgaaagaatagtagggttagaaatcttgaatccgttaacttggatgattggtaataccgcaccatccttgattgggttgatgaacttgtctgagaaccatgatgccattaatggaccagtttcagcttcaccatcaccaatttcaacagcggcgataacatcagggttatctaagatagcacctacaccgtgtgaaagtgagtaaccaagttccccaccttcgtggattgaacctggagtttcaggtgcggcgtgagatgcagtaccgcctgggaatgagaagtgcttgaataacttagccattcccttagtgtcttgtgtgtattcaggataaatttcagtgtatgaaccatccaagtatgagttgttaaccataacttggccaccgtgacctgaaccttcaatgtagaacatatcaaggtcatacttcttaattacacggtttaagtgtgcgtaaatgaagttttgaggaacaatagtaccccagtgaccaattggcttaggcttaacgtcttcagcctttaatggttggcgtaataatggatcacccattaagaacaaagtaccaactgaaaggtagttagctgcacgccagtaagcatcaacactttccaaatacttcttggaatcgtaatctactgccattctaataaacactccttctatataaatcaatacgtcctgtgctctataacaacataacgtaaatcattaaatttacaatgttaatgataaacttttttttcaaaaagtcaacctttttacaaattgatacggtccaattataaaaaattaatctttttaaggtgttctttaacatttttctatttatcttaatccgcagaaatgctaatttacctttgtttaaccccgttcaataccaacagtgtacaattaaaatttcttttgaaaaaaataaattttacatctattttaatactttaaatactgctatcatattcactagttttcttggtctaggctaacaaaagtactatatttcatgtatttatagtgaattcgcatattagaaacttcaaacggcgtcccatcatccaaaaagaaaatcccttcaattgttccaaccggctctgtttcattcaacttcaataagtcttgatcttcatttgttgacggcgaaacaccaatcgtcataaatgactttgtaacccttttccccatcatatcttctaaataattaaaaattgacccattaacaacttcgggagaaagagtgggcgtaattctaattggaataaaacccgtttcaatcataaacggctgatcatcaattaaccgtagccgtttaatctgataaacaaagtcgttatcattaagaaatagttcttcttgaacatctttacttgcaggaacaacttggtaatcaagtaattttattccttgctttttaccatctacttggaaactgtccgttacacccaaattactaccttcataatggaacaatgactggttttttaggtataacggattaataaatgtaccggatccgcgtttcttaaaaataattccttgctgagcgagcactcccaatgcccgttttatggaactgcggcttacctgatagatttcacttaagcttcgttcatcaggtaaacgcatcccttggtatttattgtctagtattttttgttttatatcacgcatcactgagcgatatactaagtctgccatctaattaactcctcggatttaattaattcgcaatttaagctacacttttagtatagcaggcctattttaaattgggatccttttgtaaaatattggtgcgtcccagataaacttaggaggaaatttttatgagtaaaaaaaataaaaaaagcaaaatgaaaaaaacacaggtagaacaaatcctcgataaaaataacattgcttacgagcaagctgaatttccgactcaccaagatggcgatgtacgttcaatgagtgttgatcataccggggttgacgaacatattatttataagaccctagtattaaccggtaacgtaaccggaccgctagttggcgtcatcccagtcgatacacacttagatgagaaaaaacttgctaaggtttcgggcaataaaaaggttaatatggtgccgctaaaaaatcttctcaaaactaccggatatgtgcatggtgctaacacccctgtaggaatttacgagaagtttgaataccctatttttattgataacgaggccagagaacaaggcgatattttcgtttcgtcaggtaaagtgggccgttctattaaattaaatgccgaagatcttgccaccctagttcatgctactttcgctgatttagaacaaaagtagtttcttgacgattgacccggttaatgttgaagattaaactgattattgtagtttgtttgatagaaaggtcctgaaaagatgaaaaagaatttatctgcttgtaccactgtccttgtgggtcgcaacgcaacgattgatggttcaacaatggcagcacggaatgatgatacatttggtccacttacgccccaacgcttcgttacttatcccgcatatcataatcaccctaaccaagtaaaggcatacttaaataaatgtgtaattgatcgccctgctgatggttatcgttatcaaggtactcctaatgttgattatcgaactgaaggggtattcgatgagagcggctttaacgaaaaaaatgttggaatgagtgcaaccgaaagtgtttatgcaaatgaacgcgtccttgcctgcgatccgcttaataccgaaaccggaatcaatgaagatcttgtggtcgctgctacccttccctttatcgatagcgctcgtgacggggttgcataccttggtaaactagtcgccaaatacggttctgctgaaggaaacggtattatattcagcgacaaaaaagatgtatggtatatggaaatcgtcactggtcaccactgggttgctcaacggatccccgatgactcttatgccgtaactggaaatcgagtagcaatccagcaagttgactttaatgaccctgataactttatgtggtctgacggcatccaagaattcgttgagaaaaaccacctcaaccctgataaatatggttgggacttccgccatatctttgggactgctgatatttttgatcaacactacaacacgccacgccaatggtacggtcataaggtattaaatccggaaactgaatttgatccgcttgattttgatattccatttattatgcaaacggaccatcgaattacccttgaagacgtcgaaaagatcctcagtagccactaccaaggaacaccttacgatccactaggtcatgaaggtaccgaccagcaaaagcatatgttccggccaatttcactaaaccggacgcaaaattcccacgttcttcaggtccgcaatgacttaccggaagctgcttcaacgattatgtggatgagctttggtattcctacctttaccccatatgttccattctttggtaatgctgaagacattgatgtaagctatcgtgaaacaccagagaaactcaatatggatttaaagagtgcttactggatgtatcgggcgctttcaatgattgtcgaatcacaccatgcagaattttctaaggccgacttggattatctcaaagatgcccgtgaatatctctaccgctgggtcaatgaagttgctccacaggttaaggggatgtcatcttctgaagtcagtgctttcctaagttcaaagacgcatgaaatggttgccgaaatggctaaacgaacaaaagctttaatggctgagttagtaatgaatggactcgaactttctaagttaacattccaaatcgataaaaacttgtaaaaataaagatgaggctgagaaaaaacttagggcattatcgccctctgttttttctcagcctcaactatttttatgaacaataacaagataacgtgcaaaacaaccacatttttctttaattatttccagcaaactgactattataaagattagcgtaaaaaccttttttattcattaatgattcatggttacctgtttcgataatcttcccatgattaaccacgacaatctggtcagccttccgaatcgttgacaagcggtgggcgacaacaaaactagttcgttcttgctgcagagcattcatcgcttcttgaatcaagacttctgttcgggtatcaacagaactagtagcttcatccagaattaaaatttccggatcagctaaaaatgcccgtgcaatcgttaataattgtcgctgtccctgtgaaatattagaagcagactcgtctaagaccgtttggtaaccatcaggcagttcacgaatgaaagcatccgcccgagccatcttagcagcatgatagacttcttcgtccgatgtattctcgttaccatacttaatattttcaaaaatcgtcccagtaaagagccaagtatcttgaagaacaatcgcaatatgcttacgtaaggtatcacgagtcattgaacgagtatctttcccatcaagataaatatggccgccttgcggatcataaaaacgctctaaaagattaataatggtcgtttttcctgctccggttgggccaacaatggcgaccatcttatctcgtggtgctttaaggttaaagtcttgaataagcggttcatcagtatagctaaacttaatatccttaaattcaactttcggaatatcctttccagtaagggatggaatattctcaaccttatcactcatctctggttcatctaaaacagcaaaaatacgttctgccgaagcaattgtttgttggatggtgttacttaaattcgcaatttgggcaattggttgagaaaactgattggtatattgtagaaatgcttgcacattaccaagagtaatctgaccatgaataacttgaatcgctccaaccactactacaacaaggtacccaagattccgaataaagaccatcattggcatcattaagctagagaaaaattgtgctttccatgctgcttggtagtactgatggttctctttattaaacttttcttcttcatcttgttccttgttaaatgtccgcacaatcgtatgagcagcgtacgtttcttctacttggtcattaatttttcccaaagcggcttgctgacgaccaaatagacgttgtgaagttgaggcaacaaaagcaactaccagaatactaagcggaattgtgacaagggcaatgattgttaatttccaactaatcgtaagcattaaaatgaaaacaccaacaagcgttaacaaactcgtaatgatttgaatcaaactttgctggagggttcccgcaatattatccatatcattaaccattcggctcataatatcgccattattatgggtatcataatatttaattggcacccggcgcattttctcttcaaaatcttgacgcaaattgtaaacaacacgttgcgatactcgtgtcataatttgtaattggaggaaactaaatagtccagagaacaaataaagcaaaatgactgtaattccaatttgccaaatccgggtaaagttaattggaagggtacttaagtgggcaccagctttcatttctgcataccctttaagcattccatcataaatgatcgtagtagcttcaccaagaatttttggtgctaagattgacaaaataacagaaataacagctaagagaattgaaacaataaccccaactcgccatggtcgtaaataggcaattaatcgctttgtggttggccaaaagtgttgagcctgttcaggtacttgtggtcctctacgcacgatcaacatcccctttctcgacttgtgacttaattatttgttggtaagtttcattatgtgcttttaattcttggtgagttccttgaccaactacccgtccttcttcaagcacaataatttgatcagcatcaacaacagtagagattcgctgggccacgataaccgttacagcacgttgaatttgtgggtcttttgctaaagcagcccggagttttgcatcagtttcaaaatccaaggccgaaaatgagtcatcaaaaacataaatcgatgcgggcttaataattgttcgagcaatcgctaaccgttggcgttgaccaccagaaaagttactcccgttttgctcaacaactgcgtccaatccgccttcttcacggacaaaatctgctgcttgcgcaatttcaagtgcatgccacatttctttattcgttgcttcctcatacccaaattgaaggttagaccgaatagtcccactaaaaagaactgcttgctgttgagtaatagaaataacctcatgcagattatgctgacttaactttttaactgggacaccatcaactttaatctccccgctttcaatatcaaataaccgcggaattaagttaaccaaagctgatttacctgaaccagtccctccaataatcgctaaagtctgacccgctgtaactttaaagtttaagtcatgcaaagctagtctttctgccccatggaaacgaaaatcaacatttttaaattcaagggaagctggttgattaatcgaaatcttttcttgatccttttccggtgcattatgaatactgattggctggtccaagacagcattaacacgggtagcagatgccgatgctcggggaacaaagacaaagatcattgaaagcatcataaagctaatcataatctgagtggcatatgtcataaaggcaattaaatcccctacttgcatgctcatattagctacaagatgaccacccagtagaataatggcaacatttgtcattcctaaaataagcgttaccactgggaatagtgtcgaaacaattgtaaaggccttgattccggtttgcgtgtagtcctcgtttgcttttttgaagcgattttgttcccaatcttcctgccgaaaagcacgaataactcgaactcctgttagcccttcccgaaagattaagttaatgcgatcagtttttttctgaatgctcttgaataacggaaccgcaaagtacataactgccatgacgataatcgctaaaactggcaaactaataaaaaacactttagttagttgcggttctcgaacatacgctaaaacacaggctgcaacaagcattacgggtgattgaagcatcatccgaagcatttgcaccatgacattttgaatctgcacaatatcattggttgaccgcgtaattaaagatgaatcgccaaactcatccatttcgcgattcgagaaacgtaaaaccttatgatagatctggcttcgtagcttttcacccaccttcattgattgggtcgccgcaaaataaacatttaatccggcggccactaatccaatcgcagccacaattatcattttaattccttcattccaaattacgcccatatctttttgcacaattccccgattaacaagatcggcggtaactgtcggcaaatataggtcacacgaaacttggattaataaaaagaaaactgcaccaattgttgcccaaaaggctaaattttttcgtgctatccgtatcattgctattcctcttcactttatcgtcaaattttataattgtttggtatctaacttttatatattactctatttaattaaaattgcaattaacctaaatttcaagaataagttagccactggactcaaataaataatactgaccaattgattattggttgatggagctgtgatatctcttggtagaaggccttacgatagatatccattgacgaatgtccattaaacatagctcgtggatagtgattcatccaatcattagtcgctatgatctgagcactactatagttatttatagcttcacctttggtaatctccttgcggagaaaccggttattgatctcattggatccacgttcccaaggggaatacggatcagcatagaaaacatgatcgtgaacttgtgttaactcactaaattctgaaccgttgtcagaggttattgtcttaaagatgcgatagtaagcatctgtgcccattttctggcgtaaatttataaagaactgatttactgcatgcgcagttttaccagcaattttactcgtgatattaactcgtgaaaggcgatcagtcattactagtacaacactgtcattaccgtttttctgtccctgaactgtatctagttcccaatggccaatttcagaccgttggtccgcagtttgaggtcgttgagcaatattaggccctaagcaccttttagcttgcggatgagttcgatgatgcttacgtttaggtttttcaaagaggtctaaattggacgtacgaagcacaccctcattaatctattgatataaagttacaaccgactttgggatcagggtgccatcattcattaaatctcgagccttataaataaccgcttgtggggagtaatggtggtcgtcaaactcaccaagcattagctgatcagctaatcgtaaaaattgctttgaagaataatataagcgacgacgaccagaatggcggtgatgttcaagatatgtggcctgaccagcttcataactatagatgtagtaagaatattcgtaaatcttaccattagatttttgacgacgaagttggcggaccgtaccacggttgagctcgttattaattgtttgatgattaactcctaattggcgaccaattgcgcgattggaaagtccttgcgactttaaagtcgcaatcatcacacgttcttctttagtaagatgagcattctttttatgagtagtcaataaactagtagacatggtatcatttaagtgcgtcatttgacggacatcctttcatataggtttggttcacttaatatgatacctgatgtcacgccgaatggcgttttttatttaccaccaactgggtggctaacttcattctataatccaccaaattgcaattaaaagctttatcacatgctttatttaaaaataataaatttttgttttaaccatattaaaataaaaattttaggctaaaatataagaaggaacatgaagtaaaaagctccagtctgtttatttttaagaaacgaggtttgatattatggctgaaacagatgttaacccagaattagttaaaaaaatcgttaaacaagtattggctcaatctgctaatggaggagatagcaccaaaaaaatttttgcttttagtatccgaaaagatgaagaaccttacgttaaagaatgggctaagaaccatcccgaaatagaagtagaatatacggatgaactcttaactcctgaaactgctgcaaaagctaaaggagctgacggggtagttgtttaccaacaactcgattacacgccagaaacgctacaagcactggctgacgaaggcattacaaagatgtcgctacgtaatgttggtgttgataacattgatatggctaaggcaaaagaacttggctttgaaattaccaatgttcctgtttactcaccaaacgcaattgccgaacatgctgctattcaaacagctcgaattcttcgccaaaccaaggtcttagatgaaaagattgctaatggcgatttacgctgggccccaacaattggtcgagaagtgcgtgaccaaactgttggtgttatcggaactggtcatattgggcgtgtttatatgcaaattatggaaggcttcggtgctaaggtaattgcatatgacccatttgaaaatccagaattaaagaagcaaggatattacgttgacagccttgatgatctatatgctcaagctgatgtgatttctcttcatgtcccggctactaaagaaaacttccatatgattgataaagatgcaatcgctaaaatgaaagataatgttgtaattgttaattgttcacgaggcgcattagttgatactgatgctgtgattgaaggacttgatagtggaaagatctttggctttatcatggatacctacgaagatgaagttggtatctttaacgaagattggcgtggcaaggacttccctgacaagcggcttaaaggtctaattgatcgttcaaatgttcttgttactccacatacagccttctatactactcatgctgtccgcaacatggttcttaatgcctttgacaataaccttaaattaattaatggtgaagaagctgacacaccggttaaagttggctaataattattaatctttcttaaaaagcccgactattagtgcaagactaataatcgagctttttttgttcactaaactagtgccgtttgtaaagcacacgcaagaaggcccccaacaattgggccacacattggaacccatgcataccaccattctgaaacacccttattaggaattggcaaaatagtatatgctaaccgtggtgaccaatcacgagctgggtttaaggcaaagccagtagttgtcccgagacatgtaccaacaactgcaataaccattcctacgataaatggcttcaatccctgtgtaaagttaccaagatttaataagatgaaaataaatgcaaaggtcgcaatcacttctgagaaaaagttaaaaattggactatttatcgctggacgagtagcaaaaataccaacattatttccttcttcttcatttggggttgctttaaattgtggatagaattgaataattactaatactgcaccaacaaacgcaccaagaaattgaccaagtaagtaaggtataacgttactccatgggaataagccaaaaatagcaaaaggaattgttacagcaggatttaagtgccctaatgagcccagaaatcctgcaacataaactcccatcgtaactgctaagccccatgaaatacagataaaccaccagccactttgtttcccataagttttatttaaactattaccagcacaacatcctgctcctaataagatcaaaaccatggtgccaaaaaattcgccaataaatccatgcatgtctaaacaccaacctttttaatttttcttcaaaataaaacctaacatcaagagaataatcaccaagaaaatcccacagtaaatatatctttgcggatgtccttttacgtgtccgtaccgataatcattattataacgttgcatggctcctattattaatccactgattccatttattgttggactaagcgcaaaggacgccgacacttcgcttatttcattattaataaagctaaaaataataaaaaggactccaatcatcaccgttgaaattatcgttgcaagattaattccaactaacatttcatagataatactgttattagctggaaccttaacaagtattcttggcatctcttgccaacttcttgcaataaagaagatgagtaaaaagcaattaccaataataaacggtaaagtccaaccattatgtaattctaaacttggcggaattacaatccctgcagcgcatagaactactattggccaatacatcgaagcaaattttcgacgtgattgcggtcgttccaggagagcaaaaaattgtcccaaaagagcttgtaagaaatttaaaacgataaatatcatgacccatatatttaagtagctaggaattaatactactttaggctgtccccaggccaatacaatcgaaataattaaaacaatagctaacaacaaagcccttggtgcataaggggacagatttcgatatttttctgctcgttgataaattaatatcaggttatacatattcatcactaaaatgacagctgaaaccagtaaagtagagtcctgcaactgatttggggatgggggttctccacctaaaataatatatgctgacattgtacaaagccatcccactgtccacatcaatggaatagttggtgtcaagattaatggctgacgcggcaaccattgttccatgtgaaacacctcctcaatatggtatcttaccataagaaattgctcaaaatctggtaagataaatagtagttagttttaggaggtaaatttttatgtttttaccacaattaggattaaaaggaagcagtcaactagaccaaattgaggatcgcttacagtataatcctactatttatgaattttatactaatgctgatgactttactgatgaaggctaccaacgcctctatgatgctattcaatacgttaaagatgctggaattaaaaatattattctacatcacccaatgaagtttcaggatcatcattcagaagtagtggcccctgaaaaacagtatcctgacctatatcgctttatcgaatttacaactgaaaagctcctttatttagctgatgatcttgatgttcaagttttggttcatggtggttatgctggtcctgagtcacgttactttgtttcactctaccctagtgtagaagacgcccgaaatgctgtttatcagcggttggatcgttttgcagatgctggtggagagcatatcatgtttgaaaactcaattgcgccagtttttgcttatggcgatccccttcaagaagatgaaattcttgcacatgattatcgacttgcctttgatacatcccattgttttattgaacttcatgggaataatcagaaattggccgtatccctagcgcatttaaaagatcgtaccgttcattaccacctagttgattcaatgggcgaaactcatgatagtcttactctcggcaccggtaaaattgactgggctaacgttttgcctcacttaaatccagctgctactagtatttatgaaattaacttacacgatcaaaataattgtcgtgaacaaattgacagtcataattatttagttaaactttaccaaaagcttaataatagaggagtttaatcgtgaagcaatatattaatcaccgtcatatttctttagtattagccctatttatcctctacttagcaatcacttactgggaagttgttgctaaatttatccaaacaattttttcggcaaccatgcctcttttaataggaggaatagtcgcctatatcgttaacctattattaagacagtatgaatacctttactcgcatttatttaagaagccaagtttgcaaaaattcaagcggccagttggaataataatgtcctacttaacaatcctcctaataatcaccatcgtctttgctctggtaattcccgaacttattacgtgtgtaaaactacttattgcaaatcatagtcacattatcaaccattttattgattactttgaacatagcagtgattttaagggcttcatcaatagctttgataccagtaaaattcaatgggataaaattggtaaataccttacatctggtgttggtggaactttccggacggttatttcaacagcctcgtctgtattttcagttgccacaaccgcaattattgcgtttttcttttcaatctacctcttgatttataaagagatgttgcaacgtcaatttactaaattactttcaacatactttagccgataccagacacaaataattaaagttctgaaagtttttgatgaaagttacagtaactatattgttgggcaatgtaaagatgccgctattcttggaatctcgtgttttattgggatgacgatcttacgaatgccatatgcttcaatgatcggagttgtaactgcatttggtgcattaattccaatcattggggcaatccttggagcgagtgtcggagtaattatcattttcgccgtttctccacttcaagccggtattttcttgatctttattattcttcttcaacagttagataaccgcattacctatccactagttgttggaagatcaattggtctcccaagtgtatgggtatttgctgcagttattattggtggaggaatttccggaattcttggaatgatgttcactgttcctttatttgcagccctttataaattgttaagtgctgatgcaagaaacagaataacaattcaaaaaatgagtgaaaaaccgtagcatttttcactcatttttttataagttatctggaacatcagcagcaggttggtccttagttagtcgataaacttgcgatgtatttacaccaaagtactggttaattaacttactcaattcttccatcgcttcattagcgcgttcaatttgttctggattaattgcttccataaccgcaactacattttgagaatcttctgtcaacattgttcgttgagcttcacgccaatttagacaacgacaaacagcaccttcatcgtcataataaataacttcccccgccaaagcaggttcatcttcttcagcaccgactggccgaaatgcttcgccaccttttgcaacaccaagatgaaggttgccagcaatcttatttcgatcttcaatgcccactggaacaccgtagcttaaagaaatactattgtagacatccacaagaggttcaattggttcaaatttccgtccttgattggcacgcttcaataaggcctcaattgatgagcgcgcacctttctttttcttaaattgttgaaatgcttgacgccattgatcaacaactggattcaaacgaaaagtctcattggttagaaacttatcagcctcatgagtagcatttgctaatagtttctttcgttcatcatagttgtcatcagtatcatggttatcaatgccatttgcaaacaagatatttacctgtgcatctggaaaaagttcccaaaaacttggatcaatcgtcacttgcttcataaaaataatctcctctttataaattaatattgacgtttgcccccatgctttacggtatcccaatcgccatcaatattttggcggatacgaactagatagtcatgaacctgctgagcctctttttccgagaagcctttcaatgcctcactatttgaaaattggttttcacgaataataaaaggataaatctcttttcctttttgagtaacataaagtcgtttaattttcttattcgttggatcactttttctttcaataaagccatttttttcaagcttttttacagcacgggcaatcgttgttcggtctacttttatcaagtttgataattgttctgaaataattcctggatgctcataaatacgaacaacatacaggtattgaccacgtgctaagtcgatttgcttgaactcaatattggcaatcgaatcgagtgctcgatcaatcatccctatttcacgtaaaatatcaatcattgataaaaattctccttaactacaatattaagttctttttgttgtaattgcaacaaaataattagctttaattattttccaacggcgcaggctgagcgactttttgcatggctgttaataattgagctgcatccattcgcgataaaactgatttcagtgctaatgtcattaagcgatcattttgtgtattaatcacattattacttggaatttcttctccagctaaaagtgcattcaaaatttcaacaaagcggtcataggcagcttgcgggtaagaattcatagtaacctgagcaattcctgcacgaatatcatccagtgaaaaattcgattttaacaatccaataagcaaaagatctactaattggttaacggcatactttttcttaatcggtgcttgaataactttctttttcacataattatttaccattgattttgtaagtggctcaattcctaaatgatttaattgttcatttacaatcgccaccacctggtcaacatataaacctagtgtaggtaattctttccatcgtggaaaccgcacccgtgctaaattattttgccatcgttgatattcttctaatttatccatatcacaacctgctttcttatggtgcaattccaatcgattgattccgaaaatcatcggtagtaactgcctgttcaattatctgtgctacttgtcctaatccaatctctttaccttctaaaggattgccttcactaacaaccttaagtgaagtttcttcattagtaattggcaaagctctaataatagtatagggcaactcaaattcatcaatcattttaaccgcatattgatgagcaaggacagtctgagttgcctgttgcccataccattcctgtagttgctgatttgtcgcatcatctgctgttcctgcaatcgaaagcattactatttttgacggtaaaaacagtgagtgatcaatcaattcggctaactcttggacttcatcatctacatactcattaacagtgggaagccaacataatatatccccacgctgaatttcaaatttaaaactagtaagagcaactgcttctggaacccttttgataatagttggtactaaatcgtcatgccggtgactaataaaaactatccgacccatcacaacctccaaatctattagtaagccatcaattcatcttcaatcgttgcatcttcaattctgacatcagtaatggtgctttgctctagtaatggcagtaatgtttgaatatttccagtgaaaaggaaacgggtctcattacctgcttcttccaacatgtgtgcccctaactttactgcattgtcgattgggaaaccagttcccattactgtcacagtacaatctactccatcattcatcgacaaatcacgtgcagaagtcaaatgactgccattaaagtaataaagagtatgagcaaaccgcatcaatgttgaaatatttttgcttgtgaaaagcactaaggcatcgaccttttgagcatagtctttaacaaggtgaccaatcatttgccgtttattttcctctaagccatcaaaggcatcattcaaaattacgattggacattgccaagcaaggagaagtgctatccgcagttctagtcgttgtgcctcgtttaatgaagcaatcatttgatcaggttcaaatttcaatgatttaagcatttggagtgcttgttttgacttcaaagcatttttacgatgacgtaatgcgtggtcaacagcttttgccactgtctttccttttaaaaccacatcatcaattcggccgatttcatttttgctttggcgcttatattttttgaatggaaccccgttaattgttacatccccatttaagatttttccacgaacagataataaatcttctaatgcagttgctgcgcctgtatcgttactgcaaattccgactacttgtggtgactttagttctaatgaaacgttatctaattgatctcctgatttagcatcatagactaaatcattaattgtaatactgctcactatataacctcttttcttaagctatctacctttactaatcttatcattttttaggtaatgaacgaaataaacatgtctttctttttaatatgctttaatttataacgacttatttgaatggtaaaataatatacataaattgtacttatcaatcgaaatgaggaatgttattttgaatgagggccaactattcactaattttgtaattataatcattacatttatctttgcggcattttttgtggcagccgaatttgctttagtgcaagcacgggtaacagccctagaagaaatgcaagcaaagcgcgataaaccatctaccaaaataaaccgcgcaatcaaaatggtcaccaatctaacagaatacctttcgaccactcaagtaggagtttcaatttgtggaattattctcggttgggtcggtgaaggaacgattgaagcactcttagctgatgcactttcgttaccaagctggtcactaaacaatagtgtcatccatgttgtaagtgccattgtgggagttcttcttctaacatatttcgaagtagttttaacagagattgtacccaaaaacatcagtattgatattccaattaagaccctgatgttcgttaccaccccactgcactattttcacattactttttatcctttcgtttggttgcttaatagttctgccaacggaattgttaaaatgttaggcatgaagccagctgacgagagccaagacgtcctttcgcaaagtgagattattagcctatctcgaaacgctgttaaaggcggtgaacttgagcacaatgacttgctatatatggaacgagcctttgactttaacgataaggttgctaaagatattatgatcgatcgtactcaattaacagttattgatataaataaaaccgtaaatgacgcgattaaactatatcttaagacgaaatatagccgcttaccggtagttgctgataatgataaggataagattttaggttatgtttttaactacgacctaattcggcaaaagcaaatcaacggagatgtatctttagcaaaagttcttcgccatatgcctactactcctgagactacctcaattaccgaagtccttaagttaatgattagtactcgggtgcccatggtagtcgttgttgatgagtatgggggtactagcggaattattactgacaaggacatttatgaagaactatttggaacagtaagagacgagatcgacaaggtttcagataacatgatttctaaaattgatgaaaatcaataccggattgatggaaaaacgaccatttatgattttgaacgcttcttccatgttgaacttaaagattctgaagatagcgatgtagtaactttatcaggatatgtgttagataattatcataatattcatgaaggagaaacgatcaaactagccaaccttgagttaaaaattcaagattatcgtcattcatatattgatagttttattgttaccactttatcaaagtaaaattttacattttggcagcaataagaaaattatccttttatttaacacttaattctactaaaataattttgtaatattaaagtaaatctaaactagaaggaagaaattcacatggcaccaatgaatattatttatatctcgcttgagggaaatacccgttccttcttaacgcggatgcagggatatgctaaacaacagcacagtattagtgaagattgtccacttattgaattaaaagaagttagcgatcaaacgcttcctgccgatgaaacagaacccttctttgccttcgtacccacatatttaaatggtggtaacggaatcgattctggtttcactgaaattatgacaaatgcattaggtgaatatatttcctacaacgataacgctaaaaaatgtgtcggctttgtaggtagtggtaataagaattttaacgaacaatattgcttaactgctcgtaaatacgcgcgagactttgacgcaccatttctcgcagactatgaattacgaggcacttcacaagatattgagcgaatttatactatcttagctaaacggtggagcgaagttaacgcctaacttctaaaataaaagcgacttggaaatccaagtcgcttttatttttagccttgtttattagcacttatcagccatgttatcccatacttatctacaatctgccccattacattatttaggatccaatcaccaaatggtaccgtcacacgttgattgtctgattttgctaaacgattaaacaaatcacgtgctttatcttcctcttcttcaaaatcgagtaaaattgaaattagtgtagacgtttggggattgcccatcgttgcatctgcacaaataatcttttgtccagcaatcataaattcaccacgcattgttgtctggttcaattgatcaactggtaatccaagactttccgcctgctcttttgtcagagactcgtgatatgtaatctgagcgccaaagtcttgttcataataagccattgcttccttcgcattctcaaatgttaggtatgggtatatagccgtcatagtgttcctccaaaaatattcattgttgattatatattttgaatcgctttccgtcaaactagcttccaattggattagctacttctaaccgtatattaatcataactaaggccccattatgatataattgtctagtctattatcaagctaattttaagatggaaggatgaattttttgaaaaaactcaaaaagcatagtccgcttctaatccttggattattcttccttgggatctgtatgcggatgccgattacagcaataccgtctgtcattaaagatattgcacaaacttttaatgtagaaactactagcttaggaattttaaccactattcccctcctttgttttggattattatcatcagtagtttcagcactcgctcaaaaaattggtaatgaactaacgattgaattagcaatgattttaatgtttattggttcttacctacgaattttaaatttctcctcgttaatgatcggaacaatattagtcggggctgccatcacttgtattaacgtcttattacctgcgattatttctgacaaacttcctaatcaaattggaagtgtgaccgggatgtataatgtcgcgatgactttatttgctgcaattggtgcttacgcaattactccaatcacccatgctactagttggcaaaccgctgttatcattattagtattgttgctttaattgcagcaattatctgggtaccaaacttacgctataatcaacgtgccactaaagaaagcagttctactgagcgtggaactaacatgtggaaaaatgcaaatgcatggtggttactcttattcttcgggggacaatgtttcgtattctatagtatcgttgcctggttacctacaattgccatggacgctggattaagcagtgataatgcaagtttagttgctggattactacagctattatcaatgccattcgcctttgtaatcccagtgattgccactaagatgaaaaatcggcaaccaattatgctatttgcaggaatcatttctttaattggaactggaatgatgttcttccctgtaaattctcttgtttactatatatttgttgccctatttcttggtgccggtacaactactactttcgttcttgcaatgaccttgttcggactaaagactaagagttctgccgatacccgaaacctttctggaatggtccaatcagtaggatacttaatttctgcattaggtcctatcgttgttggaaacctttattcacaaacacataattggtttgcaagtttaatcgtgattgctattgcagctatcttcttcacagtctgtggtgtaatagcagaacgtaaacaatttgtttaagatatctttcaaagctgcggaatttttcccagcttttttagttagttttgttttcataagctataattttaaccgattccaaatttcttttaaaagtttttttgatctagaccattaattgataaacgcttaccaaagactaatcaacaagccatttagcggtagtggtccattttaactttctaagacatcttctcagaaaacgtttcctttgatagtgcagattgtgctttaagagtatataattgtcacggtataagaattttctgaaatttcagaaggagtgaacattttggctacagaaaataaggctgtcattacattatttggtgcgactggtgaccttgcaaagcgtaaactttatactgctttgttcaagttatatcaaaagggttacctagctgaccattttgcattactaggaacctcccgtcgtccattgactgacgaagaattccaacaaatcgttcgtgaatctattagcaatattccagaaactgaggatggccaagcagaagcattctcaaaacactttttctacaagtcacatgatgttactaaaccagaacattacgaaatccttaagcaacgccttgccgaattagatgaacaatttggcgctgaaggcaaccgtctcttctacatgtcaatggcaccacaattcttcggtactattgcattgaacttgaagaagcaaggattattaactgacaatggctttaaccgtcttgttattgaaaagccatttggtcgtgactttgaatctgctaagaagcttaacgatgaattatcacaaacatttagtgaaaatcaaattttccggattgaccactaccttggtaaggaaatggttcaaaacattcaagcattacgttttggtaacaccatgattgaatcactctggaataatcgttacattgataacatccaagtaactttaagtgaaaagcttggtgttgaagaacgtgccggttactatgaccaatctggtgcattacgtgatatggtgcaaaaccacatcatgcaaatcgttgctcaattagcaatggaacaaccagttgcatttactgatgctgatgttcgagttgaaaaaattaaggctcttcgtagtcttcgcctctacacaccatcagaagcagctgctaactttgtccgtggacaatatgatgctggagaaggaactaacgcttaccgtcatgaagatggtgttgatccagaatctggtactgaaacctttgttgctgctaagttaatgtttgataactatcgttggtctggtgtaccattctacgttcggactggtaagaagttagcagacaagtttactcgtattgatgttgtcttcaagaagccattaatcgatatctttgctaacccacgttctgaaagtgaccaatcccttaactcaaacgtattaactatttttgttgaacctaactcaggttttgcaatccaattaaatgctaagcgcgcaggtcaaggcttcacaacagaacctgttgatttacgcttcttgcaaagtgattctgataagaaggaatctccagaaccatatgaacgtcttttccatgatgcacttgaaggtgaccacacaaactttgcctcatgggctgaaattgcttatgcatggaagttcgtcgatgttatccgtaagctttgggatattgaaaagcctcaattccctaactacactcctggttccatgggtccagcagcttctgacgaactcttggctcgtgatggacgtaagtgggtttatcgtttaaatcattagttaataaaagtaatttatagcattcttgctgtaaattatttttttataataaaaattgatatttagcgtttgcactatctttaatttttgttataatcgaggttgtgaattatattacataagtattgaggagagtgactttaatgtctgatcaaaaagcacaaattggtgttgttggtttagctgttatgggtaagaaccttgcactaaacatcgaaagtcgtggcttcacggttggtgtatacaaccgtcaccgtaaccgtactgacgatatgatgcgtgaccacagcgataagaagttagtacctagctacactgttaaggaattcgtagactcactagaaaagcctcgtcggattcttatgatggttaaggccggtaagccaactgatgctcttatcgacgaattattgccattacttgacaagggtgatgttttaatcgatggtggtaacactaacttccacgatactatggctcgtaacgctaagttagacaagtctggtatcaacttcatcggaatgggtgtttccggtggtgaattaggtgcccttcacggtccttcacttatgccaggtggtcaaaaagaagcttatgacttagttgctccaatccttactaagattgctgctaaggctgaagaagatggcaagccatgtgttgcttacattggaccaaatggtgctggtcactatgttaagatggttcacaacggtatcgaatacggtgatgaagaattaatcgacgaaagttacaacatcatgcgtaacgtattaaagatgcctgttgatgacattgctaagacctttgctgaatggaacaagggtgaattaagcagttaccttgttgatattactgctgatatccttactcgtaaggatgaccttggtgacgacaagaacaagcctattgttgacatgatccttgaccgtggtgctaacaagggtactggtaagtggagttcaatgactgcccttgatggtggtgctcctcaatcagttattacagaagctgtttacgctcgttacatttcaatgatgaaggacgaacgtgtacaagcaagcaaggaattgcctgttgaaactgaagctatttcaatcgacgacaagaaggaaatgattgaaaaggtacgtcaagctctttacttcggtaagcttatgagttacgcacaaggtttcgaacaaatgcggatcgactccgaacgttacgactggaaccttaagtatggtgaattggctcaaatttggcgtgcaggatgcattattcgtgcacaattcttacaaaacattactgatgccttcactaagaacccagacttgaagaacttgcttcttgatgattacttcaaggatattgctaagaagtaccaaaaggcaactcgtgacgttgttactcttgctgttaaggctggtattcctgttccttcacttagtgctgctatcagttactacgactcataccgttcagaagtgcttcctgctaacttgcttcaagctcaacgtgattacttcggtgctcacacttacgaacgtactgaccgtcctggtaacttccactacagctggtacgaagaacaataatcaaataaattttgatttaacgactgagatctattctcggtcgttttttattttaaatttcttaacaagaaaatagaaacgtggtttgattagcatagaggtgagtataatgaataaaacatttatgagcggctattaccaaggtgtcatcgaaacagcccctactactctttcggctgctaaaacagaacagttagcaattacgatgacaatcctccatttacgtcatgctggaataaacattacatcaatccatgattttcttgtcaacgatcttcatgcaaatgaacgccttgtaaataagtatattaatttaaatgctgatgggttagaaactattcaggcccaagttatagcaatcgctttcaaccaataattattttgatattacttcctttttcgtaaaactttactaaaattgcattgactttttctatgaaaacgcttaccattattcgtgtaagatattattatatgttgttgtagaaaaggggagttaacatgaatacaaaaatcgatactgcaaaaagtaaacagcatgttgcccgttcccgttttgcctattcaatgggagccttcgggcatgatgtcttttatgctttactttcaacgtatttcattatgtatgttactggacacttattcaattctagtaacaaagcattcaacaatcacatggttctatgggttacatcaattatcgctgtattacgaattgtggagttgttagttgacccattaattggaaacgcaattgatcgtactaacacacgttggggtaaatttaagccgtgggttgtcggtggtggaatcatttcagcaattattttagccatcttattcaccccaatgggcggtttaagtctttctaatccttacctatacctattgatctttgctattttatatatcattatggatatcttctattcatttaatgatgttgccttttggtcaatgattcctgcgctatcatttgattcacatgaacgtgataaaatagctacttttgcgcgggttggttctactgttggaggaaatattgttggttttgttattatgccaatggttttattcttctcagcaaatcaaaatggcggtaccggtgatgatcgtggttggtttatttttgctgcaattgccgctgctgttgctgctattactgctgttggtgtcgggcttggtactcatgaagaaaagtcattgcttcgtgaaaacaaagaacaaactaaactaaaagacgtttataaaattcttgtcaaaaatgaccaattattcgctatagctctctcatatctattctatacaacaggaatcacattagttaacagtatggagctttactactttacttatattttaggtgattcaaaggctttctctattctaggtggattaaacactgttattggtgttatttcagttcttactttccctctctttactggtaaaattagtcggcgtaaattattttacgggtcagtttcagtacttttccttggcttattaatctttgcatttgctggtaaatcactcattttagttttagttggtgcagaattattcttcattccacaaccattagtatttttagttgttttaatgactattactgattctgttgaatatggtcaattaaaattaggacaccgtgacgaatcacttacattatcagttcgtccactgctagataagttcgctggtgctgtttctggatggattattggaccaactactattattgctggaatgactgctggtgccactgcagcaacagttactgctgcaggtgctgctaagtttaagctagtaatgttcctagcccctgctatcttgatcctcattagtgtatttatctttgcaaaaaaggttaaacttgatgaaaagatgcacgccaagatcgttgctgaacttgaaaagacttggggagatcaccttgaagatgctgacagcgacaaccctcaaacagtatctgtttctaccccacaacctggcgttactgatattacatcaccagttgccggtacacttgttaacttaaaagacgttaacgatgaaaactttgcttctgggaacatgggtaaaggattcgctataaaaccatctgatggtaaagtaattgctccatttagcggaacagtacgagcaactttctctactcgtcacgcaatcgggcttgaatctgacaatggtattatgttactgatccacgttggtattgatactgttaagcttcgtggtactggattcattagttactttgataaggatcaacactttaacaaaggtgacgaattaatggaattctgggacccggcaatcaagaaagctggccttgatgatactgtcatggtaacagttactaacagtaaagacttcgatattaaattattgaaagatgctggtgaaaaggtaactactattgatatcgtcatggaagttactaaaaagtaattaaatatcttctctgttaaaaaagaggctggaaaaataatccaacctctttaccattttaaagtataaactgccagaacgcagtagctggctggattctgaacgttgataaatcaacgtccagaacacctagccatccttgcgggggggtgggactaaactcgcaagcgagtttagtcccactcctttttaatctacatattttattctaaatcttgttaatgttacggcattaatcaacgttacagcagtcataataataaccacaggcgtaaacgctgaataaaaccaggaaattccaaaaccggcaattgttgaaacattgaactactcccacttagctaaacctacggtttaatgcttgaagtgggagattctggaaacatcgcatacttaccctaccgattctgaacgaaccttcaagcagaggttacgactattagccaaggctcgtcccgagcctaactttatctatcggatagctaatcctttttgcaagatgacttgtgcagcgttaatatcacgatctaaatgtttaccacagtttggacaatcccactcacgtaccgctaaccattccgatttattcaatcctaaccgatgattattcttcccacaattagcacaaatttggctagtatatgacggattgacctgaataagctttttaccgtaccagtcacacttatattgcaacatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgtcgatacttcgccaccataatacgagctttctgataattcttaaaatcatctaattgtcgtggaactaacactttattatgatgatcccaggcgatttcctgctgagcctttaagaaccgacgactacgtaatttctcccaacgatacaactttttatggtatttgtcttcaaaatgattgatcggttccttgcatccatctgaaagattaagtaatgacttaagtcctaaatcgccaccaatatatttacttgttttaggaagagtttggttttcgctttccactaaaacaataatgtaatattgaccagcaacgttcagacgaacagtgacattcttaattttacccattggcaatcgaccagctctaaaatagacgataccgagttttggtaactttatatgatggcaatctaaaactttaatattgccattaacgtactttgaattgtagctctgagaatattttttggatttaaattgagggaatttattttgacctttaaaaaagcgttgaaaagcatcggctaaattgcgattagcactttgcaaagcagttgattctgcttgtttcaaccaaggatactcaaccttaagttgtttcaacagattattcatcccaaaggcattcacaaatttagcttccggattattcttgcgccgttcaatttgcatattaagcatttgattccatacaaaacgaacacaaccgaaggtttgccagagctgatttcgttgtgctgaatttggatagatgcgcattttaacggcttttagaaccattattttctcccttgactttcaatatatcgttttacaacttctaaaggcgctccaccagtgctaattaagcaatagctttgtgtccaaaaggctgatttccaaagatattgcttgatttctggaaattgttttttgaccattctggagctagacgatttgtaagcatttaaaaatttagccatttccgtatgaggcgttgctctaaacaaaacatgtacgtggtcctgatcataattccattcttgcaaattgatgccgtacgcttgtcccacaactacaaaacgatgtttaagatattcagatatttcatcgttaattacttttcgacgatacttaaccaccattaccaaatgataattaagtaagtatactgaatgctgatttctatctaattctattgttatcaccccattttatagatatatactaaatatatcatagaacaaaagaaaaagcactaacgtactttaagagagcgattcatcccctacttatagaagtggggtattctcgcaaatttatggataaaaatacttacaacggttttatttacttttaccttattgtaatagttagcaattgcaaggccaatataaagcaaggcaaaacccaggtacatgcaggttcccgcaaatcgcggatgtgcctctgcatcatcaatgaatttcattgccacagttattaggctaagaccaaataaaataaagtaatgaagatagatcattaaatttcctgtctcatggcgttgatgttcattaattaaatgatcaaattcaacaatgtaggtaaagaatagcgctgcaactgtggtaagtataagaatagactgaattgaaaagctggtggcagtaaagtaatcagcaataccgacaatcgtctcaccaaacatcacgataattaatgccgtaagccgttctagcaagtgcgaaaagatgataggatgatgctttgtatattttccggtaaagccaggcgcaatccaactgataataataccagcaaaagcaatcctcactctaactcggctttgataaaaaatcccaccaataaaaagcgtaacggtcctaaaaattaaaattccagcaaatgctcgtgtaatctgtttatctatcttcttttctgcctaaaagtaaactaaaacatattggatacataacgttaatgatagcaatcctgcagctatgaaaaaaattgctaaatgccagtcaaatgttgttgaaaacgaatttgacatatagagaagaattgccatatcgacgaacgaaaagataacatttgttcctgaaatctttccatgccgatttgtaaaaaccatctggaccatccaggaattaataaatacaatcacgacaattgcaaagattcctaaaaccggcaatcccacaatcccattgtgcaaatggtgaatcatttctgttgctcggaaaaccatgtaaacgaacactaaatcgtaaaataattctatcaaggaaactcgcttagtaatttcatctgccacgataacacactttcttttttataaaaaaagagttaatggtaatatttaccactaaccctcattgataatattcaatgactatttaacctgatctacatcagttcggacaactaacacatcaacaggcgcattacgctttacatatgacgtaactgaacccattacagctcgttgcatccgtgataatccactagcaccaataataatcatgtcgttgtggtgatcacgagggaagtcaaatgaaataattgtctttggattaccaagacggatatgaatgtcaagattgtcaaaaccatccttatccttggcagtcttcaacaattcatcaaggtattgctttgacttatcaactaactggtaagcaatacttccatctgacataccagcaaagttataagccattgctcgtgtatcaattacgtttaaaatatctatatgggcaccattacgctttgcaattgcgattgcacgatgcaatgcaaattctgattcctgagagccatcaactggaactaggatgttttgatattcttgatccataggtttgaacctccaaacaaacaagtaatatatttacttaaattataccatttttttaaagaataaagcgaaggaaaccagaataatactgacctcagataaaattccaaatttcctaaaatttagactatacattaatctttaattagagtaatcttaatatatccaatatacctttaatatttgaaagtgaggccgcatcttatggacaagatcgataggaagattattaaccttcttcaaaaaaacgcccgtgcttctttaaaagaactctctaaagaatgttttatttcatcaccagcaattgcggcgcgaattaataaacttgaacgaaatgggattattactggctaccatacaagtgttaacatggaaaaaatcaactttcatgttaaagcttttattcaggtgcaacttgagcctcgccaaaaacaagaattttacccttacattcaacaaattcccaatgtgattgaatgtaactgtgtaactggtgattattcagaaattatggaagttgtttttccttctaccaccgatttagataacttcatcaataatattcaacaacgttttggaaagacaagtacacaaatcgtatttagtacaagcgttgaccaccgaggagttaagctagcaccagcccaagataccgttagttcagaaaaagagtaaacataaaagcgaaggtgaggatttccccatcttcgcttttatgtttatttaattttattcagcttcaacgtcagtttctgttgatggtttttcctttccgtaattatctaaatatgcattatatttttcacggtcaagagtaccttcagattcaccgataacaagtgtggcaattgaattaccaaccacgtttacggcagttcgtcccatatcaacgaaacgatcaattccggcaatgaaagtcaaaccagccattggaaccccaattgtagaaacactagcaagcaatacaacaaaagaagctcctggaaccccagccattcctttactagtaatcatcaaaacaaccagcagagtaatttggtgagaaatactaagatgaagtccatatgcttgtgctaagaagatcgctgctaatgattgataaattgcagatccatcaagattaaaagtataaccagttggaataacaaaagctgtaatacccttgcttactcccatctcgtgcgtctttttcatcaaacgaggcaacgtaacttctgaactggcagtagtaaatgccaaaacaatctcatcaaggatagcgcgcatcgtcttccaataacgtaaatgaaaaatatgagcagtaataccgaggacaacaataataaagattaacattgtcacatacgcaatcacaataaataatcctaatggcagcagagcactaatacccatttcggcgattgtcattccaattaaaccaaagaccccaattggtgcaaacttcataacccaattagtaactttgaacataacttctgaaactgcatttaatacatcaattaaaattttagccttttccccaacagctgcaattcctaatccgaaaagaactgagaacaggataacaggcatcatgtcaccatcagacatggatttaaaaatgttcgttggaataatcgacaaaattaatggccagaatccgctactatgttctgcagattttgcagtggacatgtattgcgaaatatcagttgcatgaagtttatgaatatcaataaacgaacctggatgggtaatgttagccattacgatccctaaaattaacgcaattgtggttaaaacttcaaaataaattaatgtttttccaccaatccgtcctaactttctaatatcaccaatattagcaattcccacagtcaagcaagaaacaacaattggcattacgatcatttgaatcagccggataaagattgtccctaagctctgcataacagtgatggcacccttattttgatagaaaattaatccacaaataataccaagggccagcccaatcataatttgccagcccatactgaggcgtccgaaacgatatcgcttcactttatatcaatctcccttatgtagtcttattatactttagcacatttttagtaagattttagcaatttttaagattttatttaattaaatccgaacactttttgctctttctaggtattttattcacttcaatataataattctaatttataattcgtaattttcactaaagaaaaataagaccgctactaagtatttctctaatatgatagagtgtttagagaatatttaattgaacaggagtaatttatgaacgcttggataacggaatttattaatcagtttggttattttgcaattgccttactaattgcccttgaaaatgtctttccaccgctaccatccgaaattatccttacaatgagcggattcatgacgaccaccacctctttatcaattgttggagtaattatcgccgcgacaattggctcacttatcggggcacttattttatatgctctcggccgccagttaactgttaaccgccttgaactccttcttagtcatcgtttatttaaacttctaggctttcatcaagatgatgctaaaaaagcagtcgattggtttaataaacatgggacaggcggcattctctatggccgctgcattcccgttatccgcagtttaatctctattcctgcagggatcgcgcaaacttcattaggaaaattttgccttctcactactatcgggagcaccatctggaacacactgcttgttgttcttggcgcttgggtcggccaatcatggaataaaattgtcattatcttcaacgattacacgactgttgctattatcattatggcgatcgttggtttatactttgcttatcggtggtatcaaaaaagaattaagaaataaaatgattcagtttcaattagtaaaagcaataacgccattactatcaaaactgaatcatttttcatatgctatcgggttgtttgccgtttgatcaagtgagttccgacaactgtcttgcatgggtcattattcggattttgcagccgtttaatcatcatatcaactgcggcatgtgccatttcatcagtggcaatgtgtactgctgacatacttggataaacgtacttaacgattgccgtatcgttaaaactaatcaaggcgattcgatttggaacgttaattttggcttcttgaatcgctttaagcgcgccaactgccatcggatcatttgctacaaagattccatgcggcatacggtcaccaagcgtcgcaattgcctttttcatcgcgttatatcctgacatcgaggtgtagtcgccagcaaatataaattctggatgataaaggttttgttgacgtaagttactttcaaaatagaatcgccgcaaatcaggaacaatttgttgatccgttgtcttttcagttcctgccaacataccaatatcgttaattccttcgctaacaaattctgaaataactgaccgcactgcattttcaaagtccggtactaagcaatcgtaaccggcagccaaactatcgtaatcaacaaacacaatattagaagttactaaccgcaatgcttgaacttgcgaatcactaaattttccaatcgcgatgatgcccgtaacatcacgaggaatctcttccatattgttttggtaaacgggaacagtctgtagtccctgttgttgcgctgctcgttcgattcccatccgaattgccatgtaatacaggtcatctaattcttgtgtaagagaataccattgaacaacagctactcgttgtacttggttattacgtgctcgcttatgcttagtatagttaaactcttcggcagtggctaacactcgctgacgtgtcttttcatttacagaaagtgtcacatcattatttaaaattcgcgatacagtcgcaatagatacccctgctttatccgcgatatcatgtaatgttactgccatactgcttcagcgcccctttcttcattttaggttaaaactattttaaagcatcaacgaatcgttgccaaccttcatttccagctgtgtcatccttaaagactcccgcattttccaaaacattggcaaagacattagcaagttcttgttccataacctcatcgacattatcctcggtgatattaatccttgactgaacttcttttgcccatagaagatgactatctgcaatcttattttcagcaccaagccaaaacttcttgacttcatttaactcatccttaagccgcgctggtaaaatagcacgacccatcacttcaatcaaaccgatattttcctttttaatgtgccatagcttttcatgtggatggaagattccgagtggatattcatcattagtattattatcccgcaaaactaaatcaagaacaaacttatcgccttcccgatgcataattggggtaacagtatgatgacgaagttcaccatcaaaagccttaatatcaagactttcatcactgtattgatcccataccttaataatatgtgtgccaagatcaattagttgctcagtatcggtactagttaaacgaatatcactcattggccagttaacgattcctgcattaacagctggatattcatcaaagtacaattctttcttaatagaggctttcatcattgggaaaatatgcttaccaccttggtagtgttcatgagcaagcattgatccaccaacgattggtaaatccgcattgcttccaacgaaataagctgggaattgcttttcaatttcaactaagttaattaaagtttgccgattaatctccattggctcatgcttactatcaaggaagatacagtgttcgtggaagtaagcatatggagaatactggaatccccattgttgcccccctactgtaattcgaataatacggtggttgcttcgtgctgcctgtccaagacgtcccttgtaaccctcattttccatgcaaagagcacattgtgggtacttcttagcggtatcatgagcagccgctgcaattgctttgggatccttttctggctttgaaagattgatggtaatttcaagattgccgtacttagttggtttatcaaagacaacattcttcttgatagcagctgctttaacatagtcgttgctagtacataagttatagaaccaatcagtcgcacttgatggagattgttggtacttttcccagaatttatgattaactactgatggcgttggggtcatcaaatcataaagctgatcgtttaaaatttccttagcagtttgaccatcatcaattttcccgcgtttaacagctaaatcaacaagttgactaacaacagattcatcatctttagcttcaacatcttcatcatcaacaaagccccgaatcttgtttaagacatagatccggtcgagtggttcataagttccactagcaatcacttggtcagcaaacttttccattaacttcattttctcattcccccactaaaatactattaaagcttatgtggtccatcaacaacttcagcatcatagaaactggcatcgtaaccaatcttgtcccggtagatctttccaacattctttttgaagttttctgcttctgacttcttaacaatggcaatcgcactgccggcaaatccaccgccgaccattcgagcaccaaggcagcctggttgaccccatgcattttctgctaaggtatcaagttctttaccagtcacttcataatcatatttaagtgatacatgagaggcattgatcagacggcctaattcttcaagatcgcccttttccattgcatcaatggctttctttgtccgttcattttcactaactgcatgacgggcacgacgaatcagcgtgtcatcatcaattaagtaggtgtattgatcaaatgtatcggagtctagttcaccaagtttgttaatattaagcttcttgttaagacgtttaactgcttcttcacattcttggacccgttcgttgtatttggaaccagctaaggagtggttcttattagtactcatgataatgatttcataatcgccaagttcaagtggcaaatacttatattcaagagtgttgcagtcaagataaattgcgttattttctttacccattccgacagcaaattggtccatgattccggaattaagaccaacgaaatcattttcagtcttttggccaagtttaactaattcaatttcatcaatatcaagattaaattcatccttcaagatatttcccatcaacatttcaattgatgctgatgatgataagcctgaaccataaggaagaaaaccgtggatgtataaattaaatccgtgatcaatcttgaagccccgttgctttagataaaccagcatccccttaaagtagttaacccacttttcatctttagcactttgcggttctgtatcattaatgtcaaaagtaataatcttactgtcttcttcttttgctgaattagctgagtaaatggcgactgttgtgtcctcacgcggtccatataccccataggtcccaatactgattgcacatggaaaaacatgaccaccattataatcagtatgttccccgatcacattaatccgtcctggtgagaaaaatacatccttccccggttccttaaatacatcttggtattcagctaaaaattgttgcttatccatcagaataacctccatacatcaaacaaacattagtaaacttttactaaatataatttactactttttaaccatctcgtcaataagcgcttacaaataattcaacacacctaagaaaacggttacaaaggataagggatgatatacataatttcttctttaatgctacactagtcataaataattggaggatttaaatgaagaactaccaaccaactgatctaattaaatttgcttcacgtactggacgctggaccgttaaaaagattaataatatgcccaccttatacaccactaaccttggaagctaccttcgttttaaggtttcaaatgctaaaaaatgtcaaattactgttttgccaaatcaaaattccctatctcctagccaagtgtttgcatttcgaattgatggcggaaagtggcaacgggcacaagctagcttagaaaaatttgatattccacttgattcgatattacataccatcgaaataatggcagccggtaattccgacattgacgaagtgtggaaaggtaatgaaggctttgcaattaaaaacatttatcttgataacggcgcaattatggcagccccgcagcgtcctgtggtcaactttatcggtgattcaattacggccggttgttgggtagttggcaatcatcctgctgctgactaccgaccagaaactaactatgcgggaatttgtgcagatctgcttaatgtcgatagtgttcgaatagcctactctgctgggggagtgttaagacctgctactggcggggtcccaactgccgatgtctttttaggaaaaattgacaatcagacattatggacgcctaatcaccctgatctcaacgtgattaatttaggcgttaatgaccgtcgtttccctctaactcaatttattgccgctttcgatctttttatccagcaagttaagctaacttttcctcatgctcccttagcaatcatgattccttttagtcagacctttgcttctgcgatccgcacaattgccactaaacataactgttcgataattgaaactaaaacttggcaccatagctttactgatgggctccatcctgaccaagcgggcgctattactgaaggaaaaatgcttgcacaagctttacaacctcttttatctcaattcagtgtacaatagtagtaagagttaatacgaggaggattctcatggctaaccaacgcttacttccaataaagaatgggtacaactttcgtgatcttggaggttatcccacagcagatggtcatcaaataaaatggcatcgtcttattcggactggttcacttgctcatttagatcaaaatgatctcaccgttttagataatattcctatttcgctcgatattgacctccgtgctcccgacgaagtaaagaaagatcctgatcgagtgccttcccaagcaaaatattatcatttacctgttttcgaagccgacgaaacagacgcctcgcatagtgatgaggaaatcgccgcacagatgcaacagccaggaaacggttatcaccatatgattgatgtttatcaccgaatgaccacggctgcttcagctaagcaggcttaccagaaattatttaatctcttattgaataatgaacgcggtgccttgctatttcattgtactgctggtaaagatcggacaggaatggctgcttatctcatcctcagtgcccttggcgttgagcaaaagattattatggaagattacctgctaacgaatactgttactcaggattttcgtaatcactggctgcaagatatgcggaatcatggagccagcgaggcactagtgacaaatcgggctgcccttgcctcagtagctcctgattacttaaatacagcaatcaaaaatattatccagacttatggaaatattaatcagtatctcaacaactaccttgatattactcctaccgaaataaaagatttacgaaaattgtatttagattaggctcgattataattgtcttataaggaggaatttttatgcaaatctcagtaccattagttaatgggatgttagcagatgaatatggtaaatatgcgccagcagctgatatgctagctgaccatccaattaagtcatttccaattaaaattaccgacgcaccagcagatacaaagacatttgcactcgtctttatcgattatgactcaacccctgtctgtggcttcacttggatccactggttagccgccaacattccagcaacgttaacagatatccctgcaaatgctagtcgagaattagcggataaatttgtgcaggggaataatagcaatgccggctcgttggttaatggaaacccattgattactagtggttatgtgggtccacaacctcccgacaaaactcatgattatactttaatggtgtttgcgttagacgatactctacccttagaaaataaatactggctcaatgacttcatccacgcagccaaggatcatattctagcaaaagcacaaattgatttgccaagtcgtgcatgaggaggaacttatagaggaggaacttataatggaaacaagaattttctttaatccaggcgattcagtcgctaatattcatgactataatgaagctgttcgaaagggacaaatttttaaacaagcacgtcacaatgacgaacttgtcatcgccaaagatcctaacgataaagaatacgcaattttttacgctaaggatgccttaccagctgagcacgaaaaatcaaagccctacgaaattaaaaatcggctttaaaatagaaaatgactcgcggaaatttccacgggtcattttctatttcgataaaaagcttaacgaccaccaacaattttggctgtcgcattttcaagccgttcaattaatgaatcagcatcgttcttaaagtcatcaacaaatgagctcgattgtggttgaatgcgtcctacttcatcacccataatatccgtaacgactaggtcatccccatcccacttcacatcatcataatgaccttcaagagcttcatcaaaaaatgcttggagtatatcccgaacagcattttgaataacagtcttttcgtcaacttgctcaccacgtacctgatgttgagccagctgcattgctacttcttccatattttctggaatttcaacgctcattgtggattcctcctcttaaaaaattaatggcgacgtaatttccgccgagcctttttactaaacttgattccttgaagggacttctttttccgctttaattgtgaatcaattttgttatcgctactcttagccacttgttgcttttgttgcatttcgcgttgacgcttgagcaggcgtttacgttcatattcgccccatggattcaagaggccacgcataaagtcagcaacttcctgcttatgttcgtccatccacgcttctgctacatctgcatcatcagtatcgataccattactattgatgaatgataaaactaattgagtttcacgctcatcacgatttaatgaggcaagcatgtcttctgatggttgcatattagcaattgcctttaagcccaacttgtattgatccatgttgatgtaatcattttgcttcaagtattcaaacaaggcctgcgcgctcggtacgatgttgtgaatttgcttaattgaaatatgtggatctaatggcatcatcatgcccaatacgcgttgcaagttgctgaaagtccattgacctggatattcattgcattcttgtaccattaattccaagaactcttgcacaacatagttcaactcaacatcatctaattcaagattattgaattgggaagcagacttaatagcttgttgcacatttgctaataagtccttgaacttctcaggtgtccatgtaatttcttttttagcaggacttgcttgaaccgaggttgcttctgcttcgtcattttccgcatccccatgtaattgggcccatgtcttatgtgctttccgacactcgttcatctttgtccgttgttcttccattgcttttacaacttccgcaagattttcaactttcaaaaattcttgataagctcgcaaaactggaacaaccgcaattccaaattgattagttagtgctggatcagcgatgaattccccgaccatgaccgcttttactgcttctggtgtccaagtagtatcggtcaaatgctgatcatttgccatctggttattaaaacgcgtcaaaatatcctgtgcatgcttttgctgattagcagataactgatgatagttggacgaagtaagaaactggtcaatatgttgttcttgttcgttcattatctatatatcctccgtctccaaattgaattttcctttctatcatatcataattatatctagtaaatataacaagattgctaatatacaaggagaaactataccaatgcaacgaaaaaagatccaagaagcaatgaaaaatgtctattttcaaaaaatgactgcaaatggctatcatgaaattgaagaacaaattgcaaaattacaacagcaaagacctgcaaaaattggacaattaaaagcagcccgtgcgcttggtgacttatccgaaaatacagaatatagtactgctaagcgtgaattacgccaccttgagagcaggcttcggtacctcaataaacagcttcaatatgctgaaattgtgacccccaagaatgatcacactattgatttagggacaaccgtgataattgaatttgaggatgaccatgaacaagaaacttatcatattgtgggaaagcaggaagctgatcttgccaaacaaaaaatctcctttgattctccccttggtcaagcccttcttcacaaaacagctgggaccactgtaactgttgaagcgccgcaatcttcatataaagttaaaattgttaaaattgaattatagtattgataagtcattcgatatttcgtaatccgctaaaggaaatttttaaatttattattttcaacgatagggttaattttccgcccttcaattaatctaagcgactgattaaataaacttttgggtattgcatccctgattttgacccggtatactattaaacgttgcttttttacatccacaatatcttgtggttactagccggcagtaaccacaaaattgcacaacatatagtagagggagttagattaatgattagcgattattttaaatttcttgcccaccaattaaagggctggccacaacaaaattattacctattctttttcagtcttggctgtcaggtaatgactttagttagtgctccaataacgcgggtaactgtcattacatttattggaaccacgcttggagtactttgcgttttagcaattaatgctgctaagtcggtaaatggtttcttaggtattttatcggcattatgtttcatcattgctggttttagtgctaaaaattatttaagtattgccgaacaaatcgcctatgttattaccctcgatttaccagtattactttccgcaaattggaatgttaacatggcatcaaagatccgtaaattcaatgctcgttcatggacggttgccatcattgcaacaattattgtctatctcgtttctggttatttaatcggtcatcttactgacgatccacgaccatggattgatgcaatcagcttttctattagtctttccgctggtgttatttgcttcttgcgttttaacaatcaatatttctggtggcttgcatctggtcttgcacaactagtactctggtttgtttcttacaagcaaggatctgctactttagcaatggccgttaatagctcgatttaccttattaatgatgttctcgcctttaccatttcaccatggtacaacgaacgtgaacgtcaacgtctcagtaaagaagaagcagcctatgccaaagcaatgggcttagaataaatctaaaaacagcaaagagattgaaaattcagtcaatttgctgttttttgtttaatattgtttattgtattcataaactaattctggttcacgaccagtacgatgataagcatttaatgcatctatctgtgccatttcttgggcgttaagttcaaaattgtaaatatcagcgttttgggcaattctctcttcatgaactgacttgggaataaaagaaacaccattctggagatgccaccgcagtataatttgcgcagtagatttattatgagcagcagcaatatcttttaatactggttcattgagaactgctcctcgccctaatggactccaggcttgcgttactatttgatgttgacgattaaattctaatagtggtttttgtgttaatagcggatgcaactcaatttgatcaacaactggcatttcatttgcttgggttgccaaatattgaagatgaatcatttggtaattacttacaccaattgacctagtaagcccttcctttttcatttcttcaaaagctcgccaggtgtcaaaaaatgatcgttcaattggccagtgaacaagcaacaaatcaacgtaatccatttgtaatttacgtaaggattctttgacagattcaatggccttatcgtaaccttgattttcttctgccactttagttgtcacaaaaatattatcgcgcggaatggctaattgcttaaaagccgtccccacttcttgctcatttccgtataactgagccgtatcaaaaagccgatacccatcttcatatgcctttttgactgcttgattcattgtcgcttggccatctaccttataaaggccaaaaccttcttgaggcatttcatttccatcggcaagagttaataggttgtccttaatatccattgaaaatcacttcctttccttatctttaatcagtaactgaggattgtcaatatcgaaattttcctttctgaacaaactaatgtatgatgagtttaaatctatttacggggaaacaattatggctaaaatatttatcgctgaagataatcctgatattatccattccacaactcaagaattaaataaatggcaacacgatgttatcacagttaacgactggaaaaacgttgcaaatgaaattcttgctacaagcccagatctggtcttatttgatattaccctcccgacgttcgatggcttttattggattcaagaggttcgtaaacatagtcaagtgccgattatagttatttctgcggctgaaattgataccaatgtcatgcatgcagtggccgcgggggcagatgattatattatgaagccatttgcgatgacggtgcttttagctaaaattcaagctttattacggcggaataagcaaacgactgacgcagaagaaataatgtgggatcataattcattcaatccccttactaatattcttatgaacgaaaacggtactgcccagctcactccaactgaaggtgctatgctccaagttttactcagtcaccgtaataaaaccgtttctaaggagcaattacttcaatggttatggcaaggtggcaaataccttaatgagaacacccttaacgttaatattagtcggttaagaactaagctaagcacaattggtttacggcaatgtattcacacagaacgtggccttggctatcgattggtggaaaacaatgaataaacgttattttaaattattttggcgttcaatccttcttcctactattggctatctttttctcttaggtctggttgggcttttagtaattttatataatctcccaactgttttttggggcgatgtgattcgcttttctcttcccttttttatagtatggcttatcggtagtggtgcaattaaatattatcgattgcgccatttaaatatttctcagctcgataaattcactcctaccaatatgactgagggaaaacttgttgaactattgcaagatgaacaagcaaaaaacattgacacaattcgacagttacaagcaactcagcatgaacaacttgaccaccttgaattatttactcatgaaattaaaaactatttgactagtcttaatgccgcggcagaaaattcaccaactgtcgcaagtacagaagtaaaaaagaatatccaccaagctaactattatctcaatttgttgttaaatgacgaacgactagcgattaataatcatgattacaattttcaatggatcgatattgccaacttaattaataatattttgcaacaaaattctgcggtcttcattcataaacaattgattccagaattaaccggcttggacggaattaaagttctcactgatcgtaaatggttgcatttttgcattgaacaactactttcaaacgcaatcaaatactcatcccctaatagtacaattaatatttcctgggaaatgaattctttgcggatcgctgaccatggatgcggcatctcaatgaatgatcttccgcgaatctttgataatggttttaccgggaaaaacgggcaccgaacaactgctgctaccgggatgggattgtaccttgttaaaaaagttactgaatacttaaatttcaaggttagcatctcatcagttcaatcccagggaacgacagcgattctatctttcttaccagataatatcagatcatcaaactaattcttacaaaactgtaaggttctgtacacttccgtaagtaggaagttgcacagaacctttttataattaagacataatcaaaacaagttctctaccagaaaggaaaattactatgacattattaaatcttcaacacgttcaacgcgtctataatcgtaactctgccaatccagtaatggccttaaaagatattacctttaaagttgaagagggagagtatgttgcaattatgggagaatctggtgctggtaaaagtaccttattaaatataattgcaactttagaacaagctactaacggacaagcaatccttaatggccaagatctccggcagctttccaaggacgacgcagcacgatatcgacgggaacacctcggctttgttttccagcattttaacttacttgatagtctctcaaatcgcgacaacatttacttaccacttgttctagcaaaaactccggttgcaacgatggaagaacggattaagcctttaattgatcgcttacgtattaataaaattattgaccgttttccaagtgagatttctggaggacagcaacaaagaattgccattgcacgggcgttatttacccatcctgacctccttctcgctgacgaacctactggagctctagattcgaacaccagtaacgaaattcttgagctctttgatgaagttaatgctaacggtcaaacaattattatggttacgcacagtgccgcggctgctagtcatgctaagcgcacactcttcattaaggatggacgaatctatcatgaactctatcgtggtgatctttcccttaaagactaccaacaacaaattaatcagacaatgatgactttaacgaatggcggtgaataatgatgctctttctcaaactgattaattcgagttttaagcgtaatcttaaagtttacgtcccttacctcatctcaatgacaatgctagtcgctattaactatatttttaaggcagttgaaattaatcgcagtcttaaagatttaccaagtgcgacagttactaaagcattaatgcaaacaggatcaacttttattatccttgtaacacttgcgtttatgatctacgtcaatcgtttcttatggcaacagcgtcaacaagaaatgggtctttatagtatgctggggatgacgagacataacttacaagtgctaacagtcattgaaaagtgctatcttttagtaattagtctttttctcgggactttatttggtattatttttgatcgcctcgcttttcttggctttgctcatctcttgcaaattgatcatttatctcaaccttggattgaatggggcgctgtgataaatacaatcgtcatcattggcggctttttcttaattttaatggtcattgatctgatcaaactatttcagctaaatccaaacgaattataccacccccaacaaactaaaatcgcgcgtcatggtaagttctttacttttgccggacttttgggtgttgcagtccttgcctacgcctattatcttacaattacagttaaaccgcggatatctgctttaacaacattcatgactgccgtcttcttagttgtgattggaacatacctcatttttattgctggtagcatcattgtccttaaactcctgcaaaaaaacaaaggatattactatcgccctcgccactttatcgcggtttccggaatgttacaacggatggaacaaaatggtgctagtcttgcaacgatttgtttactctgtagctctgtccttgtaattttatttacatctttaactatgtatgccggcattaatgatacggttaattcttatgccccacgcgaccttacaattatcacctcgcagaaacttactgcacaacaagaatcgaccatcaattctgttgccaaaaaacaccatgctcaacttaataagcctgttacctttacaacgagcgctccgcaatacggatattgggaaaataatcgtttcatcaaccagggtaatttagagaatatgactaatcaaactaccaatacagtcattaccatgtcgacagcaacttataatcagattacggataaacatgttaaattagcagcaaataaggccttaatttattcccctgctaaagagcatcgcggtgctttacagattggtacacaaaaataccaagctactcctatctatgactttcactactatttcaatccaagtcacgcgatttattcgccaatttttataatcacaaatatgcttccggcaaacactaccacaattaacttcacaggaattaattatcacttaaatggtagtaagaaagctcatcttaactttgaaaatgaccttcaagcccagcttcacttgccaaaccaagtatattcttcccggacaaaccttcgtagtcaattgaccagtctctatggcggaatcgtctttttaggaattctcattagctttgccctaggaatcacgacaactgttgtaatttactttaaacaaattactgaaggttatgaagatcaatatcgtttcaagacgatgcaacaagttggtttaagcgagaaagaaacaaccaagagtattcatagtcaagtattgatggtctttatgttgccagtagttggtgcaataattaacctttgctttgcgatccctgcaattcggcaaattctaattcaatttaatttctataatgttcgattgatgataataattgccgtctcaattacctttatcctcctatgcctctactttgctatttacggacttactaccaggatgtatcgtaaaatcgttgagcaaggttaagtactacaaattgacatttcttattttaacagttacactttaattactataaataagtacgaccgataaaataaggagatgtcgttcatgattcttattaacaccaccattatagaaaaaattacaagctgttgctaaactactcacgacagattagactgcccttatttaggcgtggttaatctacggtattgcttagtgacagtttttaatttggtttagattatatcgaggtggtttcatgacggcagatccattaagaataggaattcttaacttaatgcatgacaaagtagatactcaactgcgatttacaaaagtactttctgagggatcctacaatgttgatgtacaatacttttaccctcaaacacactatacttctcgccctgtccctgacattgttcaagagatttcccagcctttagattttaaacaagttgccacaatagatgcttttattatcactggcgcgccaatcgaacaactcacatttgaagaaattatatatcttgatgagattcatcaattgattgacgtattagttgccaataacattccacaactttacatttgctggggcgcgatggcagctgctaactatctttatgatattccaaaatttcaattacctgaaaaaatttttggagtcttccacaattatttgcgcgcgcaagaccctctcttaaaaggattacctgatggctttcttgctccccatgctcgttatgccgaacttgatattgacaagattatgaaagatccacgattagttattaatgctgtgaccaaaaataatttcttattctcgttccgcgctcgagaaaagaatcaatactttcttttctcccatcttgaatacggaaaggatgcccttttaaaggaatacttacgagagcggaatgctaatcccggtgttgagtatatcaagccgcaaaactactttcgcgatccgcttcatatgaaagatcctgaatttagctgggcaactacccaacgagtattctttgataattggcttcattcagttgcggatcacatagctacacaacaatttgtaaaggagtaattaatatgacaaaaatcactaattcaatcgtaaatttaatcggtaatactccgattgttaagttaaatcgcgttgttcctgaagatgcagcagacgtttatgtaaaacttgaattctttaatcctggtggttcaattaaggatcggattgcccttgccatgattgaagaagctgaaaaagctggtaaattacaagcaggtggcactattgttgaaccaacctctggaaacactggtgttggcctagccatggttgccgctgccaagggataccatcttgtcatcaccatgccagaaacaatgagtgttgaacgtcggaaactcatgcaaggttatggagccgaacttattcttactcccggtgccgacggaatgaagggtgcaattgcaaaagcagaagaactagttaaagaaaaaggctactttatgccaatgcaatttgataatccagcaaatccagcaattcatgaagaaactacaggaaaagaaattcttgaagcatttggcgatgatattcctgacgcctttgttgctggtgttggtactggaggaacacttaccggggtgggtcatgcattgaaaaaagctaatcctaatgtccaaatttatgctcttgaaccagcagaatctccagtattaaaagaaggaaaaggtggcaagcacaaaattcaagggatcagtgctggctttatcccgaaagttcttgatactgatgtttacaacggaatccttgaaattaagagcgatgacgctattacgatggcacgtgaagttggtcatcaagaaggaattcttgttggtatctcagctggtgctaatatcaaaggtgcgattgaagtcgccaaaaagcttggtaagggtaagcaagttattactgttgctcccgatggcggtgaccgttacctttcaacagaattgtttaattactaaaaatttaaaaaggaaagagactaagatatttttaatctaatctctttcctttttcccattgaccgcgaccttacgtcattagctacacttgatagtatgaaaggagtggtcaatatgtatacgactggtcaattagcaaaaaaatgtaatgtttcaatcaggacaatccaatactatgaccgccgtgggttgcttcatgctaaacgaactgaaaacggattgcgccattataattatcaagaccttaaacaacttcaagaagggactgtgacataagttaagttactttcataaaaagcaaatacgcagtacaacaatggcctctaacgtccggtaaaaccgaacgttaaaggcttattgttgcttgcgggggctcgaaaacgaagtcacaagtgacttttgtctcgctctcagcttaaaagacattcaacagattattaatgacactgacaacaatattctaaaaagcctaattgttaaccaacgaagaaaactcaagcaggaaattaaagacgcttcagaacaattagcaagtctatctcaattagaaacttttttgaataaacattctgatttcccaggaaatatcagtcaaagtgtttttgacaagatcaagaaaacaaagaagttaaaacagttacgaattaaattattgcttattggtatcagcatcgacttcattctttggggtagcattctttactttcttttttatcaaggaaatttgatatggttattattaggaattcttattacagttgctttaacttggtatattgctataaattattaccatcatacttgctatatttgtcctcattgttttcataagtttagggtgtcgcttagtaaatggctttttgcccgtcatactcctaatacaagatatcttatctgtgacaagtgttcacaaaaaaattattgtattgaagaatattattaacaaaaatgaccaaggcgcacaattgctaaaccttggtcatttttttgcattttatagtattggtgaaagcaagcgagaaaagtattgcttgaatttccgccactttgactgattagcaaaatactcaggagtaagtaacgtactctttttcatgtcactttcaaagtcttgctttaactgcgctgttagtttttcattatacgcaaatgcattgacttcaaaattaagtctaaaactacggtaatccatatttgccgaaccaacagaagcaatgttgctcccactaaccatcgtctttgaatgaataaagccattatcgtacttgtaaacttttaccccgttgttcactaagtatttagcataatattccgttgcccgataaacaaatggatgatcaggcatgcatgggatcataattcggacgtcaattccacttcttgcggcaattactaatgcttccagcactgaatcttctggaataaggtatggcgattgaatatagacgtattttcgggccgaactaataattgattcatatccccgtcgaattgaataattttcattatccggtccagaagatacgatttgcattggaacctcatctggatcgccatctggtgcaaccagttcaaaattcttaaattctttttcaaggtcaattttctttttatgagtttttcgacaggttgtattccagtccatcgcaaaccgcactgtcatcatcatcgttgcttgtccgacgacacgaaggtgggtatcacgccaatagccaaacttaggatcttcgccaaggtattgatcaccgatattgaatccaccaatgtaaccaatcttgccatcgataatagctagtttacggtgaagatgataatttaaccgtggcgtttgaaaataagctttggcagcagcaataaacgcttgcgcttctccacctaattcttctaaatgcttaaaaaatttgaaagtagttccatgagacccacttaaatcatagagaacacggacttttactcctcgtgcagctgcatcttctaaggctgccaacacccgcttccctagattatcagcataaaaggaatagtattcaatatatacatgatcagttgcatgatttatatcgtcaattaacttatcaaacttctttttcccatcaataaatacgtgaactttattattaaaggttactactgaatcattcaaactcaaaaaaaggttaaccaactgacgatcacgcgacaaccggcttccttttggcattaattcatgttcttcacttaattttcgttgtttttcaagatatttagtccgtaattgtttttgctcatcttgaatactaaatatctcatcatgggataattgtcgtcccacaaaaagatataggataaatccaactactggcaaaatagttaagactaatagccatgcccaagttgatgcaatatcccgacgactacgaaaaacagtccatactgcaaaagcaatgttaatcaaccataggacttcaataatgcggcgaataacatcccatgtccaaacaatatccataatttaataatctccctagttgtattactgattcattatagccattatttgcttacttttcagcaggttcagagattattttcggtaaaaacgacgaagggcaaaagataacccgatcgctaaaagtccgtacactgcacctacatagccaagcatcgttaaattagcaaagttaacagtagtagaagccgtaaaggatccaagtgaaatcccaacattagcaaaaattgaaattaatgatgttgctaaagctaatgactgcggatattctttttctgccacactaataaataccagttggatagttgttccatatataattacaacgacacaaagagttgctagaacaagcattcctgtaatcttatttcccaatgcaatcccaagaataagacttaatattgtcatgagaataaagacaaatggtaatttttgaaccccattgtgactcgcaacgattccagcaatttcgttaccaataatactcattacccctaaaagaagcagcagccaatttaaactagttaagctaaagtccatcacagtagtaattagcggccggacataagtatagaaagtatactggagacttaagaccgccaccgtgattccaatccctaataaaacacggtgatcttttaatagcgctaattgttctaaaatgctccctttaatttgatgtgtatcacgaggagtaagccagactaacaacgcaaacacaattaatgttaatcctgaaatgatccaaaaactatcgtgccaggaaagtaatgttgcgatggttgtaccaagcggaaccccaatgaccgacgcaatactaaaacctgcaccgacccacgctagaaccattggccgcttgtccattggtgtaattatactaactagcaagttaattaatgaaataatggttccagcaacagcggcagtaataattcgcgcaaataggagccagccaagtgttggtgccatcgcagttaaagtattaccaataaaaaagacggtcattaatagcataagaagattatagcgattccaattgctagttaaggtagtaataattggcgtactaatcgcatagactcctgcaaaagctgtcaccaaaaaaccaactgtggaaagtggaacatgataactccgtgcaatatctgataaaacgcccacaaccataaactcattacatcccagcataaatgcaacaagaataaaagtgaacgatcgcaatttagcgtgcttcacaataaacctccttttaaaacaaaaaattttctggaaaaagtcaatccagaaaattataaacgtttaacaattaatttccaatagttttgaactatttagtttaataaggttgtgagtgataagcagtaaaggttttatcatcaaagcaaaccatcgttacttgatcaacataattggcattagggagaaaatctttaatcgtcctaatcgcaatttttactgccttttcaagcgggaaagcatatacccctgtactgattgaaggaaaggcaaccgtccgacataaatgtttatcagccaacagtaaactattgtgataagaattggctaacaattgatcttcaccattatcaccaccatgccaaatcggtccaggcgtgtgaataataaacttggctggcaagttaaagccgccagttatccgcgcttctcccgttggacatccatgaaatttttcacaggcgccatataacgctgggccagctgctcaatgaatcgcaccatcgacaccaccgccacccattaaagttgtattagcggcattaacaattgcatcaacttttattttggtaatatctcctttgatcacgttgatttgcggcattatttagcccttctttctttaaattgcggaaataaccagattaatcctgtaaaagcaaaagatttcattgctaccataaacccagtaatgaaatcttgtaaatcgtttttaccaatatggaacactaaactatctaatttcataactaaaatagtaaaaattaataaagttattaagattttaatttttcttttccaactcatcaattcccatttactttgactaattaagtaaagtatatttatggaaaataatcccaataaaatgtaattaataatccgccatttctcactatcaacaccaatataaattattccgcttgattgaagtaagaaataaatacatccagctatattgataaaatacaaaacagttaaaagttgttgtttatgtatacttgttctgtgctcttctttatagttatttatcatctcatgatcctcccgtaataaatcatccaaactaacatggtagaggtcacttatttgaaccaacataaaaatatcaggataacttcaaccattttcccaactagaaattgttttacgtgagatcaacaatcgttctgctacatcctgctgagtccatcctttttgataacgatataatttcattttatcggcaaatttcaataagttctcctaccttcaattaaatttatttcccgggaaattaactatgcttaagctttaccgaagaaggcgatatttgtcacgctaagaatcatagcaaacaaaaaggctggagaaacttccaaccttctgtaaatcttaaattaccaaatatgaacccgatcttctggcgcccggtacatttcatcgctaggcttaatgtcaaatgctgtgtagaagtcatcgagattttctgcttgaatattagcacgtaatttttgcggtgcatggacatcaattgaaagcagtaattgcatgtattgttccgttgctttcattcgccaaatagttgcccagttaataaagaattcttgggcattgaagtcagcttcagtttttgctgcttcaagtgcacaactaaggcctcctgcatcggcaatattttcagaaaccgtgagcttcccgtttaccttttgcccagcaaatgggatcccatcaaattcttcaatcatcttttgggctaattgcttaaagtgtgcagaatcttcatctgtccaccaattattaagatttccaaactcatcaaataatgacccgttattgtcaaaggcgtgggaaatttcatgagcgattactgcgccaatcccaccataattttggctgctgctttgtttcaacgagtagaacggtgcctgtaggattgcagctgggaatacaatgatattcttaaatgggtgatagtaagcattaactgtggccgcactcatttcccatcgcatccgatcaacaggtttattccaacgactgaatagttctttattagccgtcactgttaattgatttaggtttgcaatcaatgattcctcttcatcaaccttaaattgatcatagagagcaggaatcttatctggatacccaacttgaatgcccagtttatcaagcttgaggatagccttatcacgggtatccttactaagccattggttattggtcaagcgtcctttatagactttaatcatttgctcaaccatgtggtgaacgtctgctttggcttgtggtccaaagtacttcttcccataataatccccagctacttgactaaacatgtcgcgggcaagataaaacgcaaatttacgttggctaactggtttcttgcttccagaaagtgcccgaccataacgtccattgatttcacgcatttcatcatcaaggtaactggcattttcgcggatgacacgaattaatgcccagtttttaaagagttcaaaattatcttgtaagatcttattcagggacttaaagtattccggttctgtcacaattattttttccggttcttccccaactaactgcttaattattgccgcaatatcaagttgatcagtggcactagctagttctgcaaccgtttgtggattatacatcttactataatcagccgcttcttctgcactttttacatttggcgcaagaagggcatcgaatttgattgcatcatcaataatcttttttgcttcttctttgctataccccaacttatccatcaaggcttccaccattgaagaccataattggagtaattgatcgtgctgagccttcttttctgcttcatagtagctcttatcaggcaaaataagcgatggtgatgaggcaaataaagcataaacagtcgcattcttcatatcagcgtcaatatcaaaactaatcggtgaaggcatccctgctaaaatccagttcttccattgagattggtaatcttcatatgaattaagattttctacacttgccaacatccgtttaagcggttgtgggccaactttcttacgccaatcaaactttttagcgaggcgatatagtttaatcatttcgttaaaacgcgaatcctcagacttttccttcccttctgcataggcatcaaagtcatccatcagttgcttgtcaatgtcatcaacaaggtcattgaagcccccggtagctggtttatcatcaggaatcttcgccgtctttagccattccccgtttactgcttcgtataagtcgtctttaattagttcgttattcactgccatgtgcagggcctccttaaaaggttacattacttactattatactatgcctactagaaattcacgtaaatttgcttcaatctaaaaaaggacttaataaagttttccgtgcactttctgaaaaccatgagtcatgttgcatcagtaattgatttacttcctggtaattacttaagtcaacctttcctttaattaatccagcaatttggagctgccgagcaaattgaacatctgcggactggagaaagttgcgaaaaatcggctgttcatctggatcccaccgcttattaagaagaccaattgcccgctcatattctttgctatgggtaagtaccttttgcatggcctgtggatttaaaattgttgtcatcaattatcccctcatttctaatactcttcccggtggctcttttactgataattgattagcctttgtcatcattagccaataaacattttgataatgataattattgattctttcctctccccacccatcagtaataataataattatgcgatttcgtttagttagatggtgttgatggagatagtcaaaaatacactgaaaacttgtacccccgccacctgttcgtctaaaatcaagttttttaccatcatgtagtttttgtttggtggtcacccgggcatcaaacgaataaacattagctgtcagttttgttttcttaagcatcttttcaagtgtcgttagtgtttgaacgatttcttgatcggtgaccgatccggaattatcaacaaaaatgtcaatggctggatccaatctcgtaactttgccaggcaaatccattcgtaatggttgccggcgattaaagcgagcatgcgaattaacttgtcctcgtgcaatcaacccaaactgatgcctaaaaacctgccgccaatcaactattttagttttttggactttctgtagctgtgatcttacatttcctggtaacaaaccgcgatctcgttgcggggtttgcctccaggaacgattcaaaatctgcttaatattcgctaagcgcacgacctgattgctgatctgctgacttgtcttagattgctgccagccgttatgagtatcagctattttaacctcatctgccgttgcattttcctcttgtttaccaccattcaatttaagacctggctgatgtaatttttcttgctgttcagcaggcagctgttctaatatattgagataatcctgcgaatctaattttggcattagtttttgacgaagagctttctccaattggctaagggttactgttccctgaggtggctcagttaaatactgatttaccgctacatcagttgcaatctggactaaatcttgatgaggataagaagcataacgtaatggatgcatccagataagatgaagggcttcatgttctaataagctttgaagttcatcattacgaacgttcgctaacttttctggattaataaccagtacaaggcgattgtcttcccacctcaatcccatcattgcgggtaactgtaaatcattctctcgtggaagttgtaataacacttctccgaaaaggcgctgtttttgaaggatgataataattgcctccctaatccgttgcgcagatgtcacatgattattgcttccatcattttgatgtaaccgtgatagaaagtccactaaactcatcgattatcaccactcgtcgcaacttccgcaaaatattgataaagttgcgctacagagccttggggatgtttaatggcttgctcatacattacttgcaagaggtcgacgaaatcctcaccaactgtttgaacaatcgcatactgcccatcttcactgactaattggagatacttaataaatagagctgcctcttcttcagatgctagcttaggacttagccatgaacgtaatacttgaattttggttgcttcatcagcattttcaaactgctccttgccatctttagcgtctttcaaggttgccactgtaagctcttgcccctgtgcaaggacaaactgagcaaaggccacccctacttcatcacctaagtcaccactaaatatatcagcagcaagttctttttgcattttctggtctaacgcctgtaattgatcaagattgcgagaaactctttcccaagcacgtggcgtgggagccaaatcttcattgttcggatcaacaactaataattgttcaggatattgcgtaagataggcggaaacaaggtcattaattccggttgcttgggcccattttaaccattccgccgttgaactcgtcattactaaacgaactgtccgatctttaattgcagcatccccagtcgcaacaccatattcacgatcagtaaatcctgtcatcgtagaatcaggattttccgcaataatgatccgtactgcggaaggcaaacgcaaagcattaatctttcgttgaaggacaaggttcattagttcactttgaacagcttgcgttccacgattaaattcatctaaaaaccaaataattgattgattaggatgggcttcggcatacttaataatgctaattaaagtttcagagtaaccgaattgtacatttgcaagacgaccataattcttcgtttcaacaaaagattcactggtcaagggggaaccggaattgcaaggtctcctttttcgcttaagctgacaaccgtagtaaataatgccgcattcagattagcagcaatttcacgaactaaagcagatttaccgatccccgcatccccgacaatattcggaacactacccgcatcgagaacaacgggaactgccgttaatagttgttgataagttagcgccattatttaccccttccaaccatgacattccagatccatgtcttgttttttcacgtttgatacatagggattgccttttacataaaagcggcgtggacttaacccatctttccccttcaaattaactccaatccgcgcagaaatagctatttctccaggaattttataattatgtaaatcaaccgttagtggacttgtttccataggctgcccatctaaatcccgtgaatgaattccgagagcttgtactaatttaccgggaccgttagtaatatttacccctgacatgtgccgattttcgatcattttatcgatgtttagcgccggttctattccgcgaagtaaaattccttgaggttcctctgcatcctgaaccacaatatcaaaacaataatgtccacggatttggtataggtaaatattcccgggcatcccatacaaagattccgagtagccagtgcgtcgtccgttaaaagcatgtgatgcagaatctttttctcctaaatatgcttctgtttcaacaatataaccaccaatgattccacttttagtttggtattttactagtttccctaaaagatccttcgcaatttcgactgtgggccgtccagtaaaaaattgttgatattttgttagcatatttattttcctcctaaaaagaactatcctaaacataacactaattaaaggagatcggcatgatggaactaaaaattgaacgaatttatactaaacctgttgatttagatggttatcgtatccttgttgaccgcatttggccacgcgggatttcaaaagaaaatgcacatcttgataagtggctcaaagaggtcggcccaagtaccgagctgcggaaatggtttggtcatgacgttgctcgttatccagaattcaaagaacgttatctcgcagaattaaccaacaatcctgtttactataattcattaaaggcaattgtccaaagtaagttgccgagtcagaacgttattctcctttacggggcaaaagatgaagaacataatcaagcaattattcttgctgacaagctccaaaaagatttacaactcgctataaaataatataattttgtattttttaggaataatttgttttataataatagtatgaggattttattcataattctctagtgcccattgtttcactgacttagttatataaattccttttgaaggtatcaataccacaaaggatttttacaaactttttagtgactttttctaatcgtgtaattagaatcacgggtaccaataaccccctagtttcattttgaaacaattatctgataaggtggaagtctattattgaagtggtaggtagacttctgctttatatttttaaatcaattatttgtcagcccaactacgaccatcgagctcaccggcggcattgactaggcgttgtgcttgttcaagcattaactgctctaatgcccggtaaaaagcttgatcttcatatgttgggctatttttcattaatttttttaattcttcgtgtgcccattgttgattctcatccattttagtcatcctctttttctcgaagccatccgatagaagtatgtaaatcatccagctcctcttgttgatcttgtaaaagtgccaataattgttctaatttagcttgttgaagaggatctaactcttgagcaattttaacgttaaggtggtcaataaaccattgcgtctgattgctaaaatgcaagaatttatctaaggtcaaatattgctgatagtggataaataaagactgccgctcttcttcactctgttgggcaaattgatagatcggcaatggtggcaaataattcatccccatcgcgtgcgctaaagcctgatatggtcgtaaaagttcagcaattgtatatccttgactggcacccggttgaaatgcagacgcagaatgagcaaccgtcgtaacaatccccaattcacgaccctttagcaaatgactgcttgtaagttgtgaattccatacctcatcaagccattgctttaagatcgccggcgcactataccaatacagcggaaattgaaaaataattcgggttgccgatttaagtaattcctgctcttgagaaatatcaaaaggtgtttttaattcatgccacataacgttattttcatcatcagcggctgcctttaaaaatgattcagtcgatgaattcgcaagttgagggtgagccactattaccagtgttttcatcaatttcactcctttaattctgcaaggccttgtttcaagacatcttctgtaacatcgacagttagaaatcgttgcagaggcgtttcactatgacgatccttaaaagccattggttctgcttttagaattacaacagtcaaattattttccgtcagcattaactgacccggatatttaaatttccccttagtatgttttccagtccgccaagtatgtaatttagcctcaccattctggtcaaatttcaactgatactttccactagcatctgtttcgacgggaatcccggtaaacttttgaacatcatacttatcttttttacccataatatatccttcttagtaattaatctaattttacggttccacttttaattggtccgcataggcattaacctcatcctgttggtcttcacttgtgtagtaattatttatcaaattcgtaacagtggtatgcgtagtagtcattggtgcccctgtcacattttgattttcagttgatccaatcattttaattgtgacatcattgcctttacgtttaaaccaaatatagctagtcaaatcaccctgtgttgttacatattgataatccgcaacttcaccataaccataatgcgttccataatacatttcaccattttgaactcctgccttaaaccaatcagggttctttaacaatgcaactaatgttcctagctgctgggtagttaatccatccttatccgtaattgtaactttaccacgcatatcaataattttggtgttttttgctactttcaaaacacgattaacttccccatgagttttggcatacgtcaccatttcagcgagtgttacgcctgttttgcgaataccattactactgttcgcatagtaaaccttatttccgacaattgtataataggttgaatttaaacgatcgccatcttcatcacttttggaagttaatttaatcatgtataaaactttggcgcctttaggataagtcttagcagaggatccctctcccatggcactgcacctttatcataaatcttaactgttgctccctgattattgttttccatatcagcagaataatcataatcatttgctcctggcatatgtgcatcacgatagtacaacacaagtgcagcagtttgcttaagtgttaatcgttcagcgtttagtgctgcatcatcccttatttgttgtgtacttgataaagaactagtcatactactagttgatctattagtacttgaggatgttctcccacaagccaccataaccatcatcgtcaatgaaagcatcaaaattagcgctatttttctcataaagatactcccacagatcttatatttaaagttttattataccttaatctttaggagtcatctaaaaagcctctataatcgatttggagacttccttttcattttattcagcaaaataatccttaatttctttgtctgacaagtcaaacttttcttttatctctttcttgaattagctgttctttttctttgagtcgatcctggccttctttaatttcatgtttacttttctgaagttctcgttttccttctaaaagctctcgttttccttctaggagttcacgttttccttctagtatctcccgtttgccatcccgtatcctacgttcaccctcacgaatctttttctcgcgcatttcttgatccatttcatatactgaacgtcgcatgtattccggcctccatttccggttccgctttacaactgctattctctcctttaattttacgacaagcggatcggtcgcttcaacttttcgttgggcaatatcgtggaggtcagctacttgcatctcaacatcataatcaagcatcactttgttgaagatatagtcatcggctaagcccgccatctcctactttttgcgtaagaattcattcatcgttatatcccccgttaaatagttctataaagatatatacgtaaaaggcaaagattttcacttttctactcaatatttttccaatgtatcattaatgcatattaataatgctttatcttttggctatggataagattcaactataatagatagtgaaaagtaaatcttctttattaggtattatctatggtatgtgtagataggatgttgaaaggaagcaatactatgttcgacgttatcttttggattcttgcaatctggtttgtagtaaacgttgtatggatgtggtttgcccttgataaccaagttctacaaaaaacattcgcatggattaatgtatgtgcaatcgtaattggtttttgggtatattacggcatgactcacgacggcaacgcccttaacggctggttccttacaatgaactgggtaaacattgcaattgctgctatccaattctactttggttatcgtgaaaacagcgttatccacaacggtcacacaaccgcatgattgatttacttttcaactagaactatggcttggggtcatggttctttttttgtaaatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactgtgtgcagttcgccagtagcccttgcgggtactagcgaagacatatgcatcacgctgggacagccccagcttctgtaagttagttaccttagttttaagcttcttccattgcttccagatatactgtcttattcgggccctcaaccacttgtcaaggcgttgaataaagtcagttagtttcccaattgagtagtactgaagccatccacgcatttttcgatgaatttcttcaaacattcttgtcagggatattccacgattacgtttagttaataacctcaatgctttctttactcgttgttgcgattgttttgctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttatccaactcatttagatagatattcgccagtattggtgacaatggccctccttgtggggttcctttttcactcttagcgaaaagcccatggtctaagactccgctagttagaaacttacgaatgagccttagtgtccatgggtcatcaatatattgttgaagatacttaatcatcaagtcatgattaacattatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaattccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcgcagtggacacccttgtcctcagctcatggttccgactactacggcccatagcggactctcaccgcctagctaatacccatgccgggcgcacaaagaagagagtatggaaaaactaaaattttcccacactctcttttcaatttttcatattgatgacttgaactatttaaattctaaaacatataaaagcaatttattactatgcactgaaaatacacttacttcttcccaaacaaagctgccatctttgctgctacttcgggatcaagattatcggcaagcgtactttcatttgatttttgttcattttgctgattagtgatcgtttgcttaaggtcatcaatgactgcttgctcaccaacttcaatcggattaaccgttaaccggccacctgcagcatcagcatgaccgccaccattaaagtatttttcagcaaatttagccacatctaactttccgttgcttcgaagcgacacgctaaccggactgactaccaaggccgcatcgacttctggatgttgcactaataattcgtgggcaatttcagatttatagtcacttgcatatacgacactaaatttatgatcatcgatatctgtaattaaaatatctttcaaatggctcttaaggtactttgcccgccgttcgtttagtgtccgaatcaacagccgattttcttcctgatattgttgccagctggtattaaaaacattttggacaaactcttctgaatcttggaggggataaaaccaaaagagctgatcaagattatcggcatcaattctttcctgctcattcatttctggatcattttgccaatcccaagtatcatatgcccgaatcaattccacaagataagcaaggcctttttgccgttgctcatcaatctttgtaaaagacgattgttgttttaaccaatcccataccaagcttgtggcacttgggttaactgttggatcagcaggtacgatactattggccgcatacttttgtcgtagttctgcttcactttcatgatggtcaaagacaagccaatgattagcgaaacgttcattcaataacttaaatgaataatcgctatctggcgtcatatccatgatgtaaacatctgtaaatcgccctacttccgctgtttgcatccatcgacttaactcttcatcgattcgtccagcgccacagtttgtcatatcaaactctgtgtcttcaaacattactggttgtagtgtttttaataataatggagccccgaatccatctaaatcattgtgggaaaataattttattaaccgttgtgccatttttgatcctcgcaattctgattttgtttcttattataccgtagaaaatcggctaaaccacacttaattactgacatcacgctaacgaactgctatcattgaaattagtaactcattttaagaaaggaaaataatatggaagtttatgattatcgtcaagaattgattgacctcttaaataataccgctgatgatccacaaagcttactgcagacacagcgaagtcttaccaccattcttaatattttaaatcattaccaggaaagcaaacccgttaaacaaaatgcaccacggtttgttcaacgcaaaattcaatcgtcaaacgagttgcctccgcaagcacgcaaaacattgaagtcactgcttaccggtcctgctaatgatgaagagaagccaacctcaacggcaagcccagttgcatctccttcagttgaagcaccaaaagaaatcaccgaagaagaacgcctagcagccgacaatcgctacttagtacaccggaaattaagtggagccgagattaatcaccgttactacccggaagcaattctgcatgcattaccatttcctattgaggatggggacattgcccaactagactatgaacaaaaagtccgcggccttccagttattcggcagattaccggtgaccaccttagcgattacactcccgaaaaagtcaatgtgattgaatatggtgaattaaaacgcgtgcccggttctgatgtgcttcaactgagtaaaacaattaagggtaattcaatcgttgacgaagcgccagaaaacaccatcgtaattgatccctttaagtaccctggccgcgatattaagccaggaatggttattgattttgcctactatgatcgaggaaatggcctaactgataccaaagatggcgcgattcgctggattcatgaaaagcaagattatgatacaactaagcaaccagctaaaccaaaagttgttaaaaagcctgctaattctcgtcatgattatgagaaaaagctggactatgaccttcatcaacgaaaggtacttgttattaccggaatccgcagcaaggttaagggtcttaaaccagtcattgacaaacaccacggtctgttccgcggattagatgcgtctgcagaagaaaaagtttctagcagtaaattaaaacgcgaaattcgtgatgcagactttgtgattgtctgcatcgatgcaattcaccatcgaattagtcaactcgccaaccatcacgctaaacgttatgaaaagccacttgccattgcaaatgttacttctaatactgctgttgagcgagccattgcccgggcattaaatggtgatcctgcatacgccgaaagtagcgaagatttgaaaaattataaataaattttaatttactgttgacttttatgagaaataggttaatattaatgacaacaatttaattattcgatcgcaatgagaaagaagagtatgttagacgatagcttcagcgagtctcgtttggtgtgaggagacagttttaactctaattgaaaatcactttcgagtctacagcttaaataccagtaagctgtagtggttacacccattatcgtgtcagcgtatcgccatgatggccgtacgtgtgaggtattgttagcaatagcagtacaatgatagggtggtaccacgctcagcgtcccttagccagtttggctaagggacttttttgttgggatcagattaggaggagaaaacatgcaagatttaacatcgcgcaagttaacattcaaaaactatttagttgttgcatcattgcttttcggtttattctttggggccggaaacttgattttcccgttacaccttggtcaattagctggtagtcattggggaccagctgcagttggctttctgattactggagttcttttaccacttctatcagttctcgccgttgctgttacgcgtgcagaaggggtctttgatatcggtcgtccgcttggcgtcggtttcgccttagtattcatggttcttatccacgctacgatcggtccattattcggtacaccacggactgctactgtctcattcacagttgggcttgccccattcgttgataaacaatatcaatcccttgccttgctattattctcagctttattcttcggggcagccttcctcttctcataccgggaaaatgatatcttagctaacatcggaaaagtattaaatcccgtcttcttagcccttttattccttgtctttgttgttggtttcgctcgtccgcttggtaaccccgctaccgcacctacaactagtgcttatgttcacggtgcgctcactaacgggttccttgaaggatacaacactatggatgctcttgccggtcttgcatttggtgtaacagtggtaaccgccgttcgttctatgggacaacggtcagcaaaagatgtatccaaagtcgttgcaaaagctggtgtcctctcaatgggtgccgttgcttttatctacttattactaatccttcttggcgcaatgtctcttggtcgtttcaaagtttccccagatggtggagttgcctttaaccaattagttaatgcttatgccggtgcattcggacaagttgtactagcattcttgttaactgttacttgtttaacgacggctgttggtttagttgctgcttttgctcaagacttccataagcactttccaaaagttagctaccatgcatggcttgccctcagttgtctcgcctctttccttactgctaattttggcttagaccaaatcatcgcttggtcaacaccaatgttaatgttcctttacccattatcaatggtgcttatccttttatctgtgacatcaccactctttaaccgtgatggcgttgtctacttcttcgtggtccttttcaccgttgtaccagctctcggtgatatggttgttgccttcccagcggttgttagccaaagttcatttggcttatctgttgccgctttgcgaaataacttaccacttgcaagtatgggattatcctggcttgttccagcacttgtcggcttagtccttggtctcttagttcactggtaccgtcatcaacgggttgcttccaccagtatgcaaagcgaagtacattaataagtgtcttataggttaaaaagcgtgagaaatggctcattacaagagtcgtttcccacgcttttaaattattatttaacattatcgtattgggcaagattaaacttcttaatcgcatagatcagcttgctggcataatctggatcggttgcgtaaccattccgctgtaattcgtaagctgcctgttgataagtttttgctgtttgtactccatggaaacgtgcatgattatcagcaattccatttacaatgagcaatgtgtgcgcattaattgaatcagcccagctgttgtaaactgtaaagtattgttttacttgaacatttttaccccgaatattttcggtagtatacatttgaaccttttcgtcgtcactattagctttaattccaaataagttattgtatttattcgctaaccggctccgaccccagttcgattcaagtcctgcttgtgcaatcgtaatgctagctggaatatgatacttcttctgttcacgttgagcagctggcgcaatctgacgaacaaattcattgacggttatatctgtcgggtgggtctcacgttgaatttggggagattgatggataataatcgccacaatcccaaataaaataatcaaaaatgcaagtacacttccacaaatgatttttgtttcttttttcatgacgtgtctttcctttttatgaatttgacgctattataaccacttcaccatgagaaagcgagaatttacaatgatcttatttacttttaagctcgtttttatagttacccgaaatgtcaatttaagttagaaagaaagtagttgctcatcagtgacgtaggacatgaatacctcatatggagttcgatagcctagtgatttgcggggcaggttatttcgcttactcatcagttgggtcaccaattcatcaggaagattgcggaaatctagctgttttgttaagccgtcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgctgcgggaatttccgaagccactgacctaagtgttggttaatcgcatcagccgtcttttcgtgcacattgagtacaatttcgaccttcgattggcgttcggtcagggtcattaccgccccttggtgctttttgccttggacggtatcagcttcaaggtgtccaaattcagtggcatagtgcggaaagtccttggcacgctcgtgaatacttcgccccaattggccagccttcccgcggcgctcaatatagccattcgggtgccgcttacctcgcatgggcaaagcacggacatccaaaccgaactgcccccgttcaaacatccggtaaagagttcgccggttacaactaattgggcgctcagcgcgcccaataatggtgtcaggcgtccacccctgggcaattttgtcgttgatataagtaagttcagccagtgacaactgagtacgttttcggccacaacgttgcttattgcgcatatagtgatcttgataatcagcaattgaggcaccggtttccaggtaacgataaacgcgataaacggtttcggcgctacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgttattaaagtatttactatcagtcatcttcaatttaggaaagctcttgattagccggcgatgattccaactcaattgcttaccagctccctctttgtttagatgttgagcaaagtaccgttgccaatcttgaaggtgatctttaattgctaatttatccttaggagctgctttttcaagttgatccagcagtttctttcgataagcggctgctcgttcatcccattgctgagttgtaatatggaatttttccacactaataacgctgagaatagtgtcagttcccatcacgaggacaataattagggcaagcatcccgtgggtccatgattcttcccagttaataatccgctgaataaatggctgaacaaacttaaccagcaagacaacgccaatcccccagaaaaatgaaatttggagagcaactcttccttgaatgtttccttttagatgcgaatagtcccataacttcatatgaaaaagtttttcgagcagccaacttgctacatactcaaagatcgaagccacaataacccctactacgaatagcagaaaaatattatcttgaaacggataggtagtaatcaaaatcgtcgtaacggcaaatccatatattggacaataagggccaaataagaatccccggtaggtgaaatgatggtccttaattgaacagtaacaggtttcccataaccagccaataaatgaataggtaaaaaataagacaatgatttcagaaagtgaatagggcactcgtttcccctcctttttgaattcattgtctcatatatttctatttcaagctaagcttttcaacgttcaggatcttatcaagccatccttcaaagaatccttgttcgtgactaactaaaattaaatttcccgggaaatcttgcagggctttctttaacccttccttagtttcgtcgtccaggtggtttgtcggttcgtccatgataagaaaattacatggggttaactcgagaatggcaagtttaactttcgtctgctcgcctcctgataaaagattcatttccttcattgtattagcagcgttaatcccagcccgcgccaactttgtccgaatcgttcgtggctgcatcgttgggaacatattttgaattgtttgcagtggcgtaagcgttgggtcatcccactccaaatcttggtcaaagtaatttatccgggccgatggggagaaggttgctgttccgcccaacgctggaattttctttaaaattgatttaatcaaagtcgacttaccaaccccgttaaatccggtgaacaataatttttcacccattgtcatcgagaaagttactggcgctagtaatggtcggttataaccaactgataatttttctacccgcaacgcatttgctgatccggtattttcatacggaaaatggaaagttgcttttagattatcttcgggtggatcaatctttttcattcgtgcaagcatcttttcacgcgatttagccatagtcgattttgaaccggccttgtttttccgaataaaccgttgcgccttttcaatgaccacttgctgcttctcatattcccgctcttgggcttccttccgctcttccttttgccgcattgcttgttggaaacttccgcggtatttggtaattttaccaaatgacacatcacaaatggtattcgtaacttgttcaaggaagtcatagtcatgcgagataatcattgcggcaccatcaaaatcattaagatagtcgattaaccattcaatgtgagctgtatcaaggtagtttgtcggttcgtctagtaagatgacatctgggttctccaatagcatcttcgcaaggataatctttgaccgttgtcccccactcatctcagagacaacatgatccttaccgatatcagttaatcccaaaccattcattacccgctctacttccgtttcaatttcatagaagttattagcatcaagtttttcttggattcggcctgctttggtgaggagctcatcatccatcttttctgcataatccgcataaagcttattcatctggtcattaagctgataaagttccgtgaaagcagtatggaggaagtcaatcaatgtcatccccgccggaatatctacatactggtctaagtatccaattttgactcctttttgccatttgatagtgccatcgaccgggagggttttcccgatcaagattttaatcaaggtactcttcccggcaccattttgcccgacaatccccatgtgttcgtgcttttctagttgaaagctggcatcttcatagagctttttatcggcatagctcattgtcaagccttcaacatctaatactgccattctattctctcctctttttcttacttattacgagctaaaactgctatccatactatcatattttaggcacgagcttcaatttattggcaatagtcctactttaatgaaacaaggagccaccatatcattcctaaaataactacaataatccactatttgtctcgatgatgatcttaaagaaattagcaaaatacttagaaccaatgggattgagcatcaatagttattttaatatggctgtccggcaactggttattcaaaaaaaattccctttgaaatcctggctgaacaagaagactctaatttgacaactcggcgtgctttaattgaagctaaagcgaaggacttggggattattcctgatggttcgcctcatttcaaaaatgttgatgaagactaatggatgaattaatctacaaaccctaattcaaacgagactatcaaaaattatagtccgatttccaatattagagggttaaaaattaatagttaatttccattctctataatgctttatttctgtcatatcaacgatgcaaataatatttgctagcaatacgtattcagatataataaccttatccccatagaaaagaggaattaaagtgaaatttggagatcgcattaaagagcaacgtattaaattagaaatgacacaagcaaatgtggcacaggaactttttactaccagacagacaatttcaaactgggaaaagggaaaaagttaccctgatttagatacgcttattaagattagcgatttataccatgttccaattgattccttattgcgggaggataaagatttgaaaaataatttagatagaaaaattacgaataaaaaattcacaccacttttcatttttataaatttcggcattagcttttggtttattcttcagccttacataataactaatcatttatgggcaagattaggaaatcttggattagcaatttcgatgctgggaataataataacggctggtcactttagcgcatatattgaagactcacctcttataagaaaaattaactcctttgttaaggaaaaatttcttaggaagtctattgttatatctgtgattattttggtactaattatttttacgctatatcctacatcagtctccctatcaaataaaacagatctttactttggattttttgtccttattctagcaataattaatgttattcttgaattcgcaaattggatactagatagactactagaaaaaaggtaggtgataaaagatgacaaagtaccaaaagacggtaagaggacgaaatccgcaactaggtaatagtttaatttcactaggtcctcatggtggaattaactatgaatttaaaggaactaaagattcttatggattacataaaaaaagaacatataaagtatatagttcgaataatcgagacgaatggcaaaaatataatcaaactattgaagagcgtaaaagaaaaaaagaaatagaagctaaattaagatcatacaaacattatgtaaaaaaagctggtactaagagaaagtataatctatggccagagatcataattgatgtattttactatcataaaaagaatactatttcaaaatatgatttatttttgcttaaagaagctcattattgtaattcaaaaaaatgtattgttacaaaaatcaacaatggtaaagtatccattagatgtaaggctcgaaatagaattccatacactaagtttatttctctttacaataatgcaaataaactttcatatgaggtttagggtctatttttaataaataacccttaaagaatattgatatatcaagcccctatattctattatcagaatataggggttattattttataattaggataaatagcccctaaaataatgatgcaattgtgacgaacaaaatgtaacattgcaattgacaatatatttgagactattgctttacttactatccctatgtatcgcaataatgataatgaattttaggacaggagtaaattgacaatggagtttgcaaagcaattaaaaaagttacgaacagataaaggtttatcacaagaagatatcgcacaaaagattcatgtgacaagacaagctgtttcacgatgggaggctggttcctctgttcctgacttagaagcagccgttcagttggcagctttctttgacgtaagtcttgactggctagtattagacaagcaaccagccgataatgttacaaatcaagatatattaaatgcagtcaacgagctaagagacgacatcgatgatctaagtgatgatattgatgatttagatgatggcggtgttggttttagtgataatagaaaatcatttggtagttttctcgaggataattggtttctaattatagttatgtgtgtccttgtatacatgggattccatggaggtatcagctcctggaacggtaaatttttctaataaaaggagagtagcatgaaacaacacgttctacccatcaaagacaccaacattctacgcgaagtccaggacaccttacttaataatttccgctatggtcgccgaaactataccatcttccaagtcggcaaggcaacattgcttcgagtgagtgatgtattagcgctgagacgcaacgaaatcttcgctgatgatgaactatcaagaaaaatgcgtatattcgcgataaaaagactaaaaagcccaatattttgtatctaaaaccggttaaacaggatttactagattattatgcctggcttcaagaaaatgatattcaatccgaatggctttttccatcaaccacgcaccaagaccggtacttatcggatttacgtaatcccttgtcacagtaaaaatacagctattataaaatggtataataaaaaagtgcactggcgaccaccaatgcacaagtatacgttgtttggagctgattccttttggagacgttctttcacgcgcttagctggtggtgtatggcagtacaccagaataagagcgattttgctaaacttatcagcccaactattgaatataatatttcattagacagctatattatagcatgagttagcaactttatcgaccgtctggcttaatgtcaggcggtttttaattttctatataccttactaatggattaatcatatttattggacatggaagcaacaatgtacttctatgtctatttatttttatcatatataattgacactaaatttaagtaatgataaaatctctaatatatatgtcatatatatgtgtcataaggaggggaccaaatatttgaaccgtgttaaacaatttcgaaaagatcaaggattatcccagttaaagctagctcaaaaaattggagtagctcgtcaaactatcaacttaattgaaaataataagtataacccctcgttagaactttgtattaatttagctaaagcattaaatactgatcttaattcactattttgggaggaacatacggatgaaagaaacaattagcaccaaaatcattaagtggttttacggtattcatggaccattagatgaatatcgccgcaatgaactcaatcgaatcggtaataatattgccatatttttattatcaataaatctattattaagttttattgctagccttttaatgcttagtactaataattctgaacttactcttgatatcgtagtaagcgtcctactattaactgttttcgcttctttaggctatattctatatgaaactaaacgacatcatttaacagaaattgatgttgaagccaaacaggagagcaagactaaacaaaaatttattaaaagagcaattggcttaggaatttattttgcaattgtaatgtacggattaacaatccttatcgattggttacctaacaaaggagccttaattccattacttacagaaccttctacaattagtagtgttattgtcagtggccttatctacggactattaatgggtacttgggaaatacatcaaattaaaagcgatcctaatgacaaaaaagtaactcaaaatcacttacatcaaaaatattggttagttttatttattattatcgttattactagccttctattaatacataagtaattatatttccaaaaaatagaggcagtagttcgtgcatatgctgaagaaaaagaaattattttagacactgcaaaaacctttgataatactgatgacgcaatgagggagcttttcaaggacaaataataattgaaaaattagttttggccatcaatttcaacttgatattgattttgactaacacatttctcgatttcattttagttgttttctcaattttaaatacttatcaattgagcgccctaattcaaacacagagcctataaacaaaaaattagcaattgcgtttaaccagctccacggaatcatatttcttaaacaaaatccagcaattgttagtattatcaaagatgaataaatgcaaaaatcgcttctaagctcttttatttccttttgaagcttatcattagatttcgtcataatagttcctttctcggaaagaataattgtatctagtcataataccatatgccaatgtagatactttaacaatatctccttaatttattaggaaggaaaaacttgattggattgattttagttacagaaaaacaacctaagattagtttctagccttttctgctatacgccgtagccacagcgatttctcaagtatagaaaatttttattccaataattttctattcaaattattacagcaatttaacaattatgtaacaaccgccacccttaagatatttttcatatcttcttcacaatatcatcatatagtaaaagagtgcacaattagttgcatacataaaagaaaaacaaacaataattcaggagtgaataattatcgctaagaaaaaaacaatgtcaaaagtccttgctgctgccttaggtgctgctggtgcattagctgttgctaacactgtaagtgctgacacacaagttcaagtacaatcaggagatacagtatggggatttgctcaacaatacgctactactgttgattcaatttctactgctaaccaattagctgaccctaacgtaatttacgttggtcaacaattagttatcccatcttctgctatcagtgctgcttctgctgccgcaacagttgctgcacctactgcaactgataacgctactgctagtcaagcagccgttgaaactactgaaacaaccgctgcatcaactacaccagctgtttctgccacaaacgcaagcaacgtagccgaccaggcacaaccaacaacagtcgtatctactgcttctgataacaacactactgctcaagttagtgccgtatcccaagttccagcccaagtaagtgctgcttctgctactattagcgttgctcaaattagtgctgcaaatactaacaacaacgttactactttaacaacaactactaacactgcagctccaacacaaactacatacgctgccactgaagcagttgctactccacaaagcaacactactgttcaaagtactgctgctgtaaccgctactccagcaacttcaactgctgctggccaaggtaatggttctactgctaatgcggttgccgttgctcaagcacaaattggtactccatatgtttggggtggtaaccaaccaggcggatttgactgctcaggattagttcaatatgcatatggtcttggttcgaactaccggactacttaccaacaaactaacctcggtgcccaccacagtgatatccaaaacgctcaaagtggtgacctttacttctggggcccagatagtgctccttaccacgttgcaatcgctactggtaatggtggttacatccaagctcctacaccaggtcaaaacgttcaaactggtaacatcaactactacactcctagtttctacatcagcatgaactaagatacgagtagtataatcattgagtaagatagaagattttcttctaccttactcttttttcttagcaaattttaataattatattgacagctttattatcattggttatacttaacaacaattaattaagtagggagtaagtataatgaacgtatatcaaactatcaacgttaatactcgttggcaaagccggtaattcaggttgtttcgtcatggatgcgacctgaagaacagattgcatctgtgccggctgagtttgatgttcatttcagtccgcatggatccacatgcggacttttattttgcctttcaaaaagcgagggtccgtcatgtgggctctcgttttttattattttgtgaggtgagattttagatgaaaagaatgtatagtttaattgcaattattatcgctttcctttgtttcgcattctttagagaaaacaatggattcgtaactaagcaacgaattccaaaagttggtgtgttaaccttgatgcatcacccagcgttagatgaaatttataaaggatatgttgatgaattagcaaaggaaggttaccacaacggtaagaatatcaagattgagtatcaaaatgcgaacggtgaccaaagtaatcttaaaacaatggcttcaaaactcgttgatgataactcaactgttctttttggaattacgactcctgctgctcaagcattagctaattctactaccaaaacaccaattgtacttggtgctgttaccgatccaaaaacagctggactagttaaaaataatcagcatccgggtggcaatattactggagtatctgaccaagcaccaattcgcgagcagctcaatttgatcaagcaattcatgccgcgaatgaaaacactgggggtcatctacacttcaagtgatgcttcagcagtagccggttatcaccaaatcaagcgtgaatgtcgtaagatgaatattaacttgaaggcctattcaattgccaacagtaatgacttaaaccaagtttccgaacaaatgcttagcaaggttgatgcagtaattgtaccaacagataataccatcgctggagcaatgcaaactttagttaagaatgccgatgctgctagcaaaccagtcttcccggcaactgacacaatggttaagcaaggtggcgttgcaacttacagtgttaaccaacgtgctttaggtgtccaaggtgcaaagatgacggttgcaatcctcaaaggcaagtcaaaaccagctgatactccgattgagtacatgaagcatgggactcctgttctcaacattaagcaggcccgaaaacttaacttacaaattcccgctcaatttgaaaaggatgcagaaacgaaaggagaggtttacaaatgaatctaatcgtatcgtcaatcggtcaaggactattatgggctttacttggtcttggcctttacctgacttttagaattcttgattttgctgatatgactgttgaaggaactttccctcttggggccgccagtgctgttgctgcaatcacacatggcattaatccctttctggcaactttaattgcaattggtgctggaatgctcgccggtttgatcactggattgctctacactaaaggaaaaattcccagtttattagccggaattctaactatgaccgccgcctactccgttaacctccgcattatgggtaaatcaaacgtttcgttgcttggtcaaaagactctctttagcggtgaattcatgcgaagtctgccccaatactttgatagtgtcttcttgggaatagttacgattgcgattattaccgtaatcctggtcttcttcctttcaactgactatgggcaagcttttattgcaactggtgataatcctgtgatggcaaaatcattcgggattcatactgacacaatggtcatcatcggtctaatggtatcaaatgggatcgttggactttgtggtgcgttgattgctcaaaataatggatacgctgatattaatatggggattggaacgattgttatcgcccttgcttcaatcattattggtgaagtagcctttggtgaattaacacttaaccagcgacttgtcgccgttactcttggtagtatcatttaccgaatcatcttacttgctgtgctacaacttggtttctccgccaacgacctcaaccttatctcctcagttgtccttgcaatctgcatgatgttgccacaacttgaagaacgcattcaccttaaaaagccaattttgaaaggagtccggcctcatgaataaacctattttggaattacaaggtgtcaaaaccattgttaataagggcacatcgagtgaaacaactattcttaaaggcttaaaccttaaaattaatgagggagacttcattacgatcgttggaacgaatggtgctggtaaatcgaccctttttaatgtcatcggcggaaacctgcacgctgacgaaggaaaaattttgcataatggacaagatattaccaatacaacagaagaacagcgaacagctttcttatcccgtgtttttcaggatccaaaactggggacggctgcacgaatgaccgttgctgaaaacatgctattagcaactaaacgtggtgaacgtcgccatcttattccccggaagctcaaaagtaatatggaccgtttcaccaagctagctgcaacaatgaataatggtcttgagaatcgcatgaatacagctactggcgccctttcgggggacaacggcaagcattaagctttttaatggcaacaatcaaacgacctgacattattttgttggatgaacacactgctgctcttgatcctcatacaagcttaaatctattacacgctactaatgaacggatcactaaagatcatttaactgccttaatgattacccataaccttgaagatgccttagagtatggaaatcgtctaatcgtgcttaaagatggtgaaatcaaagcagattttaatgcagagcaacgaaaatctcttacccctgagaaactttatacttattttgaaggatagtttgactatatatcaaattcgatatattaagtatatcgaatttgatatataggagacttaattatgaattggtggattatttttatcacatttcttgccgtaaacctcgatttctttttcatcttaatctttttactcgaaaggtataaccttcgtgatgtaatcattggctatcttggtgcccttcttgttctggttaccatcagctttttactaggaaaaactctcgccattttcctccctgaatggattttaggaatactagggatcctccctatttacatggctctgcatgacaacgatgaagacccaactcatgcagaaaagcacggcccaattattaccaccttaataacctatctggcagtttgcgctggttgtaacctctcaattttcttaccaattttaacgaatcttaccttccagcaatttactcaggcacttctttttatcgcagtcctttcaattgcgatcgtgattctcattaagggaattggtaatattccactaattaagcaagcaatgcaacgttatagtgaaaccttaatgaaagttatttatatcggtgttggttgttatgttttttgggatagtggattaattacccaccttattcaccttctttagtttggtataataattactaaaccgattaaaaggaggagcagcaaccattgtcttcaacccaagcctttattgatgaagctgctaaaatctataaagttttaagtaatagtacgcgcttaaatatcttatattatctccggcactataacggtgaaacggatgttaaaacaatcgttaatgaccttcaccttgcgcaaccgatcgtctcaaagcaactcggtattttgtatcgttaccagttagtcagtcgccataaagaagggacccgcgtttactatgctttagatgatcctcatgttattgaaatgattgatgacatgctaaaacacgttaaacatgaaattaagggtgaacctcatccccgaaatttatataaataaagagtgaacaggaaacaatcatcaaaagggtattctctattcactctttttttgttgttgattatttttcgctcttgtggataaaagaattgaattaataaaataatcagtctttcactttgtattctgagtagcgtaaaatgattagcagattgtcaaaaggagactcaaaatggacgaattatttgaacattcttcaatcaaacgcgcatactttacacttgcactgccggtcgtattgagcatggcagtaactttgatttataacatggttgacacctttttcgtcgccaaaactggtaaccctgatttagttgcaggagtttctcagggagccccgattttcactttaatgattgccctaggtgacatttttgggcttggcggtagctcagttatttcccgcttatttggtgaacaccgtgataaattagcacgctttgtcagcggttattgcttctatgcaccaattatttgtgggatcatcgttacttcaataatgattatctttcaaacaccaattttacatttattaggtgcctcgccagctacttggcaatatgcacgagaatattacttagtgattgcttggggcgcggttttcattatctttggactttcaccaactaatattttgcgaacagaaggtctagccattcagtcgatgatcgctagtatggtggggaccggaattaatatcgttttaaatccaatttttatttttacatgtggactcggcgcagctggttcagcgttggctactgtaacaagtactgttattggcgatattttaatgatttattatttgcgaacaaagagtaaaaagttgacgacttcaattcatgaaacgaaaatcggctggaagcttcaatttgaaatctacgctatcggaatcccggcctcggtcactaacatcatggcaacgtttgcggttgcgttaactaatcgttacttgattgtttatggtgcggatagtgtagctgccatgggaattgcgatgaaagcaaatatgatcatcaatatggtaatagttggttttgcatttggcgcgcaacccttgatcggatacgtatacggcgctaaagatgagcaacggtttaataaagttgttaaatttgacattcaagttgttgctagtcttacctttatgctcactattattcttttcattttcgctccccaggttattcgcattttcatgagtgatccccaaatagtaaaagaaggtgccttgatgcttcgctggctgtcagtttcgactactcttgctggtatcattctcgtttttacaaccatgttccaatcaatgggaaaagcaacgcctgcattttggctctcattctgtcgtcaggggttgattttcggggtagtgattagtatttccgcaaaattatttggttatactggaatcattgctgctcaggctatttccgattgtttaacctttatcctggcacttattttcttttattgctatcgtccgcgttttaaataaaatagatttagacatacaaaaaaaggcctctcccgtttaaatttttcaaacgttagaagcctcttattagtttattcggttatttttcgttcaaagtaatgagccagtttagcctctggataatatccagttaccttttctttcgcctgtccatccttaaaaaggaccagacttgggacgctcattactttataccgttgtgcaatttcttgatttccatcaacattcatccgcacaaacttgattttatcaccgtattgcttttctagattttgcatagctggttccatcattttacatggaccacaccatggtgcccaaaaatcaacaaccgtcattgagccttgaacatccttatcaaaggtctcagctgttgcatcaattgccattttattctaccttctttttctgtgatctacgtataaagtgaataataatcgttaccgcaaaaacaagcaagataaaactaccgaaaatccctgatggaatctcgatgtcaattgcaggaatcgttaagaaaagtttaatagcaatcacaaagattaagatatatgccatcggttctaactcaggaactttgcgcatcagtttcataataacttcagcaattcctcgcatacatgcaatcccaatcagaccaccgattaaaacaataaccggattattagagacagctaatgacgccaaaacagaatcaatggagaaaataatatccataaattcgatctgtaaaacaactgtccaaaaaagctttcgtccagttaaatgcgttttaccttcacgggtctttcgcattgctcgcttaccaaagaacttattatgaaagtaacgatagacaaggtaaattaagtaagcagctccaataactttgatttcccaaaagttaatgagatatactccgattccaataattaagaatcggaaaatgtaagaaccccaaataccatagaaaagtgattcttcttgttcttttaacgttggtaatacacgtgtctgagccgctaacacaacagcattatcaactgacagtaaacattcaatcataaccaacgaaaagatgattaaccaatcctgccctgatgtaacgactgttgcccagttatgtggatcaaaaaatggtccatacaacttctctaaaagtgacaattaatgtcctcccttaatttaaatttgctttttagctaagttatattttaccaaataattttcaaaatacgacggtaatggcgcactaatatttaaagatttcattacgaagggtaatatgagtttttgcgctacaccatgaagcagcatcccctctgttgataaaggattataaagcggatcgccaacaatcggatgaccgctatgtgccaaatgaaccctgagttggtgtgtacggccagtcactaaatgaagtctcaccaaggaacgttcgtgattacttgccagtgtttcataataggtcaaggccggctgcgcgttttgtccgtttacttgatgaagatggggattcactggattacgcccaattgcccaatcgaactttccactctgagccatcttaccctccactaacgccaaatattgtcggtgaatttgcccatcactaattaatcggttaaggattgggacaacaattggattcttagcaacaattactgctccactcgtttgtaaatctatccgatgaaccatataagcattattttgactatgcgctaaatagcctgcaacatcgttcattaacgttcctgtttcaccatggtaattagggtgagttttttgtccccgcggtttatttactactaacaaatcgcgattctcatagaggacctctaagtgtgattgtgaagacggaatataatcatttgcggcaggggtccgaatttcatcaccacaaaatagcaactgaatattatcatttcttcccaccagttcattcattgaccgatattcaccattaacaagcactgtccgcctaattcgtaaatagtggattagacgattaggaagcagccattgatcatgcagtaatttgcgtaatggttttgtcacctggtcatcagctaacttttcactaatttgccaccgatatttcatcttactcacctctctttcgcctaaattctgataagattattttactgtatttcccagtaaatatttataatatttttaagccggtttacttttatccgataatagcgttgaatagagtatgagtaattttaaggggatgggtactgatgttaacaacagaacaaattaatgatcatagtaaatggataagtatattcgaacctctcccccatgagcgattagatttaattgaaaaatatgaggttactcaagaattacttgattatgcaattgacccttacgaaaaagcccgggttgaaattgatccagatgcaggagttacattattaattttcgatgtctatgtaccaactcatgctgtgactgctccacagactgcaccaattggcatcatgctcaccgctaataatatcattacttttacaaatgcaaaaactaactttgtaaatggaatcatcgctaatcagctacaattattaaagaaacacggggaaaatgacgacaaattaaacttagtgttcccagttctttatcgcctttcgactgattattttggtccccttcgtcgtgcagatcaacagcgacaagaaattcaacgaaatcttcaacgacgaacgggccgccaagccattactcaatttatggaaattgaaactggcctagtttatattcttacctcgctcaaagggaatgtttccctacttgaagaatttaaacgccgctttggtaaccacattactactaagcaatataatgatcttgacgatgtaattgtcgaagcacagcaagggctagaaatggcacagatgacttcagatgtttctgcccgtgtctctaatgcttatagcaaggttcttgatagtgatctaaaccaaacgatgaaatacctaaccatttattcaattgttctctcaatcccaacaattgtatctggcttttacggtgaaaacgtcaaactaccccttgcgaacgggacctattcatgggtttttacaattttcattactattgtcttaatgttggcatgtgtcatctttcttattaatcgtcattggtggaaataaaaatcggaagctgagaacttttttctcaagcttccgattttttataagttatcgccacgttcaaattgaaatttagaattcaacaacgcttcatgtaaaagctggttaatcaatttatgtgtttcattcagaacatgattagcggttttcatattttgttcagttaggtagttaattaaattagctgaattttgaatctgggctgtttttgtaattgtgtctactcgtcctacgccatagctttgacaccgatcacggaaatcatttacctcattgataaattcatgatagtgtggttctacaatcacttctaacaatttatttaaccaataagcactcttatccggctgcgcatcatctgtcgcatacttatattttgccggagtatcactaatatttgtaaagaacggaacataagggctatagcaataaaagccaaaattaatccattgaatagcagcatattgtgccggtacgtcattccgaatttgcaaaatacatgaactttgattacgatcaagtgcaattgaacggaattttcgctgttcctccggtgttccagacgcataggttcccattggatcataaggagtgccattataatgcgatgagaggaaatactctacatcctcaacagcaattttcttttctgcatgttgaataaacggaattttttggctagtaggctcctgttttaaagatggggtaaagagtttttgaccataccaagaacgaggtgtgttgtagtaagcatccgcctcatcttgtgtgccaaaaatattccggaaattaaacgttcgtgaattagggtttaaatgatatttttctacaaaatctttaatttgcggcgcatacataaagctatcgtgatcattaaagtcgacttcttcaatgcacataatatttggtgcaattgcataagcatcatcaggaatccgctgggcaacccattgatggccaccaccggtctcaaaataccaaacttcatccttatcgctaaaggcaattccattactctcaccggtaccgtatttttcaattagggaaccaagacgttgaactccttcgcgggcggacttaataaatggtaggacgagataaaccattgaatcttcattaatcccgttttctactaacggatcatgaccaagcaccctggcatttgtcatctcggtttctgtcgcgctcatcgcaacattatattcattaatgccttgttcatcccagcgtccttcatcaggcatgccattgggagttgccgtataacggcatccctgtcccttcatctcaacagttaacccattatattttgaaacataatgttcaccggtgtaatccttggcaggaaatactttgaatatcttaggattgactccatcttctgcatcctcatcacgtgcaataattgttgaaccatcaatcgtcgcattctttccaacaagcattgccgtacaactactcattagcttttgcatagtatacgcttccttccacagtagttactgtaccttctaataataccactatctggaattaactggattataaagaaaaagctgaacgttaatcacacaagccaatctaaaatatcattaataccgaacaaaccattgaaaatgttcggtattagtgctaggataactacatcaaataaatagcctatataataccgaaatatggtcggttagtctctacctaaagccgtaaactttagactataagcacttcttaaaaactgacactgtctgtttttaactttaagcttttaaaaatcggtagagaggctgaattttcagtctcttatttttatttaggcgtgttaatttttggggaggtatattttgaaagaacctgtttcatctattcaagcacctagtcgtcacactaaaatcgatttcactcgtcaatggcaaaattttgtccttggtttccagcacttacttgcaatgtattctggggacgttcttgttccgctattaattggacattacttacatttctccacgcttcaaatgacttatctagtctcaatcgatattttcatgtgtggtgtcgcaaccctcttacaattaaagcgaacaccattaactggaatcggcttgcctgttgtcctcggttgcgcagttcaagctgttactcccctcgaaacaattggtggaaagctaggaatcacttatatgtatggggccattattgcagccgggatctttgttttcctaattgctggcttttttgcccgcttaaaaaagttttttccaccggtcgttactggatctttaataactattattggatttacccttgttccagtaggtttccaagacctaggaggaggtacgccaactgctgcttcatttggtgatcccgctaacctccttatcggctttctaacaattgccatcattctgttattcaatgcctttgctcgtggctttatgaaatcaatcgccattttactaggaattttaatttcttctttcattgcaggcgcattaggctttgtctctcttaaaccggttagtgaagctgcttggttccacgctccgcaattattcttctttggcgttccacgttttgatatgagtgccatgatcacaatgattcttgtttcgctcacgacaatgattgagtcaaccggtgttttctttgcccttagcgacattactggccgtcaattaacaaccaacgacttagaacgtggataccgcgctgaagggattgctgcaattttaggcggactttttaataccttcccttattctactttctctgaaaatgtgggtgttcttaaaatgtctggagtgaaaagtcgtcaacccgtttactatgccgcctttttactcttattgcttggtcttttacctaaagtcggcgctctcgcaacggttattccagaacctgtccttggtggtgcaatgattgtgatgtttgggatggtcggtgttcaaggagttcaaattctccataaagttgatttctctaacaatgccaaccttcttactgcatctgtttcaattggactaggattagggattaccatgtatccgcaactgttccagcatatgccaactgaatttcaaatcatcctgggtaacgggattgtcgtcaccagtctttcagccgttcttcttaatctgttatttaatcaccggtgggctaatcataattaattctcattcttttttaatttagttgttgacattcaaatctcagcacgatattataatttcaacaattatcgtttcagtagaaccttcgttgggcgtaagagagccggtggtgaggtgcgaaccggtcaggcgaagtgtttcgaattatcacgtgatctgaattgtccggccatattcagtgccgttaccacctgatatgagtgcgcataaaatcaagatgcgtaggtgggtggtaccgcgattaaaataatcgtcccgttgatacttttatcaacgggacttttttatttcttttctaaggaggaacaacgatgaagagtattcgtttcaaagaggccgcaaccctcttacttatcatgctaataattttagggactgccgtgattaggtttggcttgtcaccacagatccccgtcctatttgtcattgctttacttattttttgggttaagcttcgtggtgctagttgggacgagattcataagggtatccaagaaggaatcggtaccgcaatcatccccatctttatctttatccttattggcgcattaatcgctgtttggattcaagctggagtcatccctacaattatgattgtcggcttcaaactgattagcagtcaattttttgttccatcaacatttattgtctgctctttagtcggtctatccattggtagtggttttacaactatttcgacaatcggaattgccttatttggaatgggagttgcgcttaatgctaatcctgcgctggtagcgggtgcgatcatttcgggagccgtttttggtgataaaatgtcgccgctctctgattcaactaatcttgcctctgcaattgcaggtagtgaccttttcgcccatattaagaatatgatgtggtcaacgattccttcttttatcgtttcgctaattctattctggttctttggtaattccagttctcatatcagcaccggtaagatcgcccacacaatggctatccttaatcaacaatttatgatttcatggtgggccctactaccaatcgccttaatgtttatctgtgcatggcgtcatattccagctattccaaccttatttatcaatatcatcgttacagtagtcatgatctccttccaaaatccaggaatctctcttcaatccctcgctaaattaattagtgatggttttgttgctcataccagcgatgcaactgttaatacattgcttactcgtggtgggattagcaacatgatgggaacagtttccctgatcattgttaccctttcactgggaggaattttgatgaagtttaacattgttcagtcagcaatgaagccactcgttgatcatcttcacaagcctggcagtcttattactgttaccattctctcaggtattggcattaatctttttgttggggagcaatacctttccgttattcttccaggtaaggcatttaagggtgcatttgataaaatgggtctttcacctttagctcttagtcgtgtccttgaagatggcggaagtgttattaactacttaatcccatggggagttgccggctcattcgtcgcctcaacccttggtgtaccagtccttcacttcctaccattcgctttctttagtctgttttcaccagtcttctcaattttaagtggagttacggggattggtttgaagtggcaaaaaggaaagcaacacaatactacaaatgaaaatcaaataaaggaagcttaaaaaaaatctgggtttgagagtttctcttacccagacttttttattatcctgcaattaatacttctgttaccaataatccaccaccaaagattaaaacaaagacaactaccggccacacgaaccgcagccaatgagaatatcgcatatcaagcatttgcaaagttgccattactaatccagtcggtactaagaataacattgcatattgcccaaattgatatgcagtaacaaccgtatatcgtggaatatgaaccgtatcagctagtggagctaaaattggcattgctagcactgctaaaccagatgatgatggaacgataaagcctaagacaaagaataccaacatcatcacaataatgaaaaatgatccgttcatatgcgcaaccatttttgaagaagcatagagaattgtatcagaaatatagccatcattaagcactttattaattccccgtgccaaaccaataattaatgacacaccgactaagctagctgctccatcagaaaaagctgttgtggtcttatattcgcctaaaccttcttggtgcccgaaacatgttaaaaacataataataatatcaattgttaagaaagctgatgccatattaggaaaggcccatcctttggccattactccccaaatcataattgggaaagcacaagcaaataaaattaaaataattttcttttttaaagtaaaccgctgatctttttcttcgctagtagtcattccccacatttgatcaaatttgtcccggtcatcataggaataggagaactgtggattctgttgtactttgcgtgcataccaatgaaagtaaaataataaacaagtaactgcaataaccaagccaaaaattcgtcctgccattccttgcgtaaaagttgtcccagcagcatttgacgcaattacaactgaaaacggattaattactgaaaatgttgttccaagcgaacttgctaagaaaatagccccaacacaaacaattgaatcataacccatcgcaataaaaactggggctaagattggataaaaggcacccgcttcttcttcaatcccacatagggttccgccaagtgctagtaaaactgtcacgaggaacactaaaataaattctttccccttagttttggtagatagcgcggctagcccagattcaaaggctccacttgctttaacaacaccaatcaaaccacctaagactaagataaaaatcataatatcaactgattctatcgtaccatcgaccatactagagaaaatatcgctgaccgaagcaggatgctgttcaagccgcttataagttcccgatactgaaattggcttattgattgcaccagatttaaactggtcgacatcaatctgaatgtgcaatttatctaatgttgcctgtgttgccggataactaattttttctccagttggttgtgttacttggagatgatcattgacatatgctaacttagaataacttcccgctggaacaatccaagtaagcattactgcgatcactgtcagaaagaataaaattgtaaacgcgcctggcattttcagtttgaaccgatgtcttttctctgctgttgcttctcccatcttcctcactcctcaagtcttctttctcccttctgttaattttagcaagcgttttcttgtttcttgatataatcttttatttgttgtgctttaaccaaagtggttgaaaaattatcattcataatctgtctcctaatctactcggtttattacgattagccaaaagtcatccataagtttcactatttgaaattttttattatttatactaaaaatactccatgcattcaagcacagagtattcatctttacttattatattcaacaatttccatatcattatcggtcaacgttgcgcgcgtcaggcttccatttgctgggcgctctgtcacatcatactttccatgaccaaaccgttctactaaacttaaaacggtatttccatgacttacccataaaacatttgcattatcaggtaaatcagcattccgaattaattcaatacctttgttcattcgttgccagtactcttcattattttcggcatcatgaaatggatcagcatcctttaaccagtctttggcttgaccaatggaatatgcggttacaatttcacggaagttcttaaagccatgaggggcacccgcattgtaccaagcaagatccatatttgttccttcatatgatccataaaactcttcccgaaaataaggagcagtgactggatgagctacagaattagcattattaagatttaagattacttgtgctgtttccattgctcgggaaaggtcactacaaaacgcaccatcgaagtgaatgttttgtaacttctccccagctacctttgcatcttctttgcccttcatagttaatggcgaattactccaaccctgtaatttgttgtaaatgttgaagaaagtctgtccatgacgaacaagataaatattcaatttagtcataacgatccctccataatcttattgtaccgcttacaaatccttaagactatttaagtattaactttgagctttaaacataatttcttcatattctccacgtagactaaaaaatatagaaggaaggaattattatgaaacttagagacactagtcaaccaaatattgttgccgctaagattattaaagttactccgaaaaatgttaccgtaattactgaagaaggccacttactcaagattccattaactaaacaatatcgggaagataaaactttacgggcatcattggttgatatcttgaaagcaggaatatggattccagtaaataaaaagctaaaaaaattatttagttatgactggctttttgttcctgccttggtcccagcaaagaattaagtttcttcaatgatttccataaaaagaatgttttgtagtaatctatgataaaataattcttgatttgtcgaaattgcacttcgataatatagaacaaaccatattgattgcgaggaacattcctaatgaaaaaattaagcaaatttgtggatactaggattggttttttcaccctcctagttatccttttttggttaaagaccctgtttgcttactttactgactttaagcttggcgttacgggaatttttcaataccttattttaatttttaacccattagcgaccaccttttttatttacagtttagcattctactttaagcgttcgcggttcttctacccagttattatgggtctagatatcgcaaacaccctattactctatttaaacgtcatctattatcgtgaatttaccgattttatgacaattgctacgatgaccggttattcaaaagttaatcaaggtttaagtggtagttcacttgccctcactaactttcatgatgtcttttactggttagatatcgtcgtaattcttattttaatgctctgtaaagttatcaaatttgatccacgagcaattggaacgcggttagcatttgcttttagctccgttggccttgtcttatttgggattaatttatcttttgcagaaatgagtcgcccacaattactctgccggacatttgatcgttcctacattgtgaaatatcttgggattgatacttttactggttatgatttagtgaagtcgcaacatatcaataatatgcgacaaagtgctactaaacctgagctcctaaaagttaagaagttcactgataagcactacgctccggccaatccacaaatgtatggaattgcaaagggtcgtaacgtgattattattcaccttgaaagtttccaacaatttttaattaacaagaagatcaatgggcaagaagttaccccattccttaactcgctttataacggtaaggatgcctactcgtttgataatttcttccatcaagtcggtcaaggtaagaccagtgacgcggaaaaccttttagagactagtacatttggattgccacaaggatctttatttgccacactagggagtgacaatactttccaaggtgctcctgcgattcttaatcaacgcgccggttacacgagcgcagtcttccacggaaacgttgctagtttctggaaccgcaataatgtatacaagaatttaggctatcagtacttctttgatgctagttattacgatacttctggagacaaggctaccggatatggacttaaagataagttattattcaaaaactcgatcaagtatcttcaaagtttacagcaaccattctacgctaaatatattactgttactaaccacttcccttacacgcttgatgatgaggataaagatccaaacttccaaacaactaataccggggacagtaacgtcgataattacttcgtaacagctcattatcttgatcaatcaatccaagaattctttaactatctccaaaagactggtcttgataagaaatcaatcattatgatttatggtgatcattatgggatttcaaacagtgaaaatacttccttagcaagtgttcttgggaagagtgcagatgattggactgactttgataatgctcagctgcaacgtgtaccactaatgtttgtcattcctggtacgggtcacggaaaagtttatcatacctatggtggagaagttgatgttcttccaactctccttcacttattaggaattagcagtaaacgctatattcaatttggaaccgatctcttctccagcaagcataatcaagtggttgccttccgtaatcgggattttgttacgccaacttatacgagtgtgggcggaacaatttacaataataagactgggaaagaagctaaacttaccaagaagcagcaagagaaattaaagaaggatcaagattttgtaaatgaggaattaactctttctgattcattaaatgaaaagaatctcttgcggttctaccatccaaaagggtttaaaaacgttaacccagctgattataattattcaaatggtctaaaacgagcgcagcgaatcgagaagaagaaaggaattaaatcaacaagtatttactcagaaaacggtgaccgttcaactgtagatgactacagcactgacgcccctgagcaaagccactcttccactgattccaaccgtattaagatcactaacccagatgctaataataagtagtaagggtacaaaatagtatagtagggtctaggagagcactgtgttctgcctaggctctattttttaagtttaagctaatttcaatcagctaaattttctctccattaataaaagtgatattattaacttgtacacaaagaataatggagggatttttatggttgaagaatttggctcaccgtcgtcttacatccaaggcaaaggtgtcctttttgaaagtgataagtatcttaaaaactttggcacaaaaccgttattactggctggcgaaaccgtctataaaattgtaggtaagcgttttgaacaatatcttcaagaaagtggttatgatgttacccgtgttcaatttaatggggaatcatccactaacgaagtaaaccgggtcacagaaattggtaaagaaaataatgtaaccgtcgtttatggtcttggtgggggtaaaacagttgataccgccaaagcaattgccgacaatctccatctacccgttgtaattatgccaacgttggcttcaaatgatgcaccttgttcacgtctctcagtaatttatactgatgacggtggatttgaccattatcgtttctacaaccaaaatcctgacttggtcttagttgatacacaagttatcgctaatggtcctgttcggatgttaatttctggaattgctgatgctttagctactaatattgaagcacaagcagttgccaaagctaatagcgatacaatgcttggtgaaaaacaaacccttgttggaaatgcaatcgctcagaagtgtgaagaaacattatttaattactcacacctagctgtagctgatgcagaagcgcatgtcgttacaccagcattttctaatatcgttgaagcaaatacactaatgagcggtctcggttttgaaagtggtggtctatctggtgcccacgctattcatgatggcttaacaattttagaagagactcatgatttaacacacggtgaaaaggtcgcatacggtaccttaacacaattaatgttggaaggcgctgaccaggaacgttataacaagtacttccaatttattctttctttaggtctaccaactactcttgctgatctacatttagaaaatgtcactgatgaagaattactcaatgctggaaaagccgcctgttcagaacaagataccatggatcgtttaccatttaaggtaacaccagatgacgtggctcaagcattacgagcagttgatgcatatactaagcaatatttaaatagtcaccattgtcatcatagccagatgtaataaaagggagcgagacagaagtcacttgtgacttcgtttttcgacgcgaagctagcctctgggagccccccgcaagcaacaataggcctctgacgttcggtttccggacgttagaggccattgttgtactgcgtatttgctttttatgaaagtaacttaacttatgtcacagtccctttttttgttatttaccctataagaaattaattaatgctttatcaacttgagtattattatgaagttttgaatgttgagtatcttttcctgttatttttagaacacggtatgactttgcccgagcagccactagatacttaagtgacaatgaagatacattatcaacagtaccgtctgaatgattaccaacatcaccaataatattaagaacagctacttgacctttcggataagtttgccgtacttctgtcatttgacgatatgtggcgttcatttcatttggttttccgtctttatttaatttcattccaactggttgctggatagcagcaggtacctgtttaaaattcaatccagcaaaatgacctgcgatatcaacctgtttttgtaattgaggcatattctgatttttaccgttttgcaacatatagtaaataatcgaaatatttcccaggaaatgaccaaccatattaatcttagttatgcgatatcgtttctgtaatgcttttacaacatttgtcgcatattcgccatgcttattaaaatccaactgcctattattatcataattcacctcaacaattggattaatgacccctttatgcattgaaccatgaagagtaacttttccgttattagtaacatcagctcgcaggactatgctcgttaccccggcttttttagcagcatttaccatgtgttcttctgcatgataactactacctccaccacggaaaaatagtgttggcgttgttgattgcatatatttactatgtttttgctgacgccaaactgcaccaccaattattgccaagataacaattactatcactacaccaatcccaatatggctttttttcataattttcacccgcttttttatttacctagattataagcctaagaacaataatgcagtcaaaaattactttaatgtagaagacgttgccaaaagtttccccgtcgaacatcattagcactatatagagagtaagttaatggttcaccatcaagcgtttctaattgatcactcgttatccttaagttgccaacacgttcacctttccagataggtgcttctagttttttctttttatattgtgttccaattgtataattcgtttttgtatcgtaaggactccaaatagttacatgttgtggcgtgagtttcattgttttttcaacaccattagctactttacgtgttgttactgatgatggaacttttattttttgtaaatggtcctctgtcttaaggatcttatataaatcctgcgtagccttaaatcggttgtctttattgctcccttttgaatgtaaaataacagtaataatgcgatgtccttgatacttacctgtacttgtaaaacaagctcccgcactgtcagaagtccccgtcttcaagccatcaatcgttaccccttttacagcgtactgttctcccggtaacatcttattaagattttttgcagtcttaacttgatcttttgctatttgaaattttacttctttttgtgctgtaatttgcaaaagttcaggataatgttttacaaagtattgcgataaaatggcaacatcacgtgcactcatcgtattagcagcattattagggagatccgctaacttaaaacttttcatatctccattatctaatccaaccgaattcacaatgtttgtcttagtcattccaatttttttggctttttgcatcattttaagattaaattcatcggttccatccccggtagctgttgcaagtgcgacagtcgccccatccgctgactttacaagggctgcattgattaatgtccgaactgaataagattgaccagattttagtccgattgaagaataagcagcatcattagaaatagccgcaatttcaggagttatttttacttgagtatcccatgaaagttgcttttgttggatttcatcttctattaccaaaatagttaataattttgtaattgatgccacgggaagagccttatctacattttgcttatagataatttgccctgttgaagcatcagccatgatcgctgcagaagcatcaattcgattatttgctaacactgattgacttcctaccattagcatcatgaatagagataaaataaaaactgtcaactttttcataaaatctattctcctattttcttcaagtacggtaagataaacttaataataaataataaaggaattcattatgaataaagaacttaaatcgctgcttttcatctcaactggtctattccttatttttgttctaatttttaatctttatacatataatgctgctagttttattccccaagctagcaaaacaagtcaaattcttagtcaaaatcggcttcgtgctcctaatattcaccgttcctctgaaaattgggcataccctaagatcggtaacgctcctattgaattgatcgccatcaaacaagcaaaaaggattctagttatcaactcaaataagcgccaagttatttacattattcacgcacagattaatctaccagcacaaaaaaattctttccgcttacttcacgctcggggcagcaaatttatcatattaatggttcccagcaagccatcgctaagaattggttaggaattactaatgggaactacattgaaacccccgttacagatatgaataatcatcaggtctcacgaaatctacgaaaagcacccaaaattgaaaatactatccaggtgtcaatccccgatgctaaatggctgcaaactttacctgaaaacacacccttaatagttaaggaggactattaatatgatttcacgcctaaaacatggacggttttttaatcacttacttggaagtaatcttattttgctaattataattagcttttataatcttcttacatacttcatcccattaatcaaaatttcaatcattcaaataattttattctttctaataattgacctactcttgattatctttaagattttagcgctatacaattagccgacaatctcaatcttagtaccaactggcaaattcttttccatccattgagcgtctggcactgaaagccgaatacacccgtgagaaccctgtgtttttccaagcttagcagcttcttgttcattatattttccatctgctttagtcggaacactatggaacaagtattctccatgattcttccaagaaacgtagtaattagctccctctttcaacgattgattaaagaagctatctcctcgctcttgctgagcataaaatgttcctgtcggggtcacacttttcagtttaccagttttaggatcctttttataaattccacctgtgctatacattgtataaatgacttttgaaccatcatacaaatatgtccgattattttttaaatcaactttaatccaaaagtccttcactttattcaaatctggatacggaactgtttccgaggacttatgccaatcaattggggttcgcatatgactttcactattatcgattttcttttcttgtgttggtttttcttttacttgcgattcaactactgctttttggggatgggcattcgaagtagcacgtaattctggaccaattgcaattattgctactaataagcaaaatattccataaatccaatgcttcacttgtaagttcaaattaatttctcctttacagataattcaaaacatcactattataattatagggaattttttattcaatatactttaaaaaaggtgtacaaaatgcgggataatcttaaagtttcatacttaactgctatctttttctttattgttgctatcatttatgcaaatcttgcgtaataatcgtgaggattctactatgacatcatttttttcattcatatcaaatatttggtcgtataccatcaaccataaatggtcaaaggatattttacgagccaacatcctttttattcttttagttattgtttacgatctttttcacttttcattaaaaataattaattggcggatcttttttaaagtatttctgctattaaatatttgtttgttttttaagttccttttagatggtattgatcgctatttaagaacacggtaactttataaattctttattgagttatcaattttccgtgctaagataggaacgtaattatttattttcgatttgaggaaggtacaatgcattcatatattaaatactggatagcaggaataggagcattattaattataatgattgcggggatgactgttcaccagaaaaatcatttcaataaaaacgtaaccatcaataacattgccgtgggagggctaacagccaagcaagcttttgataaggtaaaggggacctcaggagcaaccaaggtatatgttgacaataagctagtttaccaaactaaatccatgaaggctaattttagcaataatgatgaacaaaaatttaatcaagcactgaaaaagcagtttacatttttcccatcacataaagcaacgaacttatcaataaagccagataactttgatcaagattcgtttaatattgcgaaaaacaaattaactaacgaggtacatcaactcaacacaagtcgtaaagctcccgttgatgcttacgcggtctaccaaaataagaaagtttctgtagttcctgcagttaagggtaataaatatgatttaccaaacgctgttaatcaactaaataatcaagccggaagtactaaaattaatattactttacataaggaacagccgattgctgcaaatagcaaaaccgttaagaacgaggaaaaacagttaaataagttaaaagggaagaaagttacttacctcgttcaaaatgaaaagtataacctcactaccaatcaaattattacccgggcaacctatcaaaacggcaagtatcatttcgacactacggccttaaataaacaagtaaagaaaatcaatgagaaacatgcaactcttgataagccatttaaatttagaactcattctggagcagaaattaccactacagctaatggttcctatggttggaaaattagcgagaaaaaagctggcaattcattaactaaagcaattatcgatggccgccaagaagttgatggcgagcacgatattgaaggaaaaggctataacactgctggactcggctacaatgttacatccaataatggtattggcgacacttatgctgaggtttcattagctgaccaacgagcttatttctacaaagatggtaaatgtgtccttgaaacagatatcgttagtgggactaataacgaaggcaacaaaacgccaaagggagtctggtatatcatgtaccaacaaagtccttccgttctccgtggacaaaacgatgacggatcaagttatgcaagtaaagttaattattggtcgccgtttactttaacgggatgtggcttccacgatgcaagttggcgtcacaattggtccaagactgcttacctaagcgatggttcgcacggctgtattaatatgcaaccaagcgtggctggccaagccttccatgatttaaaacaaaatgaacccgttattatttattaatactctagggagcgagacagaggtcacttgtgacttcgtttttcgacgcgaagctagcctctgggagcccccgccaagcaataataggcctctagcgttcggtttccggacgttagaggccattattgtactgcgtatttgctttttataaaagtaacttaacttatgtcacagtccctattattttaaaagaacgcctaaccggactgtggtgaaaaacttgcaagctaacttattttttattctcttaattaatatatacgtaaaaatttccctttgcacctcataattctaaaatagtggtacagtaaaaataaaccttaggaggcttagattatgactgataaaattgttacttcagaagaaatgcgacattacgattcttacaccattaatacaatcggtatcccttcccttgtgttaatggaacgagctgcattagccgttcgtgatgaaatcttgcatgcttttccaatcgcgctaaaagatgtggtagtagttgccggtagtggaaataatggcggggatggaatagccattgctcggttgctgcatcttgctggtgtccatgtaacaatcctcaatataggtaatcctaaacatgcgtctgctgaacaccaaacacaagaaaaaatcgcgcaatattatcaaattcccgaaacctctgatctcgctgtccttaataaggcaacattaattgtcgatgcaatgtttggaatcggaatcgatcgtgcagtaaaaggagcttataccgacgcaattaacgccattaataacactgatgcagttgtcgttgcagtagatatgccatcaggaattaatactgatactggagaggtaatggggactgccgtcagagctactacaaccgtaactttcgcctataataaagttggcttaaccaagaatgccggaaaagattacgcaggaaatattgtcgtcgcaaatgatatgggaacctatgcagtagactgattggaatattatttaccgagccgttttactattaatcgctgaatattaatattattataataagtaacgaacgtttcagtgaactaatttggaggtaaataatatgtcagaattaacaaccaaattatttatagacctaaatttcaagaataagttagccactggactcaaataaataatactgaccaattgattattggttgatggagctgtgatatctcttggtagaaggccttacgatagatatccattgacgaatgtccattaaacatagctcgtggatagtgattcatccaatcattagtcgctatgatctgagcactactatagttatttatagcttcacctttggtaatctccttgcggagaaaccggttattgatctcattggatccacgttcccaaggggaatacggatcagcatagaaaacatgatcgtgaacttgtgttaactcactaaattctgaaccgttgtcagaggttattgtcttaaagatgcgatagtaagcatctgtgcccattttctggcgtaaatttataaagaactgatttactgcatgcgcagttttaccagcaattttactcgtgatattaactcgtgaaaggcgatcagtcattactagtacaacactgtcattaccgtttttctgtccctgaactgtatctagttcccaatggccaatttcggaccgttggtccgcagtttgaggtcgttgagcaatattaggacctaagcaccttttagcttgcggatgagttcgatgatgcttacgtttaggcttttcaaagaggtctaaattggacgtacgaagcacaccctcattaatccattgatataaagttacaaccgactttgggatcagggtgccatcattcattaaatctcgagccttataaataaccgcttgtggggagtaatggtggtcgtcaaactcaccaagcattagctgatcagctaatcgtaaaaattgctttgaagaataatataagcgacgacgaccagaatggcggtgatgttcaagatatgtggcctgaccagcttcataactatagatgtagtaagaatattcgtaaatcttaccattagatttttgacgacgaagttggcggaccgtaccacggttgagctcgttattaattgtttgatgattaactcctaattggcgaccaattgcgcgattggaaagtccttgcgactttaaagtcgcaatcatcacacgttcttctttagtaagatgagcattctttttatgagtagtcaataaactagtagacatggtatcatttaagtgcgtcatttgacggacatcctttcatataggtttggttcacttaatatgatacctgatgtcacgccgaatggcgttttttatttaccaccaactgggtggctaacttcattctataatccaccaattatttatagatgttaaaaattttgaaaaataccaatcaatgttaaagtgccaagtacacattgaagaagaacgtcatggtgattattgcttaccgggttttcctgatcgtcacaatttccaccgccttctccggattttacgtaaacatgatgacggtttaactagcaaacaactaatttatgacttcgattaccggccaagtgacctcgaagatgctactaaagcattagtaacaaacaatttgtcaactactaccccaattaacgaggaagactacaaaattcaacttaacactgaaggtatcgaagttgctgataatctgctaaagcgccgtgacaaaattgctgaagctgcttaccacacattaagtgaaaatgaacaacgagaattagaccgtcttgtaaacaagctaatagaggattatgcaaaccgcgacgtaaattacaacgcccttggaaatatttgccgttaaaatataatatcctattcaaaaaaggcagaggctaagagaatttttttctatgatcccttagtttctgcctttttagtagcgacaagtcttattaagaaagtactttcccgctcactttcaatttagttattttaaatattctgctggatttgctacaaaatcgctaattttaatagttgttgcatccttagtagcagcattctttaattggaaagttccttcttcaacttcacgagcgccaaacactgcaaagtacttcgcattacgacggaaagcttctttgatctgcttaccaacttttaccccactgtaatctttgtcagccacaatcccttgctgacgaattttactgaggacttcaaatgccatttcatccccttgctgatctgcactagcaaagaagacatctagttggtcttgaggagcaaatgcaggattttcttcttggagtaagagcattaatcgttcaacacccattccgaagccaattccaccttcttcagggccaccaagttggctaatcaacccattataacggcctcctgcacaaacagtcgtgtacccaccaccaaatactggtgagtctgacataatttcaaaaatagtatggttatagtaatctagaccccgcaccatattggtatcaatttcaaaatcaattcctaatttatttaataaggcctgcacttcgtcaaagtaagcttgtgactcttcatcaagataatcaaggattgatggagcttctgcaacaatcttcttatcgccttcatctttactatcaagtacacgcaatggattcttatataaacgttcctgagagtctttactcaattcatcatagtgaggcttcaagtaattaattaatgcttcacggtaatcttcacgaacttttttatccccaagagtattaataaccaatttaacatttggcactccaaactttttaaagagcgccattgccattgaaataacttccacatcaatctgtggtgactcattgtttaatgcctcaaccccaatttggtggaattcacgttgccgccctgattgtggacgttcataccgaaacattggccccatgtaataaactttataaggtttaggatattctggaccatagagcttattttctacataagcccgtactactccagctgttccctcaggacgcaatgcaatatgacgatcacctttatcatgaaaatcgtacatttctttttcaacaatatctgaagtatcgcccacattccgtgaaaaaacatggtaatcttcaaacatcggtgttcgaattccgcgatatccaaactggttaaaaacttcgcgcgcattttgttctactttttcccaaatacttgtagttcctggtaagatatctgcagttccctttggcttttgataatccattaactgtgtttcccctttcgttacgtataaaaacaaaagccctctaagaccttaacagccttagagggcgatattcatcactgttccacctctatttcacagtaacctcacagtcactgcctcatggagttgcgttaactcctgatgataacggaatcaccggaacagactactaaaattcatcctttcagctagtagaggtggatcatgtctgctcccagctctcaactcaactggatctctgtcaattacacaggcactttgtttctacgtcaatgcttttataatacattagtgattttaccatagcttacagattttgggtatcatttatctaaattaagccgccgttgaactcggtgtaaataccataaataaagacagataataatcagagtaccggtcattagacaaaagactgaaataaataaaaattgataacttcctttttcaatgacaaatccaccgtacaatggaccaatcgcacgtccaaccgacatcataatattaagcaatccttggtaatgcccagcttcgtcgacattagtcagttgagcaatccaagcaggtaggccagcaaaactagtcatttcaccaattgttaagattacaaaatcaataacaaatgctgtcaaagtccgagcaaaaattaacaggaggaaagatagggcaaaaataaagattcccacaataatttgcgttgataaacgaacatagggacttaacttattaacaagtggttgtccgataataattagcaccccattcaatgtccataacatactataggcatagaatggaatccccatgtttgtcatatggactgccattacactttcccataaggaataacttaaatgaaccgtaatatagtttatgagaataaaccaaaccaagacgatccatcgcgaatgcaattggcgggaaacatgatagtgttcttggatctctgaattatttttaattgcatctacagccacattaaatgttaaaacaactactagcattaacaaggcataaaagattgttgctacagcaaaaactaccactacactaatcggtaaaagaacacccaccagcaacgttccaatcacaactccgatattaaaggccatataaatataattaaagacataacgggaagaatgatcactgaccaacgtcccataagaattaacaatcgtggcattgattccatccccaaagctgttaattgtaattaggacagcataccatggccaatcatgaataaagatcaataagaatattgctagtgttgagaggctaactcctaaaatagctgtttgatattgtttccaatggtcaaataaccaccctcccaaataatttcccatcatcatggcaatggacattattaacatcacaaagccagcagtcgtcagagtttggccaaggtaattatgaagatacatagttgtaagcggccataaaaaagctgcccctgtgttgtttaacagacttgcaagggcaacccattttaattttaccgtttgctgttccattttaacgttcagataccatatcagaggaaggtacacgtaaaagcgtataggttacagcactatgatttgcttttaaccctaaaccattaatagcagtatttttatactttacatccattaccgctgcaaaagcatggcctgttttggcatcctctttttccaattgctttttatcccatggcaaagcactcgcatctaaggtaactatccgcgatccatcagcaaccgatccataccgtgaatttgttgtatatttatcatttccagcccagtacgtatacgacacaattgggtgcttgccgcttttactacgcgtcgctaaaacataatagaaatcatctgacttatttcccatttgaagtggacgataagtgattgaagtctgtgtttgttgatgattattaatgtcaactggacggaaaaatgtgagatatgacatcccccgagccaacataacgagacaactaataagatcacataacgaatcactaaatttaatttaaatactttttttgtcttcgcaatcagcattaattgtttaacacggatatagtggattacataacaaaaaaaggcaattgcacatatccacgatagccatcctagccaattccaactcataattttcaatactccattctctaaattatttactatgattatcacacaaattgattcacttgtcgttaaatcttaataacaaacaaataaatttaataaaataactacaaggataagttcaaactgtgctaaactaatttttggtaacaaactgtgtcttgatttagaataagagataaggttagtattatttaataatatacctactaaggaggaatgttttcatggacaatttgagtgagcttgctcaaggattgattaactttgagcgcgaaaatgacttaaatgataatgaagttgctttcggcagtcatttatctgttgaacgaattcacgaaattaaatcatccaatactccagtaacttcagaagaagtcgaattgcttcaacggttcatgcaaagtaagtaacattaccattcataccattgtagcaaaatcaaagctaaatattttctaaagcagaactaataatatttctctgctctaatctaaaaaggacctagaagaaaacattactttcttctaggtcctttttctgcttattttggttgataaaattcaaccggaacaagtttagtttctatcttttcatgaggtgtttctattcgcttcattaaggtttcaattaattcttgtgccaacaatggaattggttggattactgttggaagataaggcgctacttttcgaattaattgcgagccatcataacctgtaataaaaaagtctttatttatttgctttcctgcttggtagtaaagattgctaatcgttaatgcttgaacatcattagaagccagcaccccatcataattaccaggaaacgtagcctcaagatccaaatgttgaatagctaaaggttcaaaatctcgtttctgtttattcaaaaaatcaagtgccccttgaatccgattgatggtaggtgaaacagatgtatcttcatccacaattaccgccaagtgttttacatcatgttctaccaaatacttcgctgctaattcacccccgtggtaactatcagctgcaacaattgggatattatcggcaagatatctgtcaaaagaaacaatgggagcagtaagttggtgatattcctctatccccagattatgagaacccgaaataatcccatctacttgatttgccatcaacatatttaagtattcatgctctatttccggattttgtgccgatgatgcaataattgttttataaccctttttaaataactcatgttcaagctcatttgctaattctgcaaaaaatggattaattaaattaggaaaaattaagccaacaaacttagatggtttcccttgcatcgcccgtgccaaggcatttggttggtaattcaactctcgcatcgccgcatggaccttatcaatcgtcttttgacttaaagaaccataattatttattactcttgaaacagtagttactgagacccccgctaattgagcaacatcttttaacttagcaaccattctaaaactccttgattaatttcgtttaagttattccattattatagctcaccacatttgaacaatcgacggttactttaaatataattttaatcgctattttcacaaaaatgtgttctattacatatgtttaatttatcatttatctaaaaatatttttcatttgataaaacatgttttgtgaagatgataattattgattttatgatattttctccccagttttaaaggatttcacttgttttttaccttcaaattaaattgacgctaaagagaattaatgctagtttataggtagttgaatctttagaacttcttaaactttttgacctttttgatattattttaatttatgaaataattaataagccacttttaggagtaatgtttaggaatttcaaatataacttaaggagtccctgccaatgaatcgtcaatctaataatgatccatcaacccattttaaaatgtacaaaagcggaaaaaaatgggtcttcgctggattaactgctgttaccttattaactgctagcggcgctgttgctcatgctgatgatgcttcagtttcttctgcagagcctgccgccgctactactgccaatacacaaaataatacaaatagtaccgctgattcttctgctgccactcaaagtacatcaaacagcgcctcaacaggaaatagtgctacttctaatgccagtcaaactgttgccagccaaaccgcagctgattcagctttagcacaatctgctgaagctaaacaagctgctcctgctgctccaaaggctgctagtgccgttgctacatcacaagagaactcaataacagatttaagcgccctccatttcagtaataacgcttcacaacaagcattcatccaaagtgttgctcctggtgcaatccaaggatggaatgaatacaaagttctcccttcaattacagttgctcaggctatcgttgaaagtggttggggccattcggccttatcaacccaggcccataacttatttggaattaagggttcctataatggaaattcagttgtaatgcgtacacgggaagtttatggtggccggagcgtttacgttaacgccaatttccggtcctacgctaacaactccgaatcagttactgatcatggtcgctttctcaacgtaaatagtcgttaccgtaacttacttggcgatactaactatgcatctgttgcaaataagcttcggcaagacggctatgctaccgatccaagctatgctagtaccttaattcgttttgttcagacatataacttaaatcagttagatgccgttgccctttctgggaaagttgttacgaataagcaaactgaaagtgctcaaactcccgaaactaatgtaactgtttcaaacactggatactacacggttagaggcggagacaccttatcacgcattgccggacagtttaatacaactgtaaataaactcgccaccttaaatgatatccacaatgttaaccgtatttatgttggtcaacggctcttggttcgtcaacctgctgaacaacaacagcaacaaacaacccctaagcgaactgaaaccaatactaccactaatagtaatacatacaccgttaaaagtggcgataccctttcaggaattgctggtaaatttaacaccacttatactcaattagctcagcttaatcatattagtaaccctaatgtgattcatgtagggcaagtattaacgcttcatcaaactacagctcaaaatactactaaccatcaagaaagccagcaaaataaacaagttactactagtgctaatggcacctacaccgttaaaagtggcgataccctttcacaaattgctgctcgttttaataccacaacatctgcattagcttcaactaaccatattagtaaccctaatttaattgaagttggtcaacaattacggattaacaatagtgctagtgctcaaaaaaccacttcacgccactccaatactaacaatggaaattacgtagtccaaagtggtgattcattatcaaagattgccgcttatcatggcttaaactggcgatcaattgcagctaaaaataacattcaaagtccatacacaatctttgttggacaacatttatcactttagtcaaataaccattaaattattatatgatataaagcaagaagtataagaaaatctatgcttcttgcttttttgttttaaaaaaattcttttctgttctagaataaaggtaggcagtttattattaatattcactaaattactattagggagtttatagaaagtatgtgatatttattgtggtagaccgttggacaacagatattccaaatgttaataaaatcagtcaattatttaaattactagggaatcctaaaagattacaattattatatttgctgattcaacattcaatgagcgtttcagaaattagtatgaagttgaactgggaacaatcgggggtttctcaccagctgcaactattgagaaaatataatttagttcaataacggcgagaggggaaaaccgttatctatcatttagaggatccgcaggtaatgaccttgatcgctgatgtattaagtcatgcagaaaaaatcatccaataatttagtgaatattctttgggatccccccattgaaataaaagaaaggcgtttagaactcatcctaagtcaaacttagacgatgacttctaaacgtcttttcgttagttaataaacttaatttctaatcgttcatcttccaaaactccttttacaatcaatgacttaccatcataaaactgatgcttatctaaccaaaatccaagatgggcgtgactataaaacttaaaactataccgcattgcattattcagtttactaacctgcaacacaccttgtgagccatcggaacaagtaatattttgtgattgattattattatgaacataaattgttgtcattcttctcacctccgtttttattatatctcaattttggactaccaaaaatatttttaagcaaaacaaaaaagcaacaacttcagctataggaaagttgttgcttttaaactaatctgcagctaatgcatcgattggattaaggtttgccgcccgacgtgcaggaagcaatgcggcaataaacgaaattacaatcgcaattacgattgcaaagattacatttccaacagtaatttgtacaatattatatttaatcaagccatataaagcgtggttaataataaccgttacaactgcaacaattagcagtgcgagaattgcggaaaacagtccaataaagacggattcagacgtaaataatcggcgaatatctttttttcgctcacctagggctctcaaaataccgatttcctttgtccgttccgaaactgacatgtacattgtcacaataatcattaatgcagacacaagtaatgaaattccagcaattgaagcaagaaccgtggaagcaagactaacataagtattaatggttttaaggattgacccgactgtaatcgctcctaatatccgtttgttattactaccacgaagattatcgatcttattcgccactccttgaacactgtcaagatttgttacattaacggttgcaaagttagcagcagtagaggcattcgctttttgaagcagcgcacgcatagtggaataagtaattgaagttccagcactcgcgccttctgtaatccctgccaccttgaagtttccagaaacgggaactggattattattggcatctatccatgtaaaggagagacggatagttttaccaaccatttgcttataatttttagcacttgataattggattgcttgttgctttgtaagaacgatttcaccattcttgggtttatgcccctgtttaattgaatcactagtaattgccttactcgaggtacttagtgaagtcccactttgcttttttccattataatcaagctgaaaggcgctcaccataattcccggctggacagacgacacattatcaagctttcgtaaccggtcaatattatggtcactaatcgtcattgattgaggattagccgccatcgtttgtcctaacgatgattgaatttgttcctgggtcatctttttaccagttgtgtttttaaatacggtaattgcctgcggattagcaagagaattaatctgattttgaatgtacccatttatcccattacctaaaccactaaacaagagtacggcaaagataccgattgcagttccaagcataattaacgaattacgccaaaagttataggtcaaatgtttaaaagccgttcggtagctcgccatcgccggtaaaactcgtggagtaatctctgttgggtcttctggaatcggataagcaggacgcaatctttcatcgccgtcaatttttccatcagctaaatgaacaattcgtgtcccattatccgctacttcctgggagtgagtaacagcgatcactagtttcccatcacgagcaatttcgtctaataatgctaatacttctttggtattctgtgcatctaaggctcctgtaggttcatcagcaataataatttgcgggtcacttgctaatgctcgggcaattgctacccgttgcttttgacctcctgacaaatggttcggatgcttttttacttgttcacttaaaccaaccttatctaagagttccaacgcgcgctttcgccggtcttccttagtcaacgttgtcatatccaacgcaaccaaaacattatccagcaccgtcaagtgagaaattaagttataggactgatagatataacccaccgtcgcgcgccgatagctatctagttgcttttcttttttatgatcgaggattttaccatttacgaggacttcaccttcaaagttacgatcaaggcccccaatgatattcattaaagtggactttccaccacctgattcaccaaggatggatacaaattctccccgatcaaactgtaagtcaattcccttaagaactgggaattcctctttgtcaagataatatgatttatatatgttttttaattctaaaaaagccattgcatcctcccctttactatttatttagtctgtttattatagcaaggttcgttatgaaaaaggtttttcgctcataattctttaacattatttatattattggtctggagaatttttacttaatgtaagtttcccatcagctaactcgtaaacattatctgcatattcacgcaaacgtaaatcatgggttacagcaatcactgcttttccttcctttttagccagatcttgaaataattgccccactgtctttactaaattactatctaaggccgctgttggttcatctgcaagaattatctcgggattggtataaagggcacgtgcaatcgctacccgctggttttgacctcctgacaattcagaaggatattgcttgagcagcttctttattgcaagcttttccaataattcatcaaaagcttctgatgagacgttcccattcttctttatgcgatcaacaagcttaaattgatccgccacatttagatagggtaataggttatacgactgaagaataaaaccaatcttctgtaagcgtagttcatcacgttttttagaagataatttctcaatatcaattccatcaattaatacttttcctgaagtaggtgtttgcaaaccgcccgcaatcgttagaaaggtactctttcctgatccagaaggtcctaaaattaaatttagttctcccgctttagcagaaaaactaacatccttaagaacatggacacggctaattccttcgccataatatttgttaacgtctactaacttcaattttgacataacatttgcctcctcaccttaatttaaggcctgtactggatcaatcttaataatcattcggactggtaataacgaaccaatcattccaagaactattaatcccactgccattaaactaattagtggccaattcataataactggtaccgacattggaatcgctacacttgtaataagggttaaaagaatcccgccaattactccacaaaccattaggaagattgattgagtaactgtcgcaataattagatgacgagcaggaattccttgagcgcgcataactgcataatgacttattttttgcatggtaagaatatataagaagaccgcaattacaattaacgaaattaccattaagaagccaatcataaaagtaaacgtattattttgcgctgaatatcccggtagcttattaatatattcgttaacagtgtagtgttggagatcagggtaggtatttttactaagcttattgtcagaaaagagtccgctagcaacggctgaactatttaatcctctcagttcccgccaaactggcaaactaccatatataacgggggcaacgctaaatttagcatcattaacaaagccaacaattttatatttctcattttgagaattgattgttactcgatcccctaaatgatacccctttttgcttaaactcttgtcaacaacaatttcgttatttcccttagcttgacggccacttgtaatcttaatcttttcccgggaaataaattggtcaggatctaaaccgataaattgagcactttctttacttgctcctttttctttaagaactactggtgcctgaccaacaagagcaacattcttttgatctttaccagatagttggtcacgagtaataattgattgtccaagattatcattactatttttatttagaaaaacagtttccgtaccccactctttaatggcggcatcattttcattttggagtcccaacatcatccccattaggaaaaacattaggtaactaattaaaacaatcatggcaacaattaatccataatgcagcttttcatgtttcatttcttttagtgctaaaaacatattataacctcctactgcaacaatgcagtcagtgccttggagagccgttcaattgcttcattttgtttatcaggttgaagaaggcaatccttaatcgtttcatgactcaaaaccattacactccattcttgagcactatgaatcttaatttgcggctgcgtattatcacgtaacaatccttcatttgtttgaaagtgcaaacgcataaaatcacggtacttacttccgttgatctcatcaacaaaagctttaatctgattaacataatcactcgcagctaaaatatggtttgcacgggtaattggtgtatgaatttctaaaattgccacttgataaagatactgatatgcctccgttaaatctgtaaaatatttataaaatgctcctctggcgattcctgcttgttttacaatccgtgcaacttgtgcacttgctaagctatgttgactaaattctgttagtaatgcattagtaataagttcttttttctgtagatttaaattttcaaatgttgtacttggcatcttaattcctccaccgcatcgtgacaccgtgtcactatgaatttattttatattatcgccaaagtgacaccatgtcaattactagataaaaaaagcgaggcgaaaaattttttgcctcgtttttaatatatttaaatttttatcttaatctagaattaagcttcttcgccgccaaccttaacaacagcttttgaaaccttacctaatttaccactaacaaagtcttcaacaccatcaaggtctaattcgtgtgagaagagtggtagtgggtcaacaacaccagaagaaagaagtgcaattgagtcttcaaaagtgtaagggttaatgaaggccccttgaattgtaagttgtttttggaatacatcgtaagtgtttactgagaacttgtcatcagggttaccaacaccaaacattaatacttgagcaccacgagctgcagctgcaagtgcttgttcttgagtagctggcaaaccaaccgcttcaacaacgatgtcatatgcatcagcaggaatttcttccttagtagtgttgatagtcttaacgccgaagtgcttccggttgttttccaacttttcatctgaacgaccagctaaagtaacttcgtgaataccacgagccttcaagatttgtgcaaataattgaccttcaaaaccatcacctaatactaaagccttttggtatgggtgagtttcaagtaagtcaacaccgtgcattgcacatgaaattggttcaacaacggcagctgcctttaatgaaacatcatcaggaattgggtaaacaacttttgcaggagcagtaaagtattcttcaaaaccaccgttacgggtaacaccaacagcatcaaggtgttcacataattctgggcgttgagtccgacaatacttacattgaccacagtagatgttagggtcaacggttacacgatcacctggcttaacgttagtaacttctgaaccaacttttgtaactacccctgagttttcatgacctaaaacgataggaggaacagctgatgcagatcccggaagaccggcatagagcgctttatcagtaccacaaataccagcgtaggcagtatgaattaagacttcatcaggcttaatttcaggttctttaatatcttcaatttcgagttgttttttacctgttaaaacaagtgccttcataattaaaatacctctcttgtgaattttatcatttgtcaagtgatagtatagtgtgaaaacgccttaattgtcaaacgtccaacaattatctcacattcttttcgccatcataaaacgttaaactcagcaaatccgaacctaaataaatcccggtatagaagcattttctaaaaaagtgcaatttttaaatatttttttcttcactaagtttatgctatttttttgttatcacataaatggttttactttcattttttaaattacataatttcacaaggctttttatcctatttagcgttttacatcaagaaataaaatgtttctacatataaagtaataaattctaaatttatatagaaaatttctccaactttcagaaagcgcttaactaccattaggcacgccaaaacttatctccaaccgctcctcaaaatcgcccaaatggccgttataacggctattttccattgcaggatatatttttttatgttaccctaacaaagtattcgaacttagttaattatgatttccaatctaattaacaaaactcaaacgaaaggtggatttggcgtggacgacacaaagaatcaacaccggaagcataaacttattgaatatgctaacggtaaatcactagaggaaatcaacggaacagttgaagttcctcgtggaaaaggcttctggcgaacattattcgcttactctggtcccggtgcattagttgctgtgggttacatggatccaggtaactggtcaacttcaattactggtggacagagtttccaatataccttaatgactactatcttgatttcaagtttgattgcgatgttgcttcaatacatggcggctaaactcggaatcgtgagccaaatggaccttgctcaggcaacacgggcacgtaccggtaaagcattaggtattatcttatggattatgactgagttggcgattatggctactgatatcgctgaagttatcggggctgctattgctttaaacttactgttccacattccgttgatcccatctgtatttattactgttcttgatgttttagtactgctattattaaccaagatcggattccggaagattgaagcaattgttgcatgtttgatcttggtaatcttgtttgtttttgcttaccaagttgccttatctaaccctaactggggtggcgtatttatgggtctccttccatcagctaaggcaattgcccaacatccagaaattagtggtattactccattaactggatcattaggtattatcggtgcgactgttatgcctcacaacctatatctccactcagcaatttctcaaactcggaagattgaccacaatgatcttgatagcattcgtcaaactgttcgttttactacttgggattcaaatatccaattatccttagcatttattgttaacgcccttcttttaatcatgggggttgctgttttcaagactggtgctgttcaagatagttctttcttcggtttatatgatgccctgaataacacttctatgcttagtaatccaatcttaattgcggttgctaaatctggtgtattgtcaactttatttgcagttgctttacttgcctctggtcaaaattcaactattactggaacattaaccggtcaagttatcatggaaggtttcattcatatgcggatgcctttatgggcacgacggttagttacccggattatttccgttattccagttattgcttgtgttgctatgacgagtggtgagaataccatccaacaacacaccgccttgaaccttttaatggaaaattcacaggtattcttagcttttgcccttccattctcaatgttgccattattaatgatgactaacagtgaggttgaaatgggtgaatttaagaatagtggctgggttaaggcttgcggttggatctctgtaattgcccttaccttcttaaatctctacaaccttcctgcaacttatgaaggttttggtatttgggcaaaagggacatccgatgttctcgcatatatcacgattattgtcattcttgctcttcttatctggacttgtgttgaactctacaaaggggataagcgctttgctgctgaaggtaaaggattcggacaacgtgaagctcaaatgaaagattcagctgtagaagattaaaataaaaacctggaagcaatgctcatgtacggtaaagaagcaagcaaccgaaaacaatagatagaccgccagcactacactattccgaaccaaagaccaaaagataagcattttgagaaaatctaaacttttggattttcctacaatgccgactacggcggaatccctcccactccttatatatttctttctgtatacattaaatttgtatttagtaaaatgcagacaacaccacggatcggcttttggctggacaattccaaccaaacaccgcagcagacagtagaaaccattctgaacgttaggaagccggtatgattgttacatataaggggaagaaaaatttcttttagatacttgttttcctaaaactgatgtgatataataattcaattccagaaaaggagtaaaaaatatgcggcaagttattcttaaataaaactataatcaaatagtgggaacaaaggattatgatagtcccttttgtaggggcttagttttttgtacccaatttaagaatacttttgccttatcaattttgacatatccccaaaaacagcactcacaaacaggtgtatgctgtatatgtgtatgtccgcaaattatcatccccagtggtaaaagtattttactgctggggatttttatgcccttcggggcagtaaagggaggacaatcacatgaaaataatcaatattggaattcttgcccatgtagacgctggaaagacgaccttgacggagagcctgctatatgccagcggagccatttcagaaccggggagcgtcaaaaaagggacaacgaggacggacaccatgtttttggagcggcagcgtgggattaccattcaagcggcagtcacttccttccagtggcacagatgtaaagtcaacattgtggatacgcccggccacatggattttttggcggaggtgtaccgctctttggctgttttagatggggccatcttggtgatctccgctaaagatggcgtgcaggcccagacccgtattctgttccatgccctgcggaaaatgaacattcccaccgttatctttatcaacaagatcgaccaggctggcgttgatttgcagagcgtggttcagtctgttcgggataagctctccgccgatattatcatcaagcagacggtgtcgctgtccccggaaatagtcctggaggaaaataccgacatagaagcatgggatgcggtcatcgaaaataacgataaattattggaaaagtatatcgcaggagaaccaatcagccgggaaaaacttgtgcgggaggaacagcggcgggttcaagacgcctccctgttcccggtctattatggcagcgccaaaaagggccttggcattcaaccgttgatggatgcggtgacagggctgttccaaccgattggggaacaggggagcgccgccctatgcggcagcgttttcaaggtggagtatacagattgcggccagcggcgtgtctatctacggctatacagcggaacgctgcgcctgcgggatacggtggccctggccgggagagaaaagctgaaaatcacagagatgcgtattccatccaaaggggaaattgttcggacagacaccgcttatccgggtgaaattgttatccttcccagcgacagcgtgaggttaaacgatgtattaggggacccaacccggctccctcgtaaaaggtggcgtgaggaccccctccccatgctgcggacgtcgattgcgccgaaaacggcagcgcaaagagaacggctgctggacgctcttacgcaacttgcggatactgacccgcttttgcgctgcgaggtggattccatcacccatgagatcattctttcttttttgggccgggtgcagttggaggttgtttccgctttgctgtcggaaaaatacaagcttgaaacagtggtaaaggaacccaccgtcatttataaggagcggccgctcaaagcagccagccacaccatccatatcgaggtgccgcccaacccgttttgggcatccatcggactgtctgttacaccactcccgcttggctccggtgtacaatacgagagccgggtttcgctgggatacttgaaccagagttttcaaaacgctgtcagggatggtatccgttacgggctggagcagggcttgttcggctggaacgtaacggactgtaagatttgctttgaatacgggctttattacagtccggtcagcacgccggcggacttccgctcattggccccgattgtattggaacaggcattgaaggaatcagggacgcaactgctggaaccttatctctccttcaccctctatgcgccccgggaatatctttccagggcttatcatgatgcaccgaaatactgtgccaccatcgaaacggtccaggtaaaaaaggatgaagttgtctttactggcgagattcccgcccgctgtatacaggcataccgtactgatctggccttttacaccaacgggcagagcgtatgccttacagaactgaaagggtatcaggccgctgacggcaagccagtcatccagccccgccgtccaaacagccgcctggacaaggtgcgctatatgtttcagaagataatgtaactgcttccagttttttatttttgtaacgattctttcacaaaatgttcatacttgaacggtatagtatagacaatccctaatataaataaacccctatttttcttctatactatccccctcaaaatagctatgaagaaatacgaaaagtggtcggcccataatgagtcggccattttttaatacatctaggctcaccatggtataataaggaactagatatattactcattaagtatgaggtgaaatcattgaataataaagataataatcaaaataataataagcggcgacctactcgggttgagctttatgacactcctaagccaggaaaagaaaagaaaaaacgttctttctttaatcgtcagcctaaacagactacccctaaccataaacataagacagcatcccctaacaagaaaaagaatccatatggaatttcacgtcggatgttcaaggtcattttaggctgcctattagttatcttaattgcaaccattgttattttcttagttaaacaacaggaccctgtcaatgttgatagcaatgacactactgtctccacaagcacttcatcacgcaagaagcataaaaagagcagcagtagcagtcataagcatcgttcaagttccaatgacagtgatgacaatgatactcaagatacttatagtatttcaactcctagtcgttcggataacacgcctcaatcaagtcatccaactaaccaacaaccaactactaactcttcttcaactccacaacaaaaccaaccatcgcaggaagaacaccatgatcaaggcaacagccaacaacaatctacttcacaaccagcaagcagcaattctgggtcacagcctaatcaaagttcgcaaagtactagttcccagtcaaacccgcaaccagttcaacctcattctcaaaataatcagcattaatttggaataaaggggttgtcaattaaagtgggcgtgctataatcaagacaatcgattgaaggatatgcaccttcaaagtcctctacagagagtaagtgccttgagtggaagcacttgtgagtgacaatgatggttgtaccaccttcccttattattagccgagataaggctagtcggatcgtgtccgttaccgcaccttagagaggacattactagtgtgtcctaaagatgggtggaaccacgctaatttttgttaattgacgtccctgatactttcaacattgaaagtatcagggacgtttttatttatattaaaggagagatttctatggctcaggttgctgttatgtccccagatggatcagttaagaagatcgatcgggattcacaagaaagtttagaagcattacgtaagctttctgcattaatgttaaaggctgcattaaaacaagaatttaagggtattcgacttggtgaagctgtcgctgacgaagatggtttccacgttgattctgataaagataatcaacaagtttctgccgacgaattaccagctcttgaagacgtaatcaagggaatggcaaagaacgatgttaaggtagaatttgttgaagtacctgtagaggaagcacttgccgaagtaaaagatgatcgtttctcaactgaattgatcaatgaaaatgctaaagacggcaaagtagcaatgtaccaacttggtgatgtcaaagctgttgcagatgatgacattcttttatatggtaacgttgttaaaaacttacgccttctttctgttgctggtgcttactggaaaggtatgtcttcaaatccaatgcttcaacggatttacggaactgtcttctacaagaaggacgcattagaagaagacttaaagaaacgtcaagaagctaaggaacgtgaccaccgtgttatcggtaaccaactcgacctcttctttgttgatcctaaggttggtgccggtttaccatactggttaccaaaaggtgctactattcgccggacaatcgaacgttacatcattgaccgggaagttgccgatggttaccaacacgtttatactccagtcctaatgaatcttgatgcctacaagacttctggtcactgggaacactaccgcgacgatatgttcccaccaatggacatgggtgatggcgaaatgcttgaattacggccaatgaactgcccaagccatattcaagtttacaagcaccatattcgttcataccgtgatctcccattacgaattgctgaacttggtatgatgcaccgttatgaaaaatcaggtgctctttctggtcttcaacgtgttcgtgaaatgactttgaacgatggccacactttcgttacccttgaccaaattcgttctgaattcgcaaagattttgaagttgatcatgagcgtttacgaagactttgatattactgactacagcttccgtctttctcttcgtgaccctaagaacgttaagaagtactatgctaatgacgaaatgtgggaaaaatcccaatcaatgttgaaatcagcaatggacgatcttaaccttgattattatgaagctgaaggtgaagctgccttctatggtccaaaacttgatattcaaactaagactgctcttgggaatgacgaaacaatgtcaactattcaacttgactttatgcttccagaacgattcggactttcctacgttggtcaagacggtaaagaacatcaaccagttatgattcaccgtggtgttgttggaacaatggaacggttcatggcttacttaacagaaatttacaagggtgcattcccaacttggttagccccagaacaagtccacattatccctgttaacgaagaagcccatggtgaatacgcagataacctcgctaagaagatgaaggctgctaacattcgggttaatgttgaccaccgaaatgaaaagatgggctacaagattcgtgaagctcaaacacaaaaggttccatacactcttgttgttggagacgatgaaaagaataacaatggtgtatctgttcgtaagtacggtgaaaaggaacaaaatgaaatgagtcaagaagcatttatgaatgaaattcttgaagatattgcttcttactcccgtgaaaagtaattaagactaaaaatggctctatcacaactttgtgaaagccatttttttgttttaaattttttgaaagtgaaatttttagcataactttaatcaccaaaaataaaccgttttcgaagtgttcgtgaagttttggacaacctaaaattagtaattgacactattactcaaaggctttatagtaataaacgctcgcttctgagccactaaatatattaattaattattctaaaaacaaaaactatttattttggaggtataagatatgtctactatgaacgatttatttaaagcaatgggtaaagctactgaagaacatcatgctagcggtctttcatttgaagctaaaactgatgcacctgctggtattggtcaaggtatccttaacgttcgcaagtaattttaaaaggtcatgattaggaatttcccgatcatgaccttttttatttatccttaatagccaaagcaaatataaacataactaaccccagagcaaatagaacacttaatgaagctgcaccgaccgtcgatttaccagtccattgagtaacgacttcaacaataaaggggccaagcttcccaaggatattatagaaaccaaaaaattcgctactggcatttttaggaacaaggcggccgaagtatgatctactaagtgcttgaagtccaccttggcttgtcccaactaaaatagctaaaatccaaaaatcagtcaaagtttctaaccataaagcataaagacaaataaagaaataaacgataatgcccagcataataattcgtctcgtagaaaatctattagcaagccaaccatataaaattgaaaatggaacagcaattaactgaactactaacagaacgaccatcagcatcgtggtttgaattcctaagtctttaccaataaccgttaccattgtaaagattgtatcgacaccgtcaatatagaagaagtaagcaactaaaaaccatgtcaactgcttatattgattaatatgatgcatagttcttctcagacgacgcaaactatcgacaaaaggatttgcaacactgctgacgctataacgttgatgaccattttttaataacggccacgcaaaaataatccaccaaactgtagccaaaactaaatcgggctactccataactgcttaagagaccgctaaagcccttacttagttctgctactaaaaagataataaagacgactactcctcctaaatatcccattccatagccagtcgatgaaacacgatccatttgcctattatcggccacatctgttaaaaaactgtcataaaatagatttcctcctgagtaaccaataattgacccaatataaacgattaaaagtagttgccagtatttagttggaacaagggcaagcccgattgtcagtataattcccaaccaggtaaaaagatttagccagcgcttctttgcatacgggtaatcagctaatgcccctaataaaggcgctaataatgaaataacaagcgtaccaaaactattagcatacccccacagtgctgtcgagtttgctgcactaacaccggcatgatcagttactgctttgaaatagactggtaaaacagcggtcacaactaaaattccataaccagaatttgcccaatcataaaaaatccgttgccattgttgtctcgtaaacttcacaacgtcacctcagtctttaaagattgcatcaattgcttgtccggcagttgaagtcggataatgtaatcctaataatttagcaaatgtcggtccttcgtcaaccaagcgagcatgttcaacagtcgcaccacttttgatttggagaccagcaaaaatagcggtagtgaagtaatttgcttgtgttggcccgtaaccatgaacgccatgatagcgatcgtgagttccaattgattctggatcaactttttcgacaatcgctggtctgtttacctcatcggtgaaatattatcctggtttggcttcgacgaggaatgtgcacttaggatctgccccccgtttgatcgccgctgcgttatcatagattcgctcaaccccttcaacaccagcaatcatttgcttaatttttcctcgatccacggcaccacgagtgtaaatataagtttctccatcgcaagttttagcagtgacttgccagttatttcgataagtgcttttctttccaagagggtgaagaagtccttgttgcgcaaataacatatttaaatgaatcatcttatcaacattaatttgatagtgatctcctaaaatcacaaagtctgtttgcgcgtaagtaccggtatcttttgccgcttgaattatcttagctacacgtttatctagacggtgtaatgcttatttggcttgtggtgatcgaactccataacggtgacgcatactatccatatcaactaagtgaatcaatgttaagtccggctttttattttttattgtatcaaccgcataggctgttacaaaatcgtcaagccacggctgcttaatcccgtgacgtaatttaccgtattttttattcatttcatatagaaataacggactacttgcctttaacgaaaccagtacttgatttgtccaaattcgattaggaaagatttctgcaaggttataatcaatcttactgctagcagtcacaggccacaaaaatgcagcagttgttaagcccttttcttttgcaacatcatagaggggcatcaattgaatatcttttcgataccagaaccagtcaggcgattgccggcgcggctgcaatttagtattgttaataattccatgtacgaccggatactgaccagtaataatcgaagtatggtatgggatggataagttaacgttggaaagattccctcaacttttttcacccatgttcctttttctattaaatctgctaatgttggtgttaattgacgtaattcgtttaggtcacgaaaacctaatgaatctagcgaaataacaatcagcttatgctgtttcatcagttcatctgctttcttttcaaactcattagctattttaaaataaatcattgttaataactagttttgaaagaaattatcaaaaatcattctcatcgtaagcattaaaatttgtatgataaaaaagttaacccacattagtaagccagcgattttcaataagttttaaagtgaaatttgattcacagtaatttttaatgtaaaattaagtttcagttttcagtattttatgaaaggaatcataatcatgcaaaatcagttacccaagggaaaagagcatgagaaaactctcggcctctttgacctttctattctaggtattggcgcaatcatcggaactggaattttagttttaactggaattgtcgccgcggaagattcaggtccagcaattgttttctcttttctgattgctgctcttgctagtggtttaattggtctctgttattcagaattaaccactagtttacccaattcaggaagtgccttttattacgcgtgggtttcaattggtaaatttatggcgttccttgctggatggacgctgattggggtctacgttactacaaccgctacggtagccaatggttggactgggtacgtacaatcgttcctagaagtcctcggagttaatttaccacataaattactggttacgcctgcagctggtggttatgtaaacctccctgctgtcttgatgatcctttctatgacgattattttgacacgtggaactagtgaaagtaaacttgttaacaacttcttggttggtgtcaaaatctttattattgttctatttatcgttgttagtgctcaacatatcaatctcgctaactggcacccatttttaccatatggatacaagggaattttcacaggagcatctgctgtcttcttctctttcttaggatttgatgcattagctacttctgctgaagatgctaaagatgttgataaaaatattccccgggcaataattttatgtttagttatttcaactgctctttatattttagttagtcttgttatgacgggagttctaagttataaagatttgaatgtctctgaagctatgtcgtatgttcttttagctaagggtcataaatacgtggctgaaattgtttcacttggcgctgttttaggaattatggctgtcgtctttgcattcatctatgctggctcaaatatcatgaagtcaatgagccgaagtgcctttcttcctcaaggcctcgctaaagtcaacggcaaaactcaaagtcctaatcgtgctatttggctagtcggacttctttcagctgtcctagctggagaattcgatctccattatcttgcattaattgccaatattggatcattggttgtctttgctttaatttcgctcatcgtaattatcttacggtaccgttatccagaattaaagcgaccatttaaggtaccttttggcaacgttattcctgtgctatcagtattaatctgtattgttttattagtaagcatctcacttaatgcttggttaacatacttattgtggctagtagtcggattaggagtttacttcttctattcccttcgtcatgccaacgaatttaatttccaagatgaaagtgatatcccaggtaattaaaatttagttctaaattatgatagacctctacattgatccagaatgttagaggtctattttaatattatttagcacttcgattctgacgagttgtttccgctaagtggactaaattagtaacaaaattatgagttttggcttcataattatattggcgacccagcttaacaaagtaaccattgatataatcaacttccactggacgattatgactcatatcttggtacattgaaggataatgatgcggacagccaactttagagacataatttacactttctagctcttctgctcgcgtattaactaattgtacccctgcacgttcacagacatcatatgcttcatcgattaattgccgagatagttcatcagccttatcaaacgccgcatattcacccattgtaatttcaaacatagtacaaagggtattaacgactgaattaaagaccacttttgccatcaacgttcccataaaatcatctttaagggatggattaaagtttgcttttttaagttctgccattaacgcttgtgtcttctcatcaggcttttcagtataattagcccaattagtcgttcccatccctcgttctccaacaaattccacttcgccaggtttggttaaaatagttgctactaaggcagttccagcaactactttttcttttgggaaatacttcaataatttttcaacatgtcccattccattcatcgctgtcatcgcatattgatccttcaagaaatgttcacaacgttttaacatatcatctaactgcatttgttttaattcaaagaaaacaaaatcagcatctgtagcattgtattcttcaggtgtataaacattaacgggaacaaggtgtctatttttatgctcgcgagttacataaacgcctccttgttctttcatcttattgtaatgtggtaaccatccttcaacaaaatcaacttcattacctgcttcttgtaataaaacaccaaaccgtaatcccattgcacctgcaccaacgactgtaaatttcataattatctctcctttttatgactataaaaaagcgtccttagattaaacaacttaacctaaggacgctttttgcgtggtaccaccttaatttgccaacaattcacattattagcctcaaatgttcaatgcttccattaaacacgtcagctataatgggctgatcccaccattaattactaatttcatcatggcactcaaagtgattttcattataagcaggttatcctttttcatcaaccaaggactctctgctaatccactcataattactcttcttttcaacgtgttttcataatcacattttaatttttatctaatttaatactttgggttgtaaatgtcaagatttatttttgttataaattatcttgacatccctatttcatccgcgtattataatgacaactaaatgagagaaagcttagaaaagatgagtaatcttagaatcttattacagagaatcacggttgatgagaggtgacataagagactgagacgaagatggtcttggagcttcacgaattacgagtattttatataagtagttcacgattgacgaccgataaaacgtctgggtatagcttccattagtgtacctattgaggatagtattgtgagatactatcaaattagggtggtaacacgttaattaactattgattaatcaacgtccctaggaaaagtagaaatatttttcctaggggcttttttattgcttcaattcttgaacccatcacgaatagaaaggatcgatttactatgactgaattcactacacgtactacatcaccatttcgttatgacatcgttggaagcttccttcgtcctcaagagctaaaagaagctcgtgcaaaatttgcaaacggcgaaataacacaagcagacttaacagttgttgaagataaagcaattattaatttgattaaacaagaagaagctgccggcctgaaagcagttactgacggtgaattccggcgtagttggtggcaccttgactttttctggggattaaatggcgttaaaaaagctactctaaaggaaggctataaatttgcagatgaagagactcgtcctgaaactgcgcaaatcactggaaaaatctccggcgaaaaccacccctttgtcgaacacttcaaatttacccaagctcatacctctgatggcgttcaagttaaacaaactatccctgcgccagcacaatttttagaagaatttcttcgtcccgaaaatcaagctaatgctaaagaattttatcccaaccaagaagatttagatcatgacgttgccactgcttatcatcaagtgattgaagatctttatgctgctggttgtcgtactcttcaactagatgactgtacatggggaatttctgttaacgcctttgctaacctaaggaaaaaagaccccaatgctgatgtatctcagcttaaagccctgcaaaagcgatttttaaaagtaaacaatgaggcaattgctaatttacccgccgatttaacaattaatacccacgtttgtcgcggaaactatcactcaacatgggctgctgccggtggttatggaccagttgccgacacactatttgctaaagaaaacgtcaatgccttctatctcgaatacgatagtgaacgtgctggcggatttgaaccacttagcaaagtttctgatgataaatatgttgtccttggtttaattacttcaaaatcaggtgaacttgaagataaggcagcaattatcaaacgaatccatgaagctgcgcaattccatccattagataagctctgtcttagtcctcaatgcggcttcgcatcaactgaagaaggaaacattttaacagaagaacaacaatggaaaaaggttgcacttgttaaagaaattgctacagaagtttgggaataatttaaaatgaataatgggagcgaggcagaagtcacttgtgacttcgtttttcgacgcgaagctagcctctgggagcccccgcaagcaacaataggcctctagcgttcggttttgccggacgttagaggccattgttgtactgcgtatttgctttttatgaaagtaacttaacttatgtcacagtcccatttattcttctcccactaaattgccaatacacggtctttatgcggagagtaattaaacagaacatctgtcaaatccaatcctgccttatttccatgatgggtgccatcttgccatgcaggaatatgagttacatcatagacacgattattaattgctacataagctggattcccgttttgcccatcatatttttcaattcttctcttgtaaatgtttttgccataatattccgcctccttatttgatagtgtcaattcaatatcctcactatatcatggaagcgcacacaaaaaaattaataattacctcactttaacgcaaaattatactctattagtattttcttcacaattaatctaatatcatatctaagtgcggaatattgtcttcaaggtaaacatctgaaatcggcttaaatccaaacgatgcgtaaaactctttaagatatgcttgagcttgaatttgaattgtcttatttgggaaaagacgcttagtttcatcgaccgttgcctgaactagctgacgtccgtattcatgtccacgaaattgttttaaaactaatacgcggccaaaagtcgcatgagagctgtccttagccataattcgcgtataacctactaagtctccctggtcatccttcagcattaaatggtgagcttgataatcctgttcatcaatttcttgataaggacattcttgctcaacaacaaatacttttatccgttcttctgctaatctacaccattcttgagcggtcatttcacttagcgtttttacttcaacattcatattaaaacctcctaaaaaataaaagagtactaaccaacttcttcatgtcattgtgacaggccctagtagaagatggctagtactcttaatgtctttaatccggggactaaagacgagtcgttagtaaattattcggtatcagtatacaatggattaatctatcttgcaattagcgatttaataccaagcaggtttatctccgtctgtatttggtttattcacaccaaagttttttcgtgcatatggtgccggatcatcaataatttttgctacaaaattaccaattgactttcgcgagacctcggtacctttaaatggttctccttttgcagtcgtttcgtaatccacttcatccttatctgttaaccatgctggtcgaatgattgtgtaatcaagggttgaattttcaattacatcggcagcactgcgataagttcctaaataactatctttctggccgccacctaacatttcattattccactcaccaaatttacctggaacttcatcatagattccaatcgaggaaatccagactaacggctttacagcatatttttccattaagctgacaatatttttagcttgttgcgtaatttcaggatttcgtagattagcataaactacatctgctcgttcaatcgctggctctaaatcgccaatatttaggacatcccctttaataactgtttcacgattttcatcgacaacattcatattttgtgggtgccgagtaaatagtaataattcatcattgccatttgctaacaatgcatcaattgcgtgtccagcaatttttcccgttgcacctagaatcaaaacttctcttgccattatttctacctcctcataaattctacttttagtatacaattctctataccaattaaaagtaagcacacacaagtaaggtagttacactcaggtaagatatgattgatggacaagtaatcggcaaaattttattttttagtatattttttgccccactggttaattgacctaattattggtaccaaactttttcctacttccgtcaatgaatactcagtcttaggcggcactgtcgaataaacacgcttttgtataatatttgctccctctaagtcctttagttgaagagccaacattctctttgaacaatctggaattaatttttgcaactccgaaaaacgacaaggctcatattcactaatttgatatataattacgcttttccactttccgtttattaacttaagcgtattctcaatcggacaatctttttcgaccattttttctcctttctctagtgaaataaaattcacttcttgtatatttttatttttaagttactattagtaagtaaagaaatgtacgggagtgattattatgaattcacaatttaacagtttagctgcaaatcgtcgttcaatctatgcgcttggtgataatctttcacaaacaccagaagaaatttttgacttagtgaagcaaacaatcaaaaactcaccaactgcttttaatagtcaaacagtacgggcagtcgtattatttggcaagtcatcagataaagtatgggaaatcgttgaggatgctttacgcaaaatcgctaagagtccagatgcttttgaacaaacaaagtcaaaaattgatagtttcaaggcaggctatggaacgatcctctactttactgacactacaattgtgcatcaattagagaatgattatccatcatatgcagctaattttgcaaactgggctgaacaaggcctcggtggtgctcaacaagcagtttggacagcactcgcagaacaaggaatcggtgccagtcttcaacattataacccattgattgatgatgcaattcatcaagtatttaatcttccagctgattggcaattgcgtgctgaaatgccatttggttcaattgaggcaccagctggagaaaaggctcagcttgatgacgaagagatgttcaaattaatcaagtaaacttattattctccatcctcttgaacggtatataattattgtaaacacgttaaaggaggaattttaatggaacggcaacctaaaatgtataatactggagcagattatgctttagcaatcattggtggtaaatggaagtccgttatcctttatctcttagctggtcatccccgacgaacaagtgaactagttaagcagctaggcacctcatataaagtcttgagtgaccagcttagtgaaatgatagatgccggcctcgttatccgaaaaagtttcaatacgattcctccacatgttgaatatcgcttaactcctgagggtgaaaatctttatgctgcccttcgttatttaaattactggggtgaaaatagagcaaaacaaactggtgacattaaaatcatgtgtactgacgaaatgaagcaggtcggcgatgatggtctatgtgtcatcactaaaaaacatcttaatcattggcgccaagaaattgtaaaaagcaaggacaaagatatttctatctaagttcttgcttttttgtgttctttaatctaaaagccaacgccattataaatataatcatgtagctcgcaagaataagatgggtattcatgataattggaaagctttgaatacttgtttttcccaccgaaaacgcaccaaaaattctattaattcctgttgttccagcaaaaataaataaacttccccacattactaattgggaaattatccccgcaattgatgcatagtaataattgacgatcgaagaaatactataattatgggttgctttctcgtagtcatcaattgctgttttacgttctgcaccggcaaagctacggatgataaatacgccaataaaatatgttggcaaccaaaatgttaagagaattccaattgttagcatcactaaattaatttgacaatccttaaaatggaataaatggtgggtttgttttaccaataatcctccaaagacgaaagcaaataagtaagcaacaattgtccaagaatacatttttgtgccatacaaaatgccaataaaaacggtactatacagggtccaatactgaccacaagcaccataaagcattattcgttgccgtaaatgattgggatagtgaagtaatcgccgatggtttacaagcaaggtaaggatcatcgtgatgaggaagattaataaaagagcggttccccattcaagtggtttcccaaagcctaaacttctccctaatcgcaacagtaacattgcgccaagcaaaattaatgctagtaagtaattagcccaatgtagacgaactggcagcggacgaattgcatggggtgttttccaaattgatcccattgcaccaaaagtaatgattaacattaaaacaaaactaattactggcttctttatccacacaattatcccaaacacaatcaaaactataataacttgaaaaagcggcttaagatgatcctgctggggtaagagtcctcgttttattaatcgccgccgctgacttattgcggttggaaatagtcgagaggcaatccctgcccctgcacctgacaaatcccagaagattggttgaaatccaccaaacatccctaaaaagtaaccaataattccgctataaagaccaatccaggccagccgttgataatcgtattctaaatcacggcaaaataataaaattgtatgccggaaagcatagaaaatagcgaagggcaaggcaccaacaaagatatcagactgttctttagtaagggaaatatacagcaaaaaaggcattaaatttaataataaactacagacaccagtcaacttttctaattttttcatttttatttcctctaatgctggtcaattgcactattcagtttctttcgatttactagaaaaataataataactaacgggacaataaatagcattacgggataaaaatatttcacaggtaacgtactatcaacaatcccccgatgattggcccaagcgtcattccaatatcaaggccgagaaagaatgtcgaacttgctaaccctcgttcattatctggagctagcatcattgcagttgattgacaaacggaataaataataccatagccaaatgccattccagcagctgccagtgccatttcaatgttatttttcataatacttaacataataagataaaagattgttgcaaccgtgcttaaaatcaaccatggttcaaaacggacagtatcaaattgggtccgtaagaataatcggctaagtaaaagaactacagcataaattaagaaataagcaccaacagcaatagataagtgacgttgttcagcgtactcaacaatatctgcctgcgttgcaaaatatgggatagcaaataaagctgttaaaagggcaaccgggatagcgtctcgctgaatgattttaatatgaaagccactttgttttacagagtgtgctgccggttgagcgcggttactgacaaactgaattgtgacaacaaccagtaaagccgataatgctgaaatcaccattgcagctcgataaccaataattcgatataagttaattgatacagcgggggcacatgccattgccaaagcgttcatcagtccataaaagctcattgcttcgccaacatgattaaatggaactaaatatgatagccaggttgtcatacaaactgtacataatacaaatcctaatccattaaccaaacggcatattaacaagaaagtgctattaggcgttaacacataacctgcaaccccaataaagcacaatattccaccccaaaaagctaatgaatattttgaaaaacgatcagtcagattaccagcaattggtcgcaaaaacattgaaacaatactcatcattccaacgattatacctgcaaaagcacttgatgcgcctaaatcttgagcataaccgttaatcaatgggttacagtacatattactaaacataaaaaagaacgaagccgccattacgagcacaacatcttttgtaaaaatcgatttttccttcgccatcaattcccctactttctttgcatgattttaattaaattctaattactatcatacaactatttggggaagttaaatgatttcccaggaaataaataaagagattgggttttgtttcccaacctctccgtgtgtacttcactatttatattttactgcaaagaatcccaagctggtagagtaacgggttcactggcagctactttctttactcgatcgctaaggtacttcttattaataacagcctcataagtatactcttcaaaccaatcttgggtcattacaaagtatccgttatcgccattatctttaccccaactgttttcaatcttccatcgtgtaggttgaccatttaccatgtcaaagcctgttaatgtcattgcatgagaaacgacggcttgcttagtttccaaacggtgcttcttatccattacaaaatcaacatcaagcaattcctctcgatgatataattttgcatccatcaagcctcgcttacggtccatttgttggagaacatcattcccaacccaaactgtttcaccagcttgcaactgtttgatggctccttcttgtaattctgcaaaaggaacattaacaaatttaattggcaaaccatcaaccacactatcttgcgctggcattaaataactccgatccatttcatgatcaggagcgttagtaactacaacatagtcacttaagtttgtatcaaagtattcatgatagaactttaatggcgttaagccaagaacttggtggaactttttatcatcatcccgatattcaagatcaaattttgcaggcggttcaccaaatgagtaggctgcaatcttataaacgtcacccatcattcgttcttgtgcttcctgtaattccgttgcactggcattagtttgcaccattacccgtaattcaattgcatctttgcgcattaagctatcaaatacttcggctacatctgaagtatccttcgtattatgtgtgtcaggcattacatattctggaacaacaccatatttctcaataatagaagcggcattagcccattgtccaccatcatttaatgcaaaactaaggtagaaatcaacggttcgatcatgcaaaggcttatcagcagttgcaataatcttctggaaaaacatatttgcccgttcaattcgatcccagaaaaatagataattttgtgacaattcaaagtccttgaacttatattttgttgcaaacttatgacgtaatgtatttaatgctgcaaaagaccagcaacgtccactatgacgctggttggttggcttccccgtcttaatttcataagaaaatgctcgatgaagacgttcgcttgccgttggatcttcactcgcagctttaatcccatttttttgtattgcccgggcaataatttctgcatctttacgtgaatgaaattctttctttaatttttcaaccatttttgaggttaaatcgtgttcttcagtcacaataaatcccttctttgcctaaaattctaaaatgacttatacattattaatgataccgcattttcttcaaaattattgacttaaaagcttttctattttaaacaagcatcaatcctttactgcttataaaaagtaagctaagattgtatttagtaagtcacttttaattataaattatatgaactgcggtaaaattctatctaggaggtcgattaattatgaagaaagtatttgttgtcggtggttcaggccgtgttgctactgacttaattaaagatttagttgccactggtaatgaagttacagctggtgctcgccatccggaaaaagttattaagttaaaccacgttactgctgttgaattgaacctacatgatagtgttgaaaaaatcgctgaattaatgaaaggcatgaatgcaatttactttgttgccggatcacgtggcaaagatttactgcaaactgatgcgatgggagcagttaaaacaatgcaagctgctgaaaaagacggtattaaacgttacattatgttaagttcgctatatgctttacaacctgaaatgtggtcaaaagttccatcattagcttcaattatggattataacattgccaagttctttgctgataattatcttatctcaaatacaaatcttgactacactatccttcaacctgctaatttaactgaagaacccggtaccggtaaaatccaaattggtgaaggctctgcaacttctaatccgattccagacgttgcccagactttagccgatattctacaacacgataatacaatcggccacgtcatcatgatgcggagtggagatacgccgattgaagaagcactagatcaaatttaattttttacaggttgttgaccagtcgaaatagcgtaagattggcctacaactttttctattctaaaatcaggtaatagtttagctaatttttctcatcagccgtataataaacattaaaaacaaattaagaagggaatcttttacatggcaaaactcgaacgcttttataatactttccaacctgaccattatgatgtttttatcgatattaatcgagcaaagaaaactattaatggaaaaacaactatcactggtaacgcgactgatcctcaaattgcaattaatcaaaaaaatttgcaggtcactggtgttcaagcagacggtcaagaattagactttaatattgataatgatgccgaggcagttcggattacccttccgcaaactggtaaagtaacttttactgtaacttataatactaagttaactgattcgatgatgggaatttatccatcatactatgaggttgacggggagaaaaagcaaattatcgggactcaatttgaaacaacttttgctcggcaagcttttccctgtgtcgatgaaccagaggctaaggctaccttcagtctagcaattaaatttgatgagcatcctggtgaaaccattatcgctaatatgccagaagatcacgttgaaaatggcatccactactttgaacccactgtgcgaatgtccacttatcttgttgcctttgcatttggagagctccaaagtaaaattactgaaacaaaaggtggcgttaaagtaggtgtattcgcaacgaaagcgcaccaaccaaaagaacttgattttgcattagatattgctaagcgggcaatcgaattttatgaggatttctatcaaactccgtaccctcttccccattcatggcagttagctttacctgatttctctgccggtgcaatggaaaattggggattggtaacctaccgagaagcttacttattactcgatccagacaacacttcccttgaaatgaaacaattagttgcaactgtcatcacacacgaactagctcaccagtggtttggtgatcttgtgacaatgaagtggtgggatgacttatggcttaatgaaagttttgctaatatgatggaatatgttgccgtcgatgctctccagcctgactggcatatttgggaacttttccaaacttcagaagctccaatggcattacaacgagatgcaactgatggtgttcaatccgttcatgttgatgttaacaatccggccgaaattgatgccttattcgatggtgcgattgtttatgccaaaggatcgcgaatgttagtaatggtccgggctcttttaggtgacaaagcgttacgagaaggtcttaagaattattttgctgctcacaaatacagtaatgcaaccggagctgacttatggaaagctcttggcaacgcatcggggcttaacattggaaaaatcatgaattcatggcttgaacaaccaggctatcctgttgtaacagcaaagattaatgatgatggcgatttagtactgtcacaaaagcaatttttcattggtgatggtaaagatgttgatcgtcaatggcaaatcccacttaatagcaactatgatgaagctccacaaattatggcggaacaagaactcaaccttggaaattatcaagcattgcgcgataagaatggtcaaccattccgtctaaacctcggcaataattcacatttcatcgtaaaatatgatgatacgctactaaacgatattttagatcatgctgatgaattagacccgattacccaacgtcaacttcttcaggatctgcggttacttgcccaaggacaacaaatatcttatgcgtcattaattccattattaaagcaatttaaagatagtccttcagcaattgttaacgccgaactataccaaatagctaatggccttaaaatgtttgctaaacctgattctcctgctgaacaagaactacgacaattctctgatctattaagtaaggatcaagtaaagcggcttggttggttacctaaagatgatgaaagcaatgatgaccaattgacgcgcccttatattcttagcacttcactatttgcacgcaataatgattcaattactcaagctcatcaaatctttactgaaaatcaggataaattagagtctctttcggcggatattcgtggtttagttcttaaaaatgaagttcaaaacttcgggagtgctgaattatttgataaattaatcaaagcttaccaacaaacagcggacgcaagctttaaacaagacttgcgaatggcaataccaaatacaactgatccagcattaattgcaaaagttgttagttactttgaagatgctgacgtcattaagccacaagatttacgagcatggtatcgtggccttcttgccaataaagcaggtcaacaagctgcctggaattggcttcgtgatgaatggcaatggttaaatgacacagttggtggcgatatggaatttgctacctttatcactgtcactgccggcgttttccatactcctgaacgattgaacgaatttaaagacttctttgaacctaaacttaatacaccaggtttaacccgggaaattaaaatggacattagtgtaattgaaagcaaagtcaatttaattaacaaagagcaaacagctgttaatgatgcaattgcgcaacaataattaactgtaaagccctataaaaaacgcaactaaggatttttcctcagttgcgtttttattttaaatctgctgctttaataaatctaaccttgtactttggcgttgtaaaatatcgtcgattacatctgctaatgaaatttgcttcatctcattaaaagctgctgcttgaatctgatcataatacttttctaatgacgcctgaatatttccaccaacaatacacttcaaattagtttttggatcaacatgaagtaaatcatgatccatatttattgcctggtagatatcaaacaggttaatctctcgtggctttttagctaatcgcggttcagcagccccctttctagttacgatcaaaccagcagtcctcaaatctgacattaattgacgaacaacactcggattcgactcaatactatcagcaatcgctttactagataagtcaccatcctgataaacgtgcaaatagcttaataagtgaacagcatcacttagtttatatgaatatttcatactcctattttatcttgttgttttataacattcaagcgctatagtattaatttatagttttcacttttaataactacgcttgttaaataattttaattctagcaaaataaagacatgataaaaataaaatcacatgtttgagcttgattaataaatatatttagcatatattactactgttggggtaggaatctcagagttattgtctaacggaacggaatgtgaacgttagaaggaggcttataactaactgctttgttattccgcattcaccatgaacggaaacgtcaatgtgttccctaacaaaattttcaaaagggagtggattgatatgtctacgttatcatttgccggaccgcgttttactacaaagaatttgactttagctgctatgctggtcgcactgcaggtaatcttaaataaactttcaattggagatccagcggttttaaaatttagttttggttttattgccactgcacttattggttactgtcttggaccatggattagtggatgatcaatggtcgtatctgatatcataagtaatactattttaaattcaggaagcttattctttcctggctttaccttatgagcttaagttccagtagtaccggccatactttcatggctctcctcttcattcgtttgccaaaagagttgattatctggccgattgaaaccttgcttgtactagttatcctgcggcaattatcacgattaaatttaattgcaaagaagagcgaaaaataaatttatttggtggattatagaatgaagttagccacccagttggtggtaaataaaaaacgccattcggcgtgacatcaggtatcatattaagtgaaccaaacctatatgaaaggatgtccgtcaaatgacgcacttaaatgataccatgtctactagtttattgactactcataaaaagaatgctcatcttactaaagaagaacgtgtgatgattgcgactttaaagtcgcaaggactttccaatcgcgcaattggtcgccaattaggagttaatcatcaaacaattaataacgagctcaaccgtggtacggtccgccaacttcgtcgtcaaaaatctaatggtaagatttacgaatattcttactacatctatagttatgaagctggtcaggccacatatcttgaacatcaccgccattctggtcgtcgtcgcttatattattcttcaaagcaatttttacgattagctgatcagctaatgcttggtgagtttgacgaccaccattactccccacaagcggttatttataaggctcgagatttaatgaatgatggcaccctgatcccaaagtcggttgtaactttatatcaatggattaatgagggtgtgcttcgtacgtccaatttagacctctttgaaaagcctaaacgtaagcatcatcgaactcatccgcaagctaaaaggtgcttaggtcctaatattgctcaacgacctcaaactgcggaccaacggtccgaaattggccattgggaactagatacagttcagggacagaaaaacggtaatgacagtgttgtactagtaatgactgatcgcctttcacgagttaatatcacgagtaaaattgctggtaaaactgcgcatgcagtaaatcagttctttataaatttacgccagaaaatgggcacagatgcttactatcgcatctttaagacaataacctctgacaacggttcagaatttagtgagttaacacaagttcacgatcatgttttctatgctgatccgtattccccttgggaacgtggatccaatgagatcaataaccggtttctccgcaaggagattaccaaaggtgaagctataaataactatagtagtgctcagatcatagcgactaatgattggatgaatcactatccacgagctatgtttaatggacattcgtcaatggatatctatcgtaaggccttctaccaagagatatcacagctccatcaaccaataatcaattggtcagtattatttatttgagtccagtggctaacttattcttgaaatttaggaaataaatttatttaaaaaagtattgcattttaaatgaattaggttaaaatacaattaacaaaataaaaaagcgatgagaaagaagagtaactagttgtattcgttcagtgaattggtggtagtgagaaaccagtcgaccctacactagtgaataacactttcgcgagtgctgccaacccaaataagtttacttaaagtaggcttggccggatccggaccgttacctcaccggcagagcatgatgtgctcttgaggaggcctagttttatactagacaatttgggtggcaccgcggaaaaaagcctttcgtcccttgattataaggggaacgaagggcttttttaattcattcctaaatctattattttaaggagtgtctattatggacttaactattccaaaggattacgatccacgtctttcaattagagaaactgaaactgctattcgttatattcgtgaaactttccaagacgaatttggtaaagagttaaaccttcaacggatgtccgcaccaatgtttgttgaaaagagtactggattaaacgataacttaaacggtgttgaacaaccagtatcgtttgaaatgaaggatatgccaagcgaaactgttgaagttgtccattctctcgctaagtggaaacgtcttgctcttaagcggtacggttttggtatgcatgaaggtctctacaccaacatgaacgccattcgtaaggaagaagacctcgataacttccactcaatttatgttgaccagtgggactgggaaaagattattagcaaggatgaacgaacagaagaaaccttaaaggatacagttcgtgatattttcaaagtgattaagcatatggaacacgaagtttggtacaagttccctcaagctgtttaccatttaccagatgagattcactttgttacaacgcaagagcttgaagatcggtggccagacctcaccccacttgaacgggaagacaaaattgctaaagaacttggtgctgtttttgtaatgaagatcggtgacaagttgcaacgcagtggtaagcctcacgatggtcgagcacctgactacgatgactggagcttaaacggtgatattattttctggtatgaacctcttcaacgccggatcgaaatttcaagtatgggaattcgggttagtccagaatcaatgaaataccaacttgaacaagccgatgcaactgatcgtgaaaaattaccattccataaaatgttgctcaatggcgaattaccatatacaattggtggaggaattggtcaatctcgcctttgtatgctccttcttggcaaagctcatattggagaagtacaggcaagtatttggccagaagatatgattaagaagtgtgaagagaaccacattcaaattctataatttaagggagagtataaaagtggaaactattacaattagtgaagcaccaaagcatgttggggaaacagttaaaattggtgtttggttaactgataagcgttcaagcggtaagattgcattcttgcaactccgtgacggaactggatttttccaaggaatcatccgtaaaaatgatgtttctgaagaaaaatttgattctgccaagcatgatttacaccaagaaaccagtttttgggtaaccggtgaaatcgctgaagacaagcgttcaaagtttggttatgaaattcacatcaaagactttgacattgttggcgaaagtgaagattacccgatcggtaacaaggaacacggaattgatttcttgcttgataaccgtcatttatggttacgttctcgcaagccgtgggcattaatgcggattcgaagtcgtgttaagcttgcgacaatggaattcttcgaaaagcatggatttactcaatttgatgctccagaactaactggaagtgctcctgaagggacaacagaattatttgaaactgactactttgatcgttctgctttcctttcacaatctggtcaattatatgcagaagctggcgccatggcattaggccgcgtctacacgatgggtcctactttccgtgctgaaaagtcaaagactcgtcgtcacttaatggaattctggatgatcgaaccagaaatggcttggatgcaccaagatgaaagtcttaagattcaagaacaatacattgcttacttggttcaagacttaattgaccactgtgcacgcgaacttgaaatggtagggcgtagtgtagaaagtttaaagccgttcactgaattaccatatccacggatcacttataaggaagccattgaaatgcttcaaaagggtggctttgatgtagaatacggtgcggactttggttcaccagaagaaacctacttagccgaccaattccaaaagccagtctttatcttgaactaccctaaagaaatcaaggctttctacatgcctgaagatcctgaagattctcgccaagttatctgtgcggacttgcttgctccagaaggctacggtgaaatcattggtggttctgaacgttcctacgactacgaatacatcacaaacaagcttgaagaaaacggcttaagtaaagaagattacggttggtacgacgatttacggaagtacggttcaattccacactctggatttggaatgggacttgaacgattccttgcctggattactctccaagaccacattcgtgaaaacattccattcccacggatgcttaaccgtttgaacccttaataacgaaaaagatgagactagatttttagcctcatctttttttatatgcttttttttgaactcaatttactttttctttactattaaaatgagctgttccttttccccagtaaaatccttgttgtaaaataactggattcccagcaaattttttagctaattgccgatttgaaattccttcaataacaaaggtaagatgatgtttttctgcaaaagctaaccacgcattaacaaagcttatcatcagttcataatcttcatccttaaaaagtaatagcgataatttgattcgactaacaacctttagctgtcttttaatgaatgcatagctattactacccgcacacacatcatcaatcgccaattcaaagcccatttccttgagacgttggatttctctatctaaataatcaagactatgaatcgtttcgcggcgttccgtaatctcaatggccacgtgatcgtgatatgcttcgcgaatctctgctaaaaattgccaaatactttcaaatttcatttgacatggttctaaattaatatatattttgcgattttgttgttcgtttaaagcattttttaatgatttacggcttgccttaatccatgcatcgttaccctcttgtgttgtgagactgtgcaagaaattaattcctggaaattcgccattattatttcgaataagcatttcataagtgtcaatttcagcattcatcgcttgatcaacactaaggattggctgaaatatattgtacatttttatccctaacttttaataattgctatttattttacgttctgaactagtctttcgaggacgttggtgatgctgatcagtaacaatccatccccggccattgttctttacaccatataacattttatcagctcgcttcagggtcgtgtcaagtaattcatcattcaaatgatcagttaaactgcatgaaaagctaattgttaatttcattccctccttggtaacaatcaatttattattaaagaatttttcaattgactgtagtaattgataaacctcttctagtgaatggttagaaactacaatagtgaattcttcacccccgaagcgatatacataaccatgcttggaaaatgcggaatgaatttgttcgcgaaaaactgttgaaaaataatttaacacttcattaccagcaaagtgaccgtatgtatcatttatcttcttaaagtgatcaatatctaatgccccgattacgatattatggatttcactattattatctaatcgattaatttcttgactaagcgctcggtagttaagtaaccctgtcaaatagtcacgttcactttctttttcaagaagttttattttttgctcatttttcttctcactataaaaacgttgctcttcaaacatcgcaataacgaataatcctaacgtggctgcggcaacacttacaggtgaaaagctatggttaatccccagcgatactaactcaactattcctagcgatgcaatggcataaaaataactaattcttttagaaatgctgcgccaccgcgttaaaaccaaacaaattgtcgtaaaaacaatcgattcaatgatccaataccaccagtcctttagcggtaaaatccccattaagtattccacgacattcacaaataacggggttagagctaataatacccaccatattttatatactttatcgcgaaaaagcattgtgacagaaacaacttgcatgaaaacaacttgcccgatattaaataaggacaactgaaacaaacaaaattcctgaataaagtaagtaattataataacggctcctagcccccaactagttaaccgtgaattcttatacgaaacccaataccgttcaaaataaatttgactgataatcatacaaataacgatgattggtaaatagagtatcgcgtaaaaaagtttaagcgccaacttattttcaccttttcaaattttatttttattaatagctttaaaattatacttcttatagtcgaattaatctagtagcgcttccaatcttcatttaataaacgtttcctgaaagaaccgtatgatataattatttctgctaacgcgttaaaaatattaagaaaggatgacagatcttatctttataatgaaaaataattaccatgatatgtattttgagcaccaccactggctcttaaaaattcgacaaacactaattatgttccttagctggtgcattttacttatccccattattatcactacttcaacctatgtggcttaccggacaaatggtcatcgcgggtattttttctgggattatgctgaaggatttcgtgaacttaattttttagtaatcattttgctatttgctttaggaatgattggggtattctgcattacaatgggatatatccaagctcaaaggactcgtggactaactacaaaatggcccatgttcgacattaacaaaagtcatttacaacgccaacgagctgaatcattcatgactaagcagtttggtgattttgagatgcgaataaatacgcgcaattttgctgttaagcctgaacaaaatctagccaagaataaactgcgcgatattattaacaagcccataggagatgataaagatggtttctaacattttctatgaagcatttcaaactaactccccatggatgatctctcttataataatcaatttaattttatgtatatatcctattttaggagcgatgttctggttctttggcgcaatatcatatgttctatttcgccaaaaagaagaattaccaccaaaagctgaaattaccaccgaaccttttgtcacgattatgattccagctcataacgaagaaatagtaataaaaagcactttagagtatttattaacccaattgaattaccataattatgaagtgctggtaatggatgacggaagcgatgatcgcacccctgagattcttcgctcaatgcaagcaaaatattctcgtctcagagttattagaatcgaacaaaatcaaggaaaggcccatgcatttaatattgggcttttctttgctaagggtgaatatattttgagcaatgatgctgatactatccctgaaactgatgcactgataaagtatatgcaatattttacaagtactaacgggattaactatgctgctattactgctaatatggacgtttataatcgttcctcattatggggtaaatctcaaacggttgaattttccagtattgttggcataatcaaacgaagtcaaactgccattaataacacgatgtatgcatacagcggtgcaaataccatgtatcgacgcgattttcttattaatgttggtggtttccgccaagatcgggcgactgaggatattagcattgcctgggaccatacctttattaatgctactccgaagtttgctccagatatcgttttccatatgaatgttcctgaaacgtttcacgatttatatcggcaacgtaagcgatgggcccaaggtgggacagaagtttggctttctaattttctgaaggtttttcgccatccgtggcaatatcgatttgtcatccccatgctaacagacacaaccttatcgattatttggtctttctttttttggataacaagtatcattttcattattacaatgttgtattttgcaataattggtaactacgaacggatttggcacggcattgttatgagtatgatctttgtcaactttcaattaatagccggtctttttcaagtactggcggcattgattcttgattttaatggatctaagttacgctatttaatgttttcgccactttatctcttatttacctggatcgttaatcctttaacaatcgttactacatttcataaagcgataaaaactgttaccggccatggaagtggtaaatgggttagtcctgaaagaaaggtagttgataatgatggcaaattttgaaaattttctttggtggatattcattatctttaccctaacttgtggcggcttttgtattgagactcactatcgatataaaaataaagacgggattgataatgagcacaaattttcaaataaatataagtattttggccaacctgtttatgacaaacaaaataaaattcatggttatgaacttttattacgggaatacaatcatcatactaataaatggcaattaccacgaaacgttgtggacttccccctcagtaaaattgtttctacaatccaagaaatcaatccacagttaaaagatatcgcaaacttatcgttaaatatgaccgtcagccaaattaccgattttcgcgctgagtatttctttacttgggtcttaggaacgacaaatattaagcaactagtcattgaattagatgctaatgatattagacgtgccaatatttttaaacgtaaagaaatattatatatactaagaaaaatcaaacgacttcaaattaaagttactattgaaaatgttgattcttctaaaaaaacatacaatttgttacagcagtatttgccagatattgcctatttaaaatttaaaatttaatattcattcttttaataagtcagcaaatcactggatagatgttacactcgcacagtggcaacgaagaagcgccatttttaacattgaaatgattgtcggtaaaattgaagatgctaaccatattgcattagtaaatcaactaaatatccctttccgtcaaggttatgcttacggtcatccagaaaatttaaaaaaatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactgtgtgcagttcgccagtagcccttgcgggtactagcgaagacatatgcatcacgctgggacagccccagcttctgtaagttagttaccttagttttaagcttcttccattgcttccagatatactgtcttattcgggccctcaaccacttgtcaaggcgttgaataaagtcagttagtttcccaattgagtagtactgaagccatccacgcatttttcgatgaatttcttcaaacattcttgtcagggatattccacgattacgtttagttaataacctcaatgctttctttactcgttgttgcgattgttttgctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttatccaactcatttagatagatattcgccagtattggtgacaatggccctccttgtggggttcctttttcactcttagcgaaaagcccatggtctaagactccgctagttagaaacttacgaatgagccttagtgtccatgggtcatcaatatattgttgaagatacttaatcatcaagtcatgattaacattatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaattccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcgcagtggacacccttgtcctcagctcatggttccgactactacggcccatagcggactctcaccgcctagctaatacccatgccgggcgcacataaataagcgaagttggtttttaaccagcctcgcttatttattttagaaatatattcatattaacaataattttgcactttagctatttgcgataaaatccaataaccgatacataactcgcttattttcagccggaacgccatgctgaataatttcttttccattttggtgaagatcattatggtctaatggatactgatcatcatttacagcaatctcgcgaacattatctgctgtcggctcaaagtggaactgaagtccaataacattaccgttcataacaaagccttgatttttaactaagtcactactaaataataagtctgcttgagctggaacttcaaacatctcttcgtgccaatgcagagcagttaatttttggggaatatcggaaataagatcgctttttagatacaccggcgcccaaccaacttctttatgtggtgccttctttacggcataaccgagtgtcttagcgatctgttgagccccataacacgcgccaaaaattggcttatgagcatccaatagtcgctgaattaaaactcgctcttgcttgatccacgttaagtcgtcattagggctcatgggaccgccaagaataatcaacatatcagtctcatcagcagtcggcaaattaccaaactgatagggatgataaacgtacatctcatgtccgcgatcctgtgaccattcttgaattgttcctggtccttcatttggcgtgtgttgcaaaacattgattctcatcgaatatcctttccgtcgacggcaatgttgtgctaggtatcgcctgcaagtacctaagatattattgttataacatcaaatcatgagcttaacaatagtttttattcccaatattcttcatactttcgtgatgccccggttgcagcatcaacatctgctccaccattatcttcacggcgaaaaataaaaactggctcttctgcctcttgctgataatcaacggtaacaactagtcctgagaagaaccaagcatccgcaaagttaacatggtaattaataccatctttttttatgacgattgttgcctcatcgagcgtcggttctggtttatacccttgcttaggaccatgtttaacattgtgtggttgaattgttttaccataaaattttactccatttccactagcgaggttaaatttttgttggaaccacttgctagcagcatcagtaataattaattgcacttcaatcactccttagtttactatttcttttattttacaaccaagaacctatatttacctatttctgaaattaaactattcgcagtctccctctaactttgtcgtattattatttacacgtatagattaacatctttattaaatagtttcaaaggaatttatttaaactaaaatacatgttgactttataaaaacacgtgttattatagcacctgtaaattaaaaaataacaagtttaaaattaaaggagattgttaattatgaaatatgctgtaactgccgctactggtaacttaggacaagctgctgttaaagaattaaacaagttagctggtgcagaaaatgttattgttattgcccggaacactgataaggctgctaagctctttcctaataatgaagttcgtcaaggagattacgaagataagtcatcaatgatcaatacttttaatggaatcgatcacgttctctttatttcatctcaaccaggtggtaaggttgatcgtgctactgctcatgctaatgtagttgatgcattaaaggaaaacaatattaaatttgttgcctatactagttttaccgacgcacaaaattctactgctgcccttgcaactgaccaccgccttacagaaaatgcaattaaagaagcaggcattgatcactcattccttcgtaacaactggtatcttgaaaacgaaattggtttccttcaaagtggagctgctagttgcgatgcattgtactgggctaacaacaaagctggttgggcacttgaacgtgattacgcagaaggggctgcaaaagttattaccagtgaagatcctcgtgaagtttacgaatttgctggtaaaacccgtacttatgatgaattaggaaaagctctccaagaagctactggcaatgattttactatcaagcagatttcccatgatgattatgtaaaatcattagaaaaagctggcttagatactccaacagctgaacttttcgcatcattccaagacccaatcaactctggaaatcttaataaagaaagtaacgatttagaagaagttcttggacaccccgttactccacttgttgatgctatcaaagaagtccttgcacggtaaaatcatttgttcgtgaaaaccatcgaggctgagagaaaacaaagttttctctcagcctcgatttcttattaattatttttcatcatcttgaaccatctttaagctggagccaaagatctgttcaatcgtaaccgggtcacggtggtcaaagaattgactttcgttcttgttaagactagccattcttttcatatcatcatcggaaagttcaaaatcaaagacatcgatgttttcttccatccggttcttgtggactgactttggaatgacagtaatgccccgttgtaaaagccagcgaagaattacttgaccattgctcttgccatatttagcagcagtctccgcaattgcttcgttagtaaagatatcatgcctaccttccgcaaatggtgcccatgcttcaacacgaatatcttcactttgcgcaaacttaacttcttggtcttgttggtaccaagggttaacttcaatttggttgaccgctggcttaacaggcattgttaattcaagatcctttagttgatcagcgtagaagttcgatacaccgattgcacgaatcttaccttccttttgtgcttcttgtaatgctcgccaagcacccattgtatcgccatatggttgatgaagaaggtaaagatccatgtaatcaaggccaagcttttgcagtgaagcgtcaatccctgatttagcccgcttatagttaaaatcagacacccataacttagaagttacaaagacatcttcacggtttacactactattcttaattgccttgccaactgcttcttcattttggtaagcagcagcagtatcaattaaacgatagccgacttcaagagcatcggtaactgcttgttcagcttgacttaagtctggaacttggaatactccaaatccaagggttggcatttctactccgttatttaattttactgttggtacatttgtcataaaataattcttcctttctgtaattaatcgttgtctatatattaattgctaatttacaaattgaaaattactccctttacatggtagtatacaattggcgcatactattaaggagtggtctaatgattgataattacttgcttgaagaattagtgaccttcgccagtgaaaaaacacttgctaaaaccgctgaaaaacttagcgttacccagccgacagttacccgggggatgcaaaaattagaagacgagcttgggattcaattatttgaccgccagcccaaccggatcgtcctcactgataccggaaaattagctgctgaaaaagctactgaagttctcgccgtcaaccgtaattttgttcaacaacttcaaaattatgctgctcgacaatcagtaattaaaatcgcatcaattgctccgggtccattaattctgcttcgcgtaaaaagtgcatctttttctacacaaattgcgattgacaagaagtttattactcatgaccaaatcaccacttcacttttaaataatgaaaattcaataattatcagcgaccaagagattcagactgatcaaattgaatcgcgttatttagggaccgaaaatctctatgttaatcttgataaatttatgtaccttgctaattcccaacaggtttcttttaaggacttagccggattaagttttgtcgttttgaacgatatcggaccgtggaaagaaattatcaaaaaatatattccaaatgctaaatttttatatcaagaagaatgggccgcgcttactgaaatcacaaaatattctagttttccatactttagtactaatataacaacagttaatccacaacaacgtacgtcaaacgacgatcgagtccgactcccgattaccgatgaagttgcgacaatgacgttttatgctaattaccttaagaaacaaagaaaatccttaatgcccttacttaatgaaattagccaaaactggcctaatttaagttaaattataggcgtttaacttgtttcgctgaaaatccctatttaaaatattaataaaaaatgaatcatggtgactaaaatgacgaaaaaattattactcctttcaaccggtggaactattgcctcggttgtctctgatgaaggactagctccaggcgaatctggtgaagaattaatcaaaatgcttggtcggctggaatatgacattactgttcgtgatattctcgaattagattcatccaatattcaaccagaagaatggaaaattattgccgaaacgatctatgaccatcgtaatgaatatgatgggatagtcgtttcacatgggacagatacgatggcttatactgcttcaatgctgactttcatgcttcaacatataaatattccggttgtgctaactggaagccaagttcctatgaatgtgattcttagtgatgcccctgataacttacgacttgcctttgcagccgctgctaactgcgagccaggagtctatattgcttttaatcgtaaagtaatgcgtggttgtcggagtgttaaagtacggacaaccgccttcgatgccttcgaaagtgtgaatgtcccaccagtaggagaagttacttcagacggcttttccattagggatcaccagcatccccaacctggtaaaagtcaattaaatactaaaatcgatactcatgtttcactggtaaagctcttcccaggatttgatcctgccttgctccatgcaatggctaaaaatggctgtcacggaattgtgattgaagcgtatggtctcggaggaatgacctcgattcggcgaaatatggtcgctgcggttggtgaattaatccgcaatggcattccaattattacttccagtcagtgtctttacgaacgaagcgacttgacaaaatacgaggtcggacgacttgcactactagaaggagcaatcagcgcccgcgatatgacttccgaaagtgccatcactaaattaatgtggggtcttggtcaagggatggatgttaaagaaattgcagacttcttcaatactgatgttgctggtgaagtaactttagattaaacgaataagagacaggatgaaaattttgtttttcacctgcctcttattttttacttaaaaccagctacggatccagttaacaaaccgggtccaccaagactgagcttgttgcttaactgcctgcccgtcttgagaattcaagaattttttcgccttattcatcatatctcctgatgaattctttacattattaatcgtatcagttacgtgcgagctatagtctttacttgaactaattggagcattattaaactgaacaagcgcattgataattggttgttcatgattctttgtttcattgtaaatgtttcgctcttcaagtttctgattaaagattacttgaatttgattttgcgttggggtagttccttgtttcttttgttggttaatttccttagtggtatcaccaaccgcagccatcaacttaccaggatatttactatcatccttattggcttcaattgccccatttgttgcggtcaacatttggttagcagattgagtattttgctcatttaaactaactccatctgccgcaattgctttatagactccggttagagctgactccccagaaacggcccggttagcgctaacggtgatagtaacatccgtaacccccgccatttgcgcaaccatggcgtattgttgagcggttactttagtaatattatcctcaccattaaacttttttacattaactttaatccccgaacctggatcggtggggacaattgctaccgaactaaccatggcggcgttagttgtcgaaccattcggattgatatacttctgataatcactggcagtagcggttaacgttgtaaaattatcatcgactgctagcacattatttaattcattcttctcggcagcccctgctccatatacaacatatgatttatttaacgtatgagtctgggtagttgaactgctactcgtactttcactagttgtttcagccgccaaaactgtggcctggctaactggcactgctaataaagatagtgcaagagtcgaagtaataatgattttggttaacttatttgagcgcacttttttactccttttaaggcaaattaaatttatgttaatgataagaaaaaatccgccaaaatactagcggattttattttctttaccacagtttaattattacgccagtggattgggcgggagcagaaaggcgctcagtcataacttggcttggccgttaattctctccctcgtcttgcagagcttcaccgagttgcttcattcctgccttgatctggtcttcctgagcattggagtagttcaaccggaaggcaccgggctgtgggtcacctgcataaaatgggtcacctggtacaaaggccacgttatgttccagacattgcttaaaaagctcaacagtatcttctactccgggtacttcaacccataggaacattccgccttctggatcagtatatttaacaccttgggggaagtatttctctagcccctctgtcattagtgctttgcgttgcccatacaggtcactaatttgcttgacatgtgcatcaaggtcgttatgcttcagaaattctactacggcatactgggctaagttatctgtatgcaagtctgcagactgttttagtaccgtcagcttattaacaacagcttcatcggctaccacccatcctaaacggaaaccaggagcaagcgtcttggagaaagtccccatatagaaaacgtgtccggttttgtcaaacgacttaactgctggcacatgctgccccttaaaacgaatttcaccataaggattatcctctaacacataaacatcatatttagcggctagttcggccagcttttcccgtcgctttagtgccatggttcggccagttggattttgaaagtttggcacggtgtaaaccaacttagcttccggatgagcctttaatgcttcttctagggcatccatcttcatccccgcttcatccatttctacccccacaaagttggcaccatatgatttaaagacatcaagagcacaaagataagttggctgttcgaccagtacggtatcaccaggattaacaaaggccttcccgactaagtcaagagcttgttctgaacctgtcgtcatcaacacattgtctagctgtccggtcacgttttctttttctttgacacgttggagaaccaattcacggagggccgtcacccctttagcggctccatactgcattacttcttgaccacgttcagcaaacacctggtcaacagcttctttcatcgctttgacagggaaaagctcaggtgccggcaatcctccagcaaaagaaataatctttggatccgccgctgcttttaagattacaccgactgcatctgttccatctgctggcacgcgtttggaaaaattaaacttggtcattgtcgtcactcctcgtaatagatgccacatggcattaacgttatcaatctattctgcctgagctagctggtttgctcgctcttcttcttttttcaatcgttctttgatgtatgttgcggatgttgctagttttgattcttcttccggcgtcaagtccagatgcagctgctccactaccccgtcacggccaacgacagctggatatgaaaggtacgtgccgtattcttcacgataattagaaactggcatttcagttcgcgcatcattcaataatgcgttggttaaccggactgctgccgtggcaacaccataattagtgtatttcttcccttgatatacgaggtagcctccttgacgagcacgttcttctagctcagaaagctttaatccccgttcttttgctagttcagtgaccggtttccccaggacgcggactgtcgaccatgccgtaaattgcgaattgccatgttccccaagattaaaaccaacaacagagcgtgaatcaactttcaaagcttcaccaacccgggcccgcatccgtgcagagtcgagtaaggttcccgtccccatcacgtgttcttttggtaatcccgttaatttttggtacattgaggtaatcacatcacaagggttagtaacatcaactaacttaccgtgaaatccattgtctactaacatctttgctaccaagggcacttgggtccgcgtaaacttaaattcagcaaagcgatcatgatctggcgtatcaaccaactttgatttccctagggctgacacgaccacatcacaatcacgcaattggctttcatcattaacagtcaggttagtatggtaaggcaaattggccattgcatctcgtaagtccaaagcatccgcttgcaccttagcttcattagtatcaaataatgcgaggtcatcgacaaagccaccagcaactaaatagtgcgctaccgttgccccaacgtgacccattccgactactgctacttttctcgtcataataaaactccctttctcttttattgcacaactatgtaaaataattaattctagtcagtcacgtccacactcacagtgccgaagccattatcaaatttggcttcccacttgccggtagttaaatgtggtggtaagaggaaagtacctgatgatactagctgccctgcgcggaatgtcttcccttgttcttcaagctttctgactagccattgcaatgactttaatgggttgccaagcacttcacttgacgccccactatccacttctttgccatcgtggtaaagggtgacatttacatttgctgcatcatcaacggtcttaaacacctcatcggttggtcgttcttgaccatatactacatacccaccaacagcacaatcactcatgacactgaatttatttagatctgggaaccagtcagcaaaacgactatcaggtacttccagcgtgccgcagacagtagtcttatgtaataaatcttccatcgaatcactggcgtgcaagtcagttttagcacggaagccgagttcaacttccactaacggagccatcgtttgttctttgagagagagaacggcaggtgatggtaagaagtgggcatcaacttgttgtccatagagcggactatcagaatcaaacatgtcctgggttttcttactagttaaggaaactttgtacccgccagttgggagtccctttaattcaacgaaacgatcttgaagggcataagctgtattatcatcgctaacgacctctgcccattcatccattaccagtggtttcttgctttgataagcttggaaaagttcttgagcaaaagcttcttgttcttcatttaaggtaacgtttttatttgcagtcataataatatcctccttaggacctgaccgctgttaccaattaattatcggtctaagccggtcaggtcatgttctaatttttcttcaatgttaataatgtctgaaatatcactgtctgccatgaccaccaccacctttaagtatgtctaataaaaaacgccctcctagctctattaagaactaaaaggacgtctatcaacgtggtaccacctttatttacaacacaagggttgcctcaatcaactgcccacaatggcaattaatcggcaagataatggctgctaccagtatgttctactattatttcgacatacaactcgcgagggatttgtcgcaactacctcctaccggtttccaccaaccaccggctctcttaattcagcagaattgacgattctcggtcaacgttttttaatttctcttaattgattattagtagaatatcacgtgaaaatgagaaaagcaagagttaaattaaaaaatcattaaaaacaatattgccatggatcgttattcacaaaatatgcacagtatcaactaatttgactcttcccacaagaatttaatcaattcacggtttacttgactgttattgtggagcttactgtgctgggcattctttccatgaatttcaacttcgcgatatgatttgcacgatcactgactaaatactttaatgatttagcagaatttaccggtacatcttcgtccgagtgactaccatccccaacatccccataaatatttaacacggctgtatttttcggaaaggtctgccgtaaaccaagtaattcgcggtaggcagagtccattttctctagttcgccggtctttggatttatcttagcattttgcgtctcactttgccctaccagtccattatagtgtccagcaatcgctactaagtgggctacttgcggaaagcttttatcatttacattgtcattaatataattgataatttccaagtttcccattgaatggcccacaaggttaatttgcttataatggtgttgtttttctaaagctaataccacattttttacatattcaccaccatgatgatagccctgcgtgtaattatctcgatatgcacttaatttattatcttcaaggttgacttccacaataggattaacggcatttgcgggaattgggcggtttcccttttttgtcaacattcgcccgcacaattgtcttggttacaccggcatcacgggccgcattagccattttttcttcggcatgagaactgctcccccagccatgcacaaaatcgtcggtgttgatgattgaatataatgggttacagcatgtgctcgtgaacttattcctaataggccaactaaaataacagcaaagcctaataataattgagaatactttttcatctaatcttcctttacaaaagcttcatcaaagaattgtttaatcttattaaatggtattttatcaactcgatcataaaggtcaatatgttcacaatcatctacaacatacatctctttaggttcttttgctagcttataagctcgttcagagaaagcacgtgaatgagcatgatcaccaaaaataaaaagaattggccgtggggaaatctcatcaatataagctaatgctggaaattgcatcatggcaaggttagaagtagtagtgaaatttccacgagcatgagcatgaaaaccacgaggaacagcataaaatcgattccattcattagtaatcggatcgatttctggcaatgcatcaacattcgggtaaggtttagttgggaaacttggcttatattcaggaatcccgcttgcataatcttcccagcgctggttagctaactcttctttcattttatttaactcttcatcgcttaggttcatcatcccacgaacatcagtaatatcatacattgatgcggtagcaacggctttaatccgcggatctaccgcagcagctgctagtgcaaagccaccagaaccacaaattccaataaccccaattttgttacgatcaacaaacggaacttcaacgccaagaaaatcaaccgctgcactaaatgattctgcaaataaacctggggaggaaacgcgacgtggctcgccagcagaatctcccatattggcttgatcaaaagttaatacaacaaagccacgctgagcaagttcattaccatacacggctggtccttgttctttcaccccaccatatggcgcaccaataattagagcggggtgcttttctttaatatctaaacctttagcgtaataaaggttaccggctaattctaagccataacgatttttaaaattaatactttgccgttctacgttttctgataatggtgtaatgtatccaaatgacatattattctcctccgatttttttaattactttagcaggaacgcctgcaacaacagtattggcaggaacatctttactaacaactgctcccgctgcaacaacagcattttcaccaactgtaacgcctggtaagattgtagcatttgcgccaagccaggcattttccttaatgaggactgatttcaattcaacgccgcgtcgcttttctggatcaaggggatgatttaccgaaatgattgttacattgggtccgactaaaaccttatcttctaattcaattccgccgagatcagtaaacatcgcaccactgttaataaatacttgtttcccaattttcaggttagctccgtaatcactacggatcggcaaacgaatttcaaccgaggcatctattttttgaccagttacatcattaaggacatggcgaatttctctttgcgatgctgaccgactattcaattgttgaagtaagtcttgattttttaaagccgttgccgtgattgtcgcaagttcttctttttgaatctctttcattttcatccctcttttgcttgaaattattgtttatatcttatcgagtttttataataatgttaaatacttatatttaatgacatactatagttaaaaagcatattggagtgattaaaatggaagtccgtgtactgaggtattttattgaagtagtccaagaaaagaacatttcaaatgccgctaaaagattacatatttctcaaccgacactatcacgacaattaatggatcttgaaaaagaacttgggattactttatttgaacgaggacaccggcaaatcaaacttacccaagaaggctattatttatatgaacgagcgcaagagattactggcctcgttgacaaaactgaaaccgacctgcaatcacaaaatgtcataagcggaacattagatattggtgcaggagaaagtgcagctattcagccagtaatgactgtaattggtgatattatcaaaaagtatccagatgttaagattaacttagtaagtggtgatagcgatcaaatctatcagcgcttaaataacggtaccttggattttggaatcataatgggaccagaaaagctcctagattatcattcaattagattgccgcaaaagaatatctggggaatcttagtccgaaaagatcagccgattgcagaaaaggaaaagattactccggaagatctaaagggtgtccctattattacgtcagctcaatctaaagagcaggatgtgtttcgggtgtgggctggttcattaattgatcagtacaactttattggccagtacaatttaatttttaatgctcgtttattagtcgaaacaggagcgtgccttgcattaacctatgaaaatctgatcaatatcactggaactaatcttatcttccgtcctttaacacctactattacagatcaaaataatctcatttggaataaaaaccgtcaattatctaacgttgcgcaggttttcttgaaccacttaaaggaagtacaagtagtatagaataaagccttttctctcaaacactggcttttatattacttccctatagaactaatatgatctattaccattgtttaaaaagcaaacgaccttatcctaaaacgaataaggccgcccaaacttatatgactaaaactctaaagtacctttcaactactgctgtctataggtcttgaagttcttccatatggtctgctgttttttgatctaattcattatgctcatcagtaaaatcattgtaactaccactaatattagttgcatgattagcaaaatgttttaagtctaagtacgatttatggatagtttccttgtcggatttctttacagaatcatttttctgaattttttgatctaggtcatgcaggtcattaactttactatcaatttcatcaatctcgtcggtatgattactttggatagtatcaacggcagattctacatcaaaatcatcagaattatctattgcatcgctccattcttttccttcttgctttgaaagatcttcaaccttagaaccaagtgtgccgtattgatcaataaaatcttctttatcatccttataatttgatttgttcttttcctgttgttctgtagcttgttgttcttgagcttcatcaatacttccctgcgccattccagcaattagtagtgaaataatcattactataagactaatccaaaaatattttttatttttcttaagagattcattttctttatcttttcttcctttaaaccacctaataccatagacaattgcgactataaacgtaataaaaaacaccaaatcaaataacgttaccaatatctccatataaatatcctcctcaaatatacaaaaatggtcaaccagcgtagctaattgcgtcgattgaccatttagttttaaaactcttacattttaccaaaaattccttaaactgcatatgtttaatacaggaaccaccactaatttgactaatcagataaaattttagattaatagtcaaattcttctttcatatcatcaaaaaagcgctgaacaactggatttcccagcttcagcgcttctctttatttaaaattaagtgagtcaatccagccgtcaatttggcgtgggtcatttaaaattgccccttggttgactttggtatcataaccattttcattaaccgttcgttcaacatagttttgtgagcgatcatagcttgttccaccagaagtagcaaatagtgctaaattcttcccgtttaaatcaagatgatcaatcaccgtactaatcatccgcggcgggatagcccaccaaatcgggtgcccaatgacaatattgtcatagccactaatatctggtaaatcatccttaatatcaacccggctattatgctcgtgctgttcaattgatgtccggcttcgatcatcatgccagtttaaatctgcatccgtatatggttgtgctggatgaatttcggcaatatctgcatttaatttttgagcaatctgttctgcaatcttcttagtagtattggttgcagaatagtataaaacaagggtctttgccattaatgaaggcctcctttatcttaaaacgcagtataaattttaacgtaaaaacgcaatgatggaaaatgcttataattaatccttatctatgctttaaaagtattaatcgttagcgtgaatatcatatgcatttaataacatctcaccaacaccaggcgcatcaggatcatgcattcccttgcctttatcgagggcccgaatttgatccatttcttcatccgttaattcgaagtcaaaaatatcaagattactcttaattcgtgcttcgtgaacagacttagggaagacaacaattccttcttgattttcaaagcggagaattacttgaccagcattcttaccgtatttttcagcaattgctgtgattactggttcatgcagtaagtcagcattaccttgtccaaggggtgcccaggcttcaagacgaacatcatccttcgcaagaatttcccgtaatttcttttgttggaaataagggttaaattcaacttggtttaccgcaggagttacatcaaagttagggacaaacttgttccaaagtttaggtgtcatgttggaaacaccgattgaacgaagcttaccagccttttgtgcttcttcgactgccttccatgcttcgtcaaccgccccatatggttggtgaagaaggtaaaggtcaatataatcaagccctaatttgttaagagaagtttcaatagccttctttgcgtcttcatacttgtaatcttgaagccacatcttacttgttacccagatttggtcacgaggaatcccgctatccttgattgctttcccaacttcttgttcattcatgtaggcagccgcggtatcaatatgacggtaaccagcagctaaggcatccttaactgcattgtatgttgtaccatcagcagggatttggaaagttccaaaaccgattactggaatttcattgccatcgttcaatttgaaagtaggtacattatatatagacattatttttcgtctcctttgcgttaatcattgtctaaatattagcaccatattttctaaactaacattacttgattatcatatcagtatgcccgaaacgtatactaattgagtgaaggatatgggaaattttaaagtaaggatttaaaaacaacctgagaaaaagcttttattttttcaacagcctcgttattttatacgaatattgttacgatatcatggcactggctgcgcgtcgccaaaagactcgaagctaagtcccctgtgccgtgctaaaccccattctatccttagcccctctttgttgaaaaattaattcacactcacctacttttcaaatttaattcttgctcatatcaataattactttacctttattatgtccctgctgaacttttttcatcgcttggggaacctcatctagtgaaaagattttgccaaccgtgggatgaatttgattttcaaccaagatcttgtttgcagctgctaattgttggccattagctgttacgaataaaaattgatagtctattttctttttagctgcttctttttcaatactacgggatgcaagactaaaaagtccttgtttgaacttgctcattttcattcgtttagcaaattccttattaggtattccacgtaaagatacgagtttcccatgaggacgtaaaattgccatctgcttaattgtttcttttccacctaatgtatctattactaaatcaatccctgaaagaacttttgtgtaatcttcttttgtatagtcaataaatttattaaccccgagttgttcgacacgttgctgattttgtggactaccactagtaatcactttgagtccttttgctactgcaattggaatagccattgcaccgaaacttcctgtcccaccagaaataaataatgtctgacctggcttagcttgtaacaattcaagagcctgaattgctgttaaagcagttaaaggaacgccagccgcttcttgattggtaagatattccggtacatgagcaacagcggattgattaaccactaattcttcagcaaatgcaccaatattatttaagggattgcgtccatatacacggtcgcctaccttaaaattagtaacatctttaccagtttgttgaacaagtcctacaaattcatttcccagtgtttgcggtaatttatatgggacaactaatttcaaatcgccccatgctattaaattatctaatggattgacacctgccgctttaacttgaattagtaggtcgtaaggtccaagcggcggcaaagaagcattgctaattagtatttgtggattctttttattgtatttagtaagttgagctactttcataataatcctcacttttttcttatctttatcaaccataacgaattaagaaaatagcgtcaataaagtagctctaacatgtatttcatgcttgctttctagcattatatctttcaatgtcttactaacaagacattaatcgcactattattcaaaggcttttgtcttgccttattttattagttacaaataaaaactgctagctattcattttttgcattattgcctacttaatattggtattttaaattttatctttctaggcttatagtaaaagtaatcaaaattacgattgagaaaggaagattttcatggctaagaaacaaacagctggtcgcgaccaacttggtaatttcgcccctaaatttgcagaattaaacgatgatgtattattcggacaagtttggtcacgggaaagggaattaagccttcgcgatcggagtcttctcaccgttaccgctttaattacaaaaggtgcttttgaacagctcccttaccacatgcaaactgctaagaacaacggcattacaaaagatgaaattgcggaaattattactcaattagcattctacgttggctggccaaatgcttggtccgcattcaacgttgctaaaaaagtatgggatgattaaaaaatcaatttaaaacgtgcctttaatggcgcgttttttattttcggcctattataaaattaattaggaattgtgaggtaattaggatggaagaatttaaagaagcttattatgatggtgaacgtccactttatggtcttcaagatgctcatttagtaaacactacttttggtaagggtgaatcaccattaaaagaaactgctaacttaactctcgatggcgtactctttacatggaaatatcctctttggtattccgatcatatcaaagtaacaaataccatctttgaagaaatgtctcgttctggtatttggtatactaacgatattgaaattactgacagtacaattcaagcacctaaagaatttcgtcgatgtgatgggatcgttcttaataatgttcactttacaaatgctgctgaaacaatgtggaactgtaaaaatattaagatgaaaaatgtatatgctactggtgattatttaggaatgaatagcgaaaacatttatgttgaccatcttgatcttgtcggaaattatgtttttgatggcgctaaaaatgttgaagttcataactcacgcttagtatcaaaggatgccttttggaactgtgagaacgtgacaatttatgattctaagatcagtggtgagtaccttgcttggaataccaagaacattacttttattaactgcacaatcgaaagcgatcagggattatgctatgttgaccacttaacgataaagaattgccgggcattacgaactgaccttgcctttgaattatgtactaatattgatgccgagctaaaaggtactattatgagtattaagaacccaattagtggtaaaatcaccgttgatcacgctgatgaaatcattatggataatcctaaaattgatccaagcaaaattcaaattatccaaagaaagtagagggtgaaaaaattatggaatatgatttcgatacaattctcgatcgacgtcacaccaattctgaaaaatgggacgttaagccaaatgagttaccgatgacaactgctgatatggacttcaaaactgctcccgaaattatgactgcaatgaaaaagaagattgattcaggcgcttttgggtatgaatatcctagtgaagaatactttaatgcggttgcttcttggtataaaaccgagcataacgcaaaagctgatccctcttggatgcgatttgcgactggtgtcatcccttctattactgcctgtgttaattatttaagtcatgaaggcgataatttcttgttaatggagcctatttacaatactttttacaattctatcctcaacagtggtcgtcatgcttttcctacccaactaaaatacgatcattctacgtatacttattctgtcgattgggatgaccttgaagacaaaatgagtaacccgcttaccacgctgatgattttatgtaatcctcacaatcctactggctacgtttggtcacgcgatgagttaatccgaattattaagctagcccaaaagcacggcatcattgttattagtgatgaaattcatggtgatttagtattaacgggtccagactatacccctactttctccttgccagaagattgtcgccagaatgtagttacattagtgtcaactagtaagacatttaatgtggcggcccttcatgctgctacgggaatcgttcctaatcctcttttgcgagaacactttacgcgcgcaatcaataagtatgaagttgcagaaccaaacctcttagcaattcctggaacaatcgctgcctatacacaaggcgcagactggcttcatcagcttaaaaagtatttattaggaaatcgtgaatatcttgttgaatttattaagaaaaatcttcctaaactccacgttgttcctggaacagcaacttatcttgtgtggatcgatgttagtgaagtaaccgatgatagtgctactttagcgcaaaaaattcgtgaaaaaactgggttaattattaatccaggaacctattatcatggcaatgggagccactttattcgcattaacattgcctatccccgtgcacaagtaaaagatggcttagaacgattagctgctgctattaaaaattaaccattaataattattatcagtaattaaaactattttcctcttggcttactaagaaattaatttattttttcgcgcttttaaatatttggacaggaatgagtgagcaccaatatcgcgaaaatcatcattaaacataaaattgtaataaaatcccccgcatgcaactttcacacatgcgggggattttattaatgatcagtttcaacctctaatactttcttcgatccagcatcaatcttaacttctttaactgttcgtccatcttttacttgaacttcccacacagcctgattttctttttcttgttctaatttccattcgataggactacccttcttagttgctttttctgcaatttggctcgcctcatcacgactaattgtcttacttggatctaatgtatatttcttatcatttttatcaagcttttcagatttattggaaattactttaccatccttggcattaactttgaccttatactcattcgcattgtcaaagccttttattgtatatacatatttaccattgtcactttctaattcaacttcattgatttgcttattttgatacttttgattaaatttatcaattgccgcttgttgatcaatcttgatatcactcttcttagctaacttttcatgtttaacagctgcttcgatttgatcatgatggccatgtattgcaactaccccaactgtgcctcctgctcccaacacaatcccgctacaaatacaggcagtaataagcattttcttagtcatttgaggaaatttccttgattttttcttatctgagtttggttgatgatcttgtcttttttcgattttttccgtcatttttattcttcccttcttaactttagttggtaattttattttacgaaataatctgccaactaaaaccaagaacaggtgaaagtatgatgaagaaatcttcatttttgtttaggaagataaactgtaaaaatcgttccaactggttcattgtcgcgaatcataatttttccgtgatatttttcaataatcattttaacaatcgaaaggccaatccccgaaccagcaaccttattggaatgcgattcatcttcacggtagaatctctcaaaaactttttggcgattttcctttgcaattccctgaccttgatcagtaacttttaaaactatttggctatcgtctgccgttaactgaacattaatcgttgaattagttggtgaatatttggccgcattttctagcaaattatgaacaagactttgaaaatcaccttttgttatgcggtaagatatattcggatttaagtcagtaataaatttttgatgatatgcaccttggagtgactcaacttcagcgaaaacaatttttgacaagttaatttctgttagttttttagtctgatgtccttctagaataagcagttcatttattaattgactcatttgctgtgcttcttgatcaatgtactttaatgacttggcaattaattctggatgcttatccccatgccttcttattaggtttacatgtcctaaaattccagcaagcggtgtcttcaactcatgagaagcattcgcaataaattctttttcgcgttgcattgtacgatactgccgtcctagcaaatgattaaaagactgggcaacctttcgtacctctaatggttgttgcggaaccgttaaagttttcaatcgattgctttggggcgtgattgcatcaatttcattatctaaattagtcaatgtttgtgtccatcggcgagctaaacgatgaatgatggggagagcaatgatacttattgcaaggttaattaacagcgtcactatcaaaagccagcacgttaattcgattaaatcatcaacattaattgctactttgacgattcgattatggtctattttttgctgccgtaaataatagactccatgccgggttaactgtagattcttgattgctaaattccgctgatcaattcgcttaaatattttatgggctttgggggagatatatttttgttctccatcagtgatctcaattgcgtcatcgtcttgacgagcaacataagcatttaaaaaagtttcctgattcttgtttctaggccaatcttcttcaattgtttcaattacttcttctgcctgctcatcagcatagcgatatattaaatcagcagcagtcacaacaaaaagaaagttaataattaccaaaattgttgcaaataacgttaagaaaagacgagttaattgccgtgatgcggttattggacgtgtgttgttcattgctcatcacctaatacataaccaatcccccgcacagttttaattaaatcacggtacttacctaacttgttgcgcaaagcacggatatagacatcaacagtattggtctgaccgtcaaaattgtaaccccatatctcgttaagaaggtcatcacgggtttggacaactcctggttctttaatcaaggcagccatgagggaaaattctttaggtgttaaatgaacttgttttccatcaaccataaattgatgtttcagtaaatttatttcaaatggtccaaaattataatcatgtttttctgctttttcttgccctaatcgtcttagagcaaccctaattcgtgctaaaagttcctcaatttcaaatggtttagtaatataatcatccaatccttgatctagcgccatgctaatatcagaggtttgactacgagcagtaatcataataattggaacattactcgactgacgaattcgtcgtagaactgtgagaccatcataaaccgggagcatccaatccaataagattaaggttatttctttctcgttaaatatttccagtgcttctcgcccatcttttgcccagataacttcatatccttctagttctaattcagttattaagaaacttgcaagactttcttcgtcttcaaccaacataatgacagctttcttcattattttgcctccaattatttgtcctatatactattttagctgttttgattgcaggcaaataaaaaaagtttcatatgaaacttttttactgataattagaatttttgttcaagccgatataaatcattcaagaaattagcaacaatatttaattcatccattgaatattttgcggttagtttatcaaccaacttagtctttattatttcatgcatttgatcatgaacttttgctacttttttcccatcctaaatttcaagaataagttagccactggactcaaataaataatactgaccaattgattattggttgatggagctgtgatatctcttggtagaaggccttacgatagatatccattgacgaatgtccattaaacatagctcgtggatagtgattcatccaatcattagtcgctatgatctgagcactactatagttatttatagcttcacctttggtaatctccttgcggagaaaccggttattgatctcattggatccacgttcccaaggggaatacggatcagcatagaaaacatgatcgtgaacttgtgttaactcactaaattctgaaccgttgtcagaggttattgtcttaaagatgcgatagtaagcatctgtgcccattttctggcgtaaatttataaagaactgatttactgcatgcgcagttttaccagcaattttactcgtgatattaactcgtgaaaggcgatcagtcattactagtacaacactgtcattaccgtttttctgtccctgaactgtatctagttcccaatggccaatttcggaccgttggtccgcagtttgaggtcgttgagcaatattaggacctaagcaccttttagcttgcggatgagttcgatgatgcttacgtttaggcttttcaaagaggtctaaattggacgtacgaagcacaccctcattaatccattgatataaagttacaaccgactttgggatcagggtgccatcattcattaaatctcgagccttataaataaccgcttgtggggagtaatggtggtcgtcaaactcaccaagcattagctgatcagctaatcgtaaaaattgctttgaagaataatataagcgacgacgaccagaatggcggtgatgttcaagatatgtggcctgaccagcttcataactatagatgtagtaagaatattcgtaaatcttaccattagatttttgacgacgaagttggcggaccgtaccacggttgagctcgttattaattgtttgatgattaactcctaattggcgaccaattgcgcgattggaaagtccttgcgactttaaagtcgcaatcatcacacgttcttctttagtaagatgagcattctttttatgagtagtcaataaactagtagacatggtatcatttaagtgcgtcatttgacggacatcctttcatataggtttggttcacttaatatgatacctgatgtcacgccgaatggcgttttttatttaccaccaactgggtggctaacttcattctataatccaccacttttttcccattactcgttaatgaataatatattttctttttatcatcaggatgttttactgaaggaagtgatgcaatgtcgatggggcaaatttttaaccaggtcgtcattattttcttactaatgcttttaggggcagttattagaaagctcggatttccccatccgcaatcaattaatgacctaacaaatattacactctactttttatcgccaatcgtaattattaaggcctttgaacagccgttttcgcgatcacgattttatcaattattactattaattgttggtatctttttgacctattttgtttccattttgattgcaaaactactttttcataaagtaaaggaccaaaatattcgtcaaattgcaacttatggaagcatctattctaacaatggttttatgggcgttccattagcacaaggactttttggaagtgtgggtgtcttctatgctgtcgcttcaatgattggttttaatgtcatgtcatggacccagggaattggaatttttcaaaaacggcagcctcatgattggagaacacagttaaagaaaattattttaaatcctaatattattgctattattactggtcttttcctattcattagttcttttcggttgccaaaattaattgctgattttattgattacaccagtccagcgtttactccactatcaatgattgtcatcggaagtaatcttgccaatctaagtattaaaaatatcaaattaccaactgtactctggggaagtctcttcgtaaggaatattttcttcccaattctagggacaattatcttattattattgggaatcaccggtgttccactcttcaccacagtaattcttagtgcatgtccagtagcaggattagtcgttctttttaccttacaatcaaatggggatggacggccagcaaccgtcttaatgagtatttcaaccattttgagtttagtaactattccattagtctattggtttgctagtttgtggtaatgatatatacaatctttgaataaagtattaaatataataagcatttcaaataacagcctccttaatctatgatggaattagatacgtggaggctttataaatgaataaaccatatattacaattgaaaattaaatgcataggatcgggttaaattactgtgattctatgcgtttgtgctttaaaaacaagaaaacgcaagaactctcgcacacactttgggtatttaaaccaaagtagcgaaggggcttgcgtaatgaaatttataaagttgaagtgcaagataaaaaggtatgattccaatatccaactgggatcataccttttattctctagattactgctttttaagtttctttagatagaaaaacaagataaacaatcctattactatacacgccaatgcacctggccataaatctattcgaatgatcaaaataaatatagcatataagattattgctattccttctaagaaaaaacattgtttctttaaacaactaattagccataatattgcacaaagtaaagaagatgtagaagcaataatattcttattgtatgcacaatatacacaaataatgaaaaatattaatacttcaattatattccacttattcttttttaaaaaggtggattatagaatgaagttagccacccagttggtggtaaataaaaaacgccattcggcgtgacatcaggtatcatattaagtgaaccaaacctatatgaaaggatgtccgtcaaatgacgcacttaaatgataccatgtctactagtttattgactactcataaaaagaatgctcatcttactaaagaagaacgtgtgatgattgcgactttaaagtcgcaaggactttccaatcgcgcaattggtcgccaattaggagttaatcatcaaacaattaataacgagctcaaccgtggtacggtccgccaacttcgtcgtcaaaaatctaatggtaagatttacgaatattcttactacatctatagttatgaagctggtcaggccacatatcttgaacatcaccgccattctggtcgtcgtcgcttatattattcttcaaagcaatttttacgattagctgatcagctaatgcttggtgagtttgacgaccaccattactccccacaagcggttatttataaggctcgagatttaatgaatgatggcaccctgatcccaaagtcggttgtaactttatatcaatggattaatgagggtgtgcttcgtacgtccaatttagacctctttgaaaagcctaaacgtaagcatcatcgaactcatccgcaagctaaaaggtgcttaggtcctaatattgctcaacgacctcaaactgcggaccaacggtccgaaattggccattgggaactagatacagttcagggacagaaaaacggtaatgacagtgttgtactagtaatgactgatcgcctttcacgagttaatatcacgagtaaaattgctggtaaaactgcgcatgcagtaaatcagttctttataaatttacgccagaaaatgggcacagatgcttactatcgcatctttaagacaataacctctgacaacggttcagaatttagtgagttaacacaagttcacgatcatgttttctatgctgatccgtattccccttgggaacgtggatccaatgagatcaataaccggtttctccgcaaggagattaccaaaggtgaagctataaataactatagtagtgctcagatcatagcgactaatgattggatgaatcactatccacgagctatgtttaatggacattcgtcaatggatatctatcgtaaggccttctaccaagagatatcacagctccatcaaccaataatcaattggtcagtattatttatttgagtccagtggctaacttattcttgaaatttaggcttattcttttttaaaaattaatcaaaatcatcaaaactccccatgatagtcgaaataacttttccctccgactctaactattctagaagccagttcagcctctaaaataaaatataaagaaaactattccaattaagatcaaaattacagaaactatccatgtgcttggatgaactataaaaagtaataatccatatattatgaaaaatagtgcttgcagatataaaaatttcttccctagattactaattaatagtgaaagtccacaaaagattgacatcgatatcatgccaaaattgtaatcaaatattaaataccccgaaatgtcaatttaagttagaaagaaaatagttgctcatcagtgacgtaagacatgaatacttcatatggagttcgatagcctagtgatttacggggcaggttatttcgcttactcatcagttgggttaccaattcatcaggaagattgcggaaatctagctgtttcgttaagccatcccggcgtaaaaaaccgttgttgttttcgttcagccctcgttgattgggagcaccaacttcggcaaagtaagtgtgaaggtcaaattgattggcaatctcgcgccagccggcgaattcttttccgttgtcaaaggtaatcgatttgaagaagtgccgcgggaatttccgaagccactgacttaagtgttggttaatcgcatcagccgtcttttcgtgcacattgagtacaatttcgaccttcgattggccagccttcccacggcgctcgacatagccattcgggtgccgcttacctcgcatcggcaaggaacggacatcgaagccgaactggccacgttcaaacatccggtaaagagttcgcaggttacaactaattgggcgctcagcgctcccaataatggtatcaggcgtccacccctggtcaattttgtcgttgatataagtgagttcagccagtgacaactgagtacgttttcggccacaacgttgcttattgcgcatatagtgatcttgataatcagcaattgaggcaccggtttccaggtaacgataaacgcgataaacggtttcggcacaacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgtatcaaaaaaattctctaagtcctttagttaatgaagacttagagaatttttatttaaagatctctcattccatataattatggagaatatcatccgaagctgcctttaattttagataatcgatattattagagaatagcataatcattcgtttcgtcttgtaatcagcgacaaagcaactgttatatccaggaatactcccatttgcgcgaataacgtccccatcaaagtaaaccccaccaaaataggcaacttcttgatgctgcgcctgttggtagtattcattgatcattttgggatctttcagcacctcattatatacaaacttccagtaatcatttggcgatataaaaaggttccctgccccaaagtctgaggaggtcgttacagttacccggtgccaatcaactgttggatccattggttgcggaatttcttttttggaaacctcagaaaaatctttaatttggtgaagatggagcggtttagcaaagttttttcgaatataggtattatagctttgatgcgtttgcttactaataatggctgccaagatttcataatcaacatcttgataatcccatgtatgcgtataatcatacttgagatgtttaagcatataagcaatttgggctttttggcctctaagtggttcaaatggacgatcattattaatcaagccactagtatggttcattaattcccgaatcgtaatatctttactgccatcaatctgcgggtaatacttacttagcgaagtgtcccaatctaattgctttttttgctttaattgataaacagcggttcccgttacaatcttttgaagcgatgccgtgggaaatagtcggtccgcctttacgatctgatccttattcgtggtttcattattttcaatagcaatcgttttccaatctttgccattaactagcatcaccccattaatatgatggtccttcatataatcttgaagttggtgttgcgtttgtttgtcaactatttctgcctttacctttgatggcgtggtcaataagaagatagcaaaggaacaaagcgtcaaaaaaatatacaagttaacttttttcataattataagtattccttccaggcatccgttttcgaaaaaatatctatctgtattatacaaattttatcccccatcttacaaagtagaataaaatctgatttttattactaaaacactttaaattcattcgatttatgttaaaattctaacgtcaataaataaaaaacgcaaaaatagttcgtaaataacgaacattatcaagggagagctagaatgaataacgacgtcgaaaaagttttatatactcaagatcaagtcaatcaacgcttagatgaacttgccaatacacttactgaaaaatatcaagatgaatttccagttttagtttccgtaatgacaggggcaatgattttcactagcgaaatgatgaagcgccttaatttcaagttaaacgttgattatgttgacgtctctagttacgaagaaagttcaaaatccactggaaaagttaaattaattcaagatctttcccacaatattaagggtcgaccagttattattatggaagacattattgatactggtcatacattaaagtatcttgctggtcttttcgctgatcgtggcgcgaagagtattgagatttgttccttacttgataaaccggaccgtcgtgaagttaatattgaagctgattacgttggttttaaagttccaaacgaatttattgtcggatatggcctagactttaatggcctttaccgaaacctgccatttgtcggtgtgttaaagcgttccgtatatgaataatagttaaaggctgagagaaaatgttatttctttcagctttctttttggctttaaacatctaaacgcgatatagtacagttaggctaataaaattgataataattgatttttggtaaaggaggggtaatcattgcttaggcttgactggtgtttacgaatgctcatggctgccttatgtggtggaatcattgggtttgagtgaaaaagtaaggctaaaatggctggaattcggacccatgccctaattgcggtggggggcggcaatggtcatgattatttctaagtatggcttttttgatttactgaaagttacccatagcaattggaacgttgacccatcacggattgccgctcaagttgttagcgggattggttttttaggtgctggaacaatcattaatcgccacgatgaaataattgatggcttaactacggcggctggaatttgggttaccggcgcaatcggtcttgcctatggtagtggtttatacagtattgggattatcggtacctgttgcgttcttttagcagaagttattggaaaatatctagatcagtttgcacttagacaaggtaaaggattctcctgctttattcaattagaaggaaatactgatgatttgcatgcacttattaatcagctaaacaaaaaatattttgaagttccgcttaaatactcgatctatgattatggagacggaaaaatctcctgtcaactttatggtgaattaagatctggcttcaaatcagaaaacatctttactgaccttactgagctgggcaacattaaaaaagttgagttagaataaaaacataggaagtgacaagatggcttataattttagaaaagagtagaaagaattgtatgtccccggaaagaatcccagcctaatcaatgtaccaatgatgaagtatcttgctgtgcggggacatggggatcctaatcaagaaaatagtgagtataaaaaagcaattgaaaagctctatgctgttgcttataccattaaaatgagcaaaaaaggcacctaccaaattccagattattttaattttgttgttcccccactagaaggactatggtggcaagatggtatcactggaattgactacaaagttctatttcattgcaatgattcgccttcccgactttgttactcaagatgtttttgaatgggcaattcagaaggctagcgaaaagaagcagctcgatttacataacgtagaattcctgtcaatgcaagaaggcctctgtgtgcaagtacttcatatcgggtcatacgatgatgaaccggcaacaatcgacaaaatacataaatttattgcggaacaaggtttacaagtagatattaacgatgatcggcatcaccatgaaatttatttgtcagatcctcgccgtaccaagatcgaaaatctaaaaacagtattacgaattccggtaaaaaacaattaaaaacactattaataggtgatcctctattagtagtgctttattttttgccttgaccggtgagtaaatactcactataatgaaataaaaaagtaagcatttactcaccaaacagaaatgagggaactaaatatggtagaccttattcaacttagtcacttgagtaagaaattcggtgaccgtaccattcttcatgatattaatttaaccgtcactcccggtgaaattgttgggttaattggaccctcgggttcgggaaagacgactgcaatcaagacaatgttaggaatggaaaaagctactcaaggaactgcacttgttcttggcaaaacgatgccaaatcgaaaagtacttagtaaaatcggctacatggcgcaatcggatgccttatacgaaagtctttcggctaaagagaaccttgaattctttggcaagatgaagggggtaactggcagaaaactctccgaagaaattatccatgtcagtaaagttgttaatcttcaaaattatctcaatcaacgcgttagtggttattctggagggatgaagcgacgactttcactggcaattgcgttgctcggacagccagaactattaattctcgatgaaccgactgtgggaattgatcctgctcttcgccgccaaatttggcaagaactccttaaactgcgtaatcaaggacagagtattcttatcactactcacgtcatggatgaaacggaacttaccgaccgagttgcgctacttttgcatggggatgtaattgcatttgcttctccaacagaactagaaaagcgatatggtgtaccaacgattgaagatgtctttctaaaagctgaggaggaagaagcatgagaaccctagcaatcactaaacgcgtcttaaaagaactatttcgtgacaaacgaaccttagcattgatgtttttagccccaatcttaattatgtggttaatgaacgtaatgttttctgctagttccaacactaacgttaatatttcaacagtaaatgtcagccagtctattgaacgtaaccttaaaaaagtggatggcgtatctgttacgcctagctcgattgaacacgcaagaaaaaagctaaaagataattctacagatgccatcatcgaatatgatcaagcaaaaaacaaatataatgtgacctatgcgaatactgactcaggaaaaacggtattaacaaaacaggcattgaatgctgcgattacaaaaactaccattagctcattagcaaatggtgttcagcaattacaaacaattgttaaaacgacaaatcctaatataccgattgcaacagctaattctggcaattcaccaacaatcagtaatcattaccaatatggcgatgccgacactggcttcttcgctaaaattgtccctattttgatgggattatttgttttctttttcgtctttttaatctctggaatggccttattaaaagagcggacttctggtactcttgaccgcttgcttgcaacgccggtaaaaagaagcgaaatcgtgtttggctacatgttaggttatgggatcatttcaattattcaatcgactgtaattgtcctagcaactgtttggcttctaaaagtagaagttgtcggaaatgtctttaacgtcattatcattagtgtgctcctagccctcgtcgcccttgctttcggaattttaatgtcaacccttgctaattctgaatttcagatgatgcagtttattccgttagttgttgtgccccaagttttcttctccggtatcattccgctcgactctatggcccactgggttcaatatattggaaagattctccccttaacctatactggagacgctcttacccaaattgtcatgtacggaaagggcttaacgagtcttggcggcgatattttagccttgcttatcttcctcgtcgttctactatggctaaatattattggtcttaaacggtatcgcaaagtataattttattaagaggtgaagcagatgtctcaagttctagcaaattatgaagaacaactcgccaatgctaaaatgcccgcggggaaaaagaaagtccttactactgcattaaagctttttgcaaataatggcttccatgctaccactacggccaaaatcgctaaacaagctggtgttagtgaaggaacaatttataaatatttttcttcaaaggatgatttactagccaagttattgcaacctattttgatggaaattaagaacaacttttttagcaatcttgatgataaaatagacttatcttcattaataagttttattgttactgaccgaattcattttattgaggtaaattttgattttattcgattaatctttcaagaaattctaacaggtcaattaacagataaatcgtatcaagatttctttagtggcaatgatggcgttcttgtcaaactcaaaaaattacaggcaaaatttcctgaaattaatccaaaattaaatccacctcaactcgctcgtatttttattggccctattctcacttatgtcttgcagaataagttattaggcctgccagtaaataacgatgatcttgacattattcaaaaacaaattttagcgaatttaacgcttaaatattaactaaaaaagcatcagaagttgtgacttaacgacttctgatgccttttatgctacaaatcaattatttcattcagtttatacttaaccttcatgttttcccagccatacttaccaaagcgttctttcatctctttaggcgtaaacaacttattgctatcaaatgatgcttcaatcatttaacgatcatgtttaatattttgttgtaattgttgggaattctctttcatctaaaacacctcaatattttttctacttaacatccctgttatattttcacttcaattcttcatatagtggggtaagttgcctaataactgaactgatgtattcctccatattattaacttggtcttttccacgaaatgcaaatttgccaagcaaaaaactggtctttcgtgcatcagaattaaattgctgctgagcatcccgactattgatgtatttagtcagtgacatatgatcagaaaattccatctcatccttatcccaaaggtaccagcgtgtggcatcaatatcattagcccattccggtattttatccagtaattgattgtattcatccggcgtcccttgtcgttgctcactcttataatgttgaaacattaggtagacctgtaactgctttttatcaagcatcaccccaatacaggaattatagtctgctaacgatgctaaacgataagaggcccagtaatgatcacgcaggttccagccgttcgtccaactctcaacgtgaaccttcgcgaattcgcccgttggtagttgactagcgacagtttgatttaccttcttccacacttgccaaacggctttaaacttctcttttaggtctgcaacttcttctggtgaatgattttccttaatcttcttaaaggaaaattctggctggtcaaagattacaaacatactttcagttaatgctgtcattttagctcgcccctttttatccaagaatatcataactaaaaaagctaaactatgactcttaatttacacgaatcataatttagctttatagcttcattaaaacaaattcagcatcaccatataaaagccagttccgaccaagatcgatagtggcatatttcttttccaaaggtgaataaataatgttactaagccggcaacgatttctaataatgccttactaggctcagcaaaagaaatattccgataacaatagattactaatactcccatgattgctgccggaaggaatttccccagttcttccaggtaaggtgataattcttttgactgatcaaaaatcaggaatgggataaagcgggtcgccatcgtgacgactgctgcgattaaaattgaaataatttgttcagttaatgtcattttttctcctcgtgattaagtaatttaatgaaaacagtgcgacaagtgttactaatgtcactaatagaaaaacattcttgttgcaaaatagtaaacaaataattgcaaatgctaaaccaatcagagcatcacgctgagttcgggcatttttcaactgttctgtaaacaacacaataaaaagtgccgtcattacaaaatctaagcctgctaagtttaagttaatcatccccccaaggagtccacctaaacctgccccagctacccaactaaaatagttgaatgcggttatgtaaaaataaacatatgagcgatcaaggctatctggtacttttaacgttgcatttaaggaaaaagactcatcacacattccaaaaataagaatcggctttaactttcctgtattggaatatttttttaacatcgtaatgccataaaaaatatgtcgtgaattaacaagggcagttaaaatgagaacagtcaatggctgaaaactctggactaaaagattaccaattacaaattcgactgatccagcaaaaatggtcgcggccattaataacggatataaaaaattaaagcccagtttatgcatatatatcccatagccggcgcctaaaaatagaaagccaagcattaccggactagttttttgaaaagcgtaacgtacttcctttctcatggacgaattctccctccttaaaataacttgaacttattttaaacaggagtattttatccatacaaggaattaattgtatggattacaatattggagtgataaagtatgcctattaatgatttttcccaccatcagcttacctggtatcctgacaaaaataagctgacgcgaccaatttataaaagtttgctcaatcaactaaaaacagcaattgagcgtggaattcttacacccggaacgaaactgcccccgcaacgcgaactcgccgattatctcgacattaatttcaccaccgttactcgtacttacaaattaagtgcgcaacttggtttaacttatggaattcatggtaaaggaacctttgttaactcaaatggtatcgatccgttaactgccaattctcctttgacccgtaccattgatcttggctttgttgcttcctttgaacagacaaaccacctccttgacaatattcttagcaacaccgtcaagcaaggcgcctcgcaacttctaacctatgactcaccaaccgggcgtccgattgataaggaggctttccagcattatcttgactggcttggcgtgagattaactcctactcagcatatccttattacagcgggaggagaaaactcacttacattactgttaatgaccttattttcaggtggcgataagattgctgtcgacgaatttacctatgccaacctgattgcaaccgcgcaactaaataatctccatttagttgcgataaaaaatgatcaaggcgggatgaatattgaagcattaaaacacgcttgtcaaaacaacaatctagctggcctgtatctcatgccggaatatagtaacccgactggcgctgttctctcgatggctcgccggaaagaaatcgcaaccattgcgcaagaatacggactgaaaataattgaagatgactacctaagttttcttagtaaactcaatccagaacggccgcccaaaataatggaattactaccagaccagacttgttatgtttgcagtatgtcaaaagttcttgcatcaggactccgtgttggttatctagttttcccggcacagctagcccagcaaattaaaaatggtttcttcaacacaacagtcaaaacgtcaactctcaatacagcaattgcatccacggcaataaaagagcatatcgtccaacaaataattcaaaataaagtcaaccttgccaaacaagctaatatcctttttgaacaatatttcccgactgctcctacaaaccaattaaccgactatgccttttttcgtcgattaccgcttaaaagtattcaaaatacagccaagatcgaacaagcccttgctaatataaatatccgttgttttggctctgatcgttttcaaattaacgcttcttcaaatgaccattttctccgtgtttcattgtccgcaaataagtcacttgatgagttagaaacaggcctaaaaagattacgcgagtttttacagaaagctaatttaatttaaaaagtgatgttaagaatttttcctagcatcacctttacttttttgtttagcttattttctaaccgcctcgtaaatcatcccatttcactacataactctcttccctgccatccaagtttcattcacgtggatatttttaagttcactatgagcaactgtaaagatatcatcatttaagataacaaagtccgcggcctttcctacttcaagcgtaccattttcatcaaagccaccaatttttgcaccatcccgagtataaccaagaatagcttgtggaaccgtaattgcttcttctgcgttaacaacatcacaattagcggcctttcttgttacagccgcataaatactataaaacgggctatcaggttctgcccatggcgtacatggggcatccgaactcaagcctaacattgcttgagaattcaacattgttttaacgcggtaagctaatttaaactgggctggtgaaagataatgacgataggattcatcttccgcaaagaaaaagattggttgcgtgactaacgcatagttcattttactattggcaatctctgcaaacatttgatcagtcattaaggatgcatgttcaatacgaaccgatggcattgtggttagccatggcgctatctcttttgttacatcaatcactgtttgaattgctttatcgcccatcgcatgcacagctagttgaagcttattatcacgcgccatctttactgctcgctgaagtttttccactaaagtcaaactaactcccatttttcccgatggataaggatcagtattataggccgtttcgccagaaatactcccatccataaatactttaattccagcaacgcggagtttttcatccccgcttggttgcagtccaacctgcggatcaatttcatcaaagacatagtagatcgaggctttcggaccaaacccttgcttaactgcatcttggtatagttttaaagaagtatatggcttcatccggcccatcatttcaccaattgccacaattccctctttaagatagtgttcggaactattaaccatattagctacgtcgttctcatagctctgtgccgatttagcccgaataagaagttgtgaggcagctatttcgcgcataaaaccagttggtcgtccatcagcaaatcgttcaattttcccaccaaccggatcaggcgtattttcatcaattcctgaaagctctaaggctttagaattgccgacagaagagtgacagtcagaacgataaataaagattggttgcgttgttgaaacagcatctaaatcatcacggttaggactccgatgttctgctaattttgtctcatcaaccccccacccttcaatcggtactgtaccctgtcaagtttacatactaaataataaaaattaattggctttgccgtaacgaaattccgttgcagtaaggtcatttcttttagctgaaataaatgtatttgtaaagtattcaattccttcagccactagtgtttgaagttcatcaagtgtttgtgacttagatgaatgcgctagccaaattgctttaaagtcggcccaccagtgctcgataactgcgttatctgctggtgtgccaggagctgaatagctatgttgactattattgctagttaaatattgattgaacgccttagaagtataagcagctccgcgatcagtatgaataagtggggctaatacaccttcttgtttctgagctttcttgaatacttgaattgctccctcgctagtttctgttggggtaattagccagctaattggaaattgaccatataaatcaagaaccacatgtaaacgaactttataattatgaatattgtaggcgagttctgttgtatcagttacccaaacctgattagctgcttcctgtttaaattgacgattaagtatattttcagcttgataggtttgacgttccttgtcgcgttttcttttagcttgacgatagtcagctttaatcccatgttccttcataattctaataactcgttttttgttgaccaaatatccaagacctgcgcgcttaataagacgagtcattttcccatagccaatactttgcttattagttttctcaatttctttaatcacgcggtttgtaaaattaagttagaaaaataaaaagccatttgtggtagacttttgaatacccatacatcaaaagaaaggacaccacaaatgacctaccatcatcttaccatagacgaactaacgatgatcgctaattttcgtgaccaaggagtaaaagcctaccgggccgccaaacttttgcaccggagcttagaaaccgtctaccgagtttatcgctttctggccgccggccacacgctccaagaatattaccaacactatcgtgaaaacaaggctcattgcggtcggaaggctattcaattgcccactgatgaggtaacttatatcaaagccaaagtggctcaaggctagacgccagacacaattatgggacgcgctgaacggccactcagctgtagtatgcggacactttaccgccttttcgagcggggcaattttgatgtgcggaccttgccgatgaaaggcaagcgtcgccccaatggttacgtagaatggcgggggaaggccggtcaacttggccaaagcattcaccaacgggctatcgactttcccaactttaaccgtgaattcggccaccttgaagccgacaccgtccagggcaaaggacatcagggcgccgttatgactttggtagaacggacttccaaagtcgaagtgattcttaacgtccatagtaagacggccaccagtgtgatccagcacttacaggaatggttggcaaagtttccaccccacttcttcaagtcgattaccttcgacaatgggaaggagttcgctgactggcgagcaattgccaaccaatttgacctccagacctactttgccgaggtgggggcacctaaccaacgggggttaaacgagaacaacaacggccttctgcggcgcgatgggctccacaaaggccgcgatctccgccacctagctgatgaagaggttgctcaaataatgagttaccggaacaacattcctcgcaagtcattgggctatcaaacaccttacgaggtattcatgaagtatgtcactgatgagcaactactttttttctaacttaaattgacatttcgggataaaaaagaggttagagcttaaaattgctcaacctcgtaaagtttgttactcattaaaatgcctgctcatcatataaagggatcgcatttgaccatttatttcagaaatctgtggtaatttacctcattctttgtacccacaggaggtaaaaagatgatagcttgcttgattttcaatataaatatatgcaattacggttcttatatctagatgatcttcaatttgtttttgcgcatatattaataaatcacggccaagatgttgctgtcgataatcttcataaatataaatagctatctgtgccgaatgatcataggcgagatgcggataaaaatactcaagagcacaccaggcgattacttggtcatccattgttgcaacccagattggatgagtattgtcaaactgcataaatcattcacgtcgatcagcaacttcgatcggtgcactctcatcgttgacttgcagcggaattgcttgattaaatatatcgacaatcgctggtagatcatttattgttgctaacctaatttggtaatccatatcaaagcttccttacagtatttttacccactaattattacttatcatagaagtgctgccattctttattaacgttttcgcgagtcgtctttgtcccagtccatgatggaacttttacaaccccatcaatcttactcttaggtacaaatccccagtaacgaccatcgtttgaaacgctccggtgatccccaagaacaaagtattcacctttcggaacttttgtggcaccattattctttaaccaactgttctgaactgagatactacgcagtgtccagtttccagttccggttgttcgttgactcttgctaatgtagtcttgattaatctttttgccgttaacataaatgtttccattcttagagctaacagtatcaccagggagtccaattactcgcttaacataatcggttttaactgatacttgcggatcaatgccattagcatcaaatacaacgacacttccatgatggattttggcagttttcaaacaaaatactcgttcattattttgtaagtttggttgcatggatggtccatcaacccgaacaatttggaagaaaaactgcttaattactaatgcgattattaacccgattagaatgggaataatccaactcattgcttcacgaaatgctttcattataattcctcaatttctttatttaactgttattaatcatacaactagtaataaaacctgaaaagttatttataataaataatatattattttcacatttaataacatcaaaaagatattaaggttcaaagggagcgagacaaaaggcacttgtgacttcgttttcgagccccgcaagcaacaataggcctctaaggttcggttttgccggacgttagaggcctattgttgtactgcgtatttgctttttatgaaagtaacttaacttatgtcacagtcccttttaatttttatttcttttcgacaaagtacttttcgaagttcttttgatagttatgattaatccgttgttccattaaccaccgcatgaaattcatgtccttgtcataatggaaagttgttccatagcggccttctttaataagcttctcagcctgctttttaatttcattatttttagcatactgaaggaaggtcttttttgaaacccccagccataacttatagttgctttcatctttgtttccataaatcgtctcttgatcttttaagctatcaaaaacgtaatcttcaacggggaaagtagcaagttgatagccatttaatgaaacgaagaaactactacgaccttggcgaggattgaggtcaaataccttgaattggccatcacgacggtcatatttcaaatcaaagttaacaaatccagtaaattcaatactttcaaggaaattcttgatattgtcatagatttgttgatcatatgctggcataatcgcaacgtaattaccaacatttgctggattgcaatcttcaagtagcgggtgaccgagacacatcatctttaccttatgatctttatcaacgtaacaattgatggtccgcatattactatcatcaccagggataaattcttgtaaaacgaggtcgccattgtatggactatgctcatagataatctcaagaacttccgctaatctttctggtgtcttaataatataagccttttcatacccttcaaagtttcccttatgccattgcaccgcatcagcagccttcaaagcaattggaaattcaaatggtgatttatagttcttataatcaaggtctggttttaaaatatcggttttagggtaaggcaaaccatacttttcgcagacattgtagaacttctctttatccgttaatgttgctacttcatcataatcagcatacgggcagaacatgtgctgcgaaagttctttacgatttttcgcaactaattcagtatagtcatctccacaactaattaaaacggtcttcttgccttgcttagcaaactcatctgccgctttaattaataccttcgtaaacaattccggtgattgtaattgttcattataatgcaactcgacaatttttgaataacgggttggtgccaatggttggcgagcatataattgcgacttaatcccatatttttcatacatcgaccgcgccattccgtaagcattgaaatcactacctagaatcaatggaacaaaaggttgttcactcattagattcccactcctctttatctttctaaatcattaatataatcacgtgcaatcttcacatcagttaggtaagggacatcttcaccattaatcttctggtaaggatcttcacccttccctgcaaggactacaatatcatcatttccactaccgtcaattgcctttttgatcgccgtttcgcggtccatttcaaattgaatatgtttaaccttatcatgatcaatataagaatctatttcccgggcaatagtcatcggatcttcaaacccgggatcatcagtcgtcaaaattacctcatctggttgttcttcagttaaagcttttccaaaccctggacggcgcgaaatgcctttatcaccggttgctcctaagacaactgttactttaccagcattagtttgtcgttttaagaatgccaagagtcgcttcaagctagcgtaattatgggcataatcaacataaattgttccatgagtattactgttaatcatttccattcgaccacggatgtgaacatgattcaatgtttctacagcatcgttagcactcgccccagctaacccactggcaatgattgcagcgaccgcatttccttcattataatctccagggacactcgttttataacggccatctaagttcaactgctttgctttctcagttaaggcggtcaactcaaattcactttcatgaagatcttctaaatcatttcgatattcaaaatctatttgggcattgtcaggtaattcgatgtttgctcctcgccgtgcaaataagaaaatgtcttctggttgtgtggttgccttagcagtgtaataaacatcagtaaacttttcagtttctgcattgattaagcatttagcagaatttactaataattgttccttacagtgaagataatcagcaaaagttgggtgctcatttcgtccgatatgatctggcgagatgtttaagaaaattccaacatcatactttaaaccataaatccggtttttcttgtatgcttgcgatgatacttccattactaagtgcgtcattccattatcaacggcagcgcgcatatcatggaaaaggtctaaggattcaggagtagtcaaatcagatttaaattcatcttccggcttattgcctaaaatccgatcaagcgttgaaaaaagggcaatatgattagcagtactttgggctaaaatatggtcagcaaaataagccgttgttgttttgccttttgttcctgtaattgcaataatgaacaaatcattttgtggatagtcataaaatgctgcccccagtaaagacattgctttttgttcgtcgttcacgataatagctggcaatccttcgccttctggatattctttttcagccacatacgcaatcgcacctttttctttagcggatgctaggtatttaggcaaaaaatttcctttacaaaagaataaagttcctgattttaccttccgtgaatcataggacacgctagttgcggtaaaatcagtcaaattactaacatgatccaataaatggtgctcgcacaataatgctaaagcaggtgtaatatgcaattccatcttgcaaatgactctccttcaatctaatctgccctatattatttcattttttatcataaaaataaataagggttatcaattaacaaaaaaggagacttagaagagtcctacccttcgccagcctcctttaatatttttctatacttctgttgtagccgctttttgtgcgcggtcaattcccgattcatcaggtttgaagttatcaatgaaatataacttataccacgttaagaaggtgtagattgtccaaatcttacgacgaccatccaccttgccttcgaagttatcatcggcaagttttagaagcttttcttgatcaaagaactcttttacgaagtcttgttcaaataattcacgtacttcttggtaatacttcttttctcgaagccatgcacggactggagttgggaagcccatcttaggccgcgtagcccattcttccggtaaatgccgattagcagccatccggaatgcccactttgtatccttatagttaaagaggtacttagttggtgtcgtttcagctactttcattacctctttgtcaagaagtggtacccggatttcaacagagttagccatactcatcttatctgcctttaaacaaatatcgccaggcatgaaacggtgtaagtcaacatattgcttctttgcgacttcatcgatatctttatcttccatcttatcaaaaagtggattaagaatgtcggcaatacttggtccgcaatcaaattctggttgcaagtagtcagcggcttcttcaggactaaagatgtatgcttgaccaataaaagtatcccgtgctggcgctaagttgcgatacatatgctcttggccgtggaagtgtttcccatctaaccacttagcaaacttataccgacgttcacgaggcatcttctttaattgatcagttacccaacggataaatttaactttcgtattaaaaccataatcaatgtatcccgcaaacaattcatcggcaccttcacctgaaagaagggccttgtagccgttatcctttgctaacttgttcaagaagtataaaggaacaacagatgggttagaatcgggttcatctaggtagtattgaatcattgggaatgcgtggaaagcttcttcgttagtcaacttttcatcagtattcttcaagcccatcttagctgctaattcacgtgcttgtttggtctcatcgtaagtactatcaaatccgattgagaacgtattatctggacgcatcaaagccgttactaaacttgaatcaacccctgcggaaaggaatgagccaaccttaattcctttatctgcaaaggtatgtgccttaacagaattcttaacaacttcgtcaatcttgttaacagcttcatcaaacgtctcgtcttctggctcaaagttttcgtcccagtattgggtcatttcaaactgaccgtctttataagtgaagtaatgcccctctggaagacggtaaacacccttaaagaaagtttcttgagtaactgggtattggaatgtcatgtatggtttaagcgcttctttattaagttccttcttaaagttaggatgatcaagaaatgccttaatttcagacccaacaaagaaagtaccgttcattttagcgtaatacaatggtttaattccaaaatggtcacgggcaccgaacatttctttagtcttaaaatcccagataacaaagccaaacattccgcgcagcttgttaacaacatccttgccccattcttcatatccgtgcaagattacttcagtatcggcatgtgtcttaaatgtgtgacccttactgattaattcttcacgtaattcttcaaaattgtaaatttcaccgttgaattcaatggcttttgagctatcttcattaaagattggttgattaccagacttaacatcaataaaactcaagcgccggaagccaagtgctacatcatcatccacatattgaccttccgcatcaggtccccggtgaataatccggtccttcattttttggattaattggtctttaatttgtggtttttcattatcaacaaatgcaacaatcccacacattataaatttcctcttctttctcttaaattcacggatcacaaaatagttatttaaaattcgttattaaaacttgaacctagattataccatataatgccaaacttaagtatattatccatttgctttaagaaaatcataataaaatctggagagcggagtcattactctgtttctccagattttatttcccaggaaattttatttacgatccttcttggaaaacttcccctgacggacgtaaacacttaagattgcaatatcagcggggttaactccactaattcgtgaagcttgggctaaagtttctggacgaatcttttcaagcttttgacgtccttcagttgctagaccatcaatatcaccataatcgatatcatctggaatccgtttagcttccatccgtttcatccgttcaaccttaacttcctctttcttgatgtaaccagcatatttcaattgaatttcaacctgctcaatcacatgacgatcaagttcctgttctggtgctggaatgaattcggccaacgtttgataatcgaagtatggtcgcttcaagaggtcagctgccgcaattccatcttttaagcgattatccccgtgtgcttcaataaattcgttaaccttatcatcgcttggcttgagcttaatttcttctaatcgtttgatttcagctgcgacttggcgcttcttctcttccattttagcaagccgctcatcactaactaggccaacattatgacccatttccattaaccggaaatcagcattatcatgacgtaaaattagccgatattctgcccgacttgtaagtaaacggtaaggttctttcgttccctttgttactaggtcgtcgatcatcacaccaatatatgcatccgaacgcttaaggacaaatggttccttgccttgtgcccgtaatcctgcattaatccctgcaattaatccttgccccgctgcttcttcataacctgaagaaccgtttgtttggcctgcagtatagagattcttaatgatcttggtttccaaggttgggtgaagttggtacggcgcaactacatcgtattcaattgcatatccaggacgcatcatttctgcattttctaaccccttaattgagtgtacaatcttttgttggatttcttctggcattgatgtcgaaattccgtcaaggtaatattcatccgtatcccggccttctggttcaaggaaaacttggtgccgcggtttatcagcaaaacgaacaatcttatcttcaattgaaggacagtagcgtggcccaacacccttgataacaccagagaacattggagcccggctaagattttcccgaataatggcatgggtcccttcatttgtataagttaaccaacaagataattgttcgctaattggaatataggcactatcaggagtatcaaaactaaagtgatgtggttcctcatccccgggttgttcttccgttacactatagtcgattgtctttccattaacccgtggtggcgttcccgtcttaaaacgctcaagatcaaagccaagttcttcaaggttttccgaaagttttaccgctgacttagagttatttggaccagattcatactgtaattcaccaataatgatctttccgcgcgctgcagttccaacagttagtacaaccgtcttagcgtggtaacgagctcctgtattagtaataacacctttgcagacaccatcttcaacaattaactggtcaacagttgcttgacggagagtaaggttaggttcttcctcaattgtctgcttcattgcacggtgataagcatgtttatctgcttgagctcgtaatgcacggacagcgggacccttaccggtatttaacatccgcatttgaacataggtcttatcaatgttatggcccatttcaccaccaagagcatcaatttcgcggaccacgattccttttgccggaccaccaacagaggggttacatggcataaaagcaaccatttcaagattaattgttaccaacaaggtcttatttcccatccgggctgcggcaagggcggcctcgcttccggcatgacccgccccgacaataattacatcgtatgatcccgcttcgtattgaacggcatcagatgtttgcaatgcttctgaactcttcattcttctattccctactttcctaaacagaattgactaaataactggtcaagcaactcatcttggtaactatccccagtaatttcacctaataattcccaacaccgggtcatatcaatttgaaccaggtctaccggcattccatcattaattccttttaagacatcgcttaaagcatcattagcttggtgaagtaagccaatgtgccgagcatttgtaaccattacattattctggttgctttcaatccccttgttgaagaacatgtgaccaatctgttcaccaagttgatccattccttcatgattaacgattgaagtttcaataacagcactcttaccagctagtgatttcaattcctctaaatcaaccttgcgtggaagatccgtcttatttaagatgatgatccgctgcttatccttggttgcttcaagtaattggcgatcctcgtcagttaattcatttgaactatcaatcaagagaagtactaagtcagcggcgcccaaagctttgcgactccgctctaccccgatcttttcaacttggtcatttgtatcgcggattcctgctgtatcaattaacttcaatggcaccccgttgacattgacatattcttcaattacgtcccgggttgtcccagcaacgtttgtaacgatcgccttgtcttcgtgaagcaaggaattcaataagcttgatttaccaacatttggctgcccgatgatagccgttgctaaaccatctcgcaaaatctttccttgcttagctgttttaagaaggccttggattcgttgttgaatgtcctctgctttttcttttaagagtttcgtcgtcatttcttcaacagcatcatattctggataatcaatattaacctctacctgtgccaatacatccaaaatgtcttgtcgcaaattacgaattaaccgcgacaaatcaccatcaagttggtttaatgcaaccttcatcgatttatctgtctttgcacgaattagatccattactgcttctgattgggataaatcgagacgaccatttaagaaggctcgtttagtaaattcacctggttctgccatccgggcgccaaagctcagtaccaattgcagaatacggttagttgctaacaatcccccgtgacagttaatttcaatcacgtcttcacgcgtataagtgtgaggcgcgcgcattactgaaaccatcacttcatcaacttcctggtccgtatcagggtcaacaatatgaccatagttaatggtatgagttgctactttggcgagatcttttcctttgtagatccgttgagcaactttcaccgcatcatccccactaattcggataatggaaattccaccttcaccaaccggtgtcgaaattgctgcaatcgtatcattctcgctatttgccatcgctactttactcctttctaacaaaaaaagtgctagtccatgcatagtaataaaaatatcactaacatggtcaaagcactttcactactttaacgaatattaaatttataaccgctcatattctaagatcattaccagaaattgtcaacaaataagttagtccttaggcgcaatcacgatactccggtaaggttcccgaccgtgggagtatgtttttacgtggtgattattctcaagttcatggtgaatttgtttccgttcgcgggcgggcatcgggtccataaaaactgctttcccacttgcaactacttccatcgccgccttttgcgctaggttgtgaactgcttcttgacgccgttcacgataattggaagtatcaagttcaacatttacttttgccgctccatgataatccatgaatatattactaagctgttccatcgagttgatccggcgaccgtgcttaccgatcacccgtccattttcctcagtttggagattaattttgagatcatgagcttctaaattaataatccgcggttcaacagcaatacctaattccttaaatactgtcgttagatattcaaccaattctttactagttgcttgaacctttttaagattggcctgttgccgccgcttgatttcagtagggtcgagctcatcttcagctaaatttaagcttgcaggcttttgttctggctcttttgccagttgctcatctttttcttccagtgagggcatcgcaatttctttatcttttattactgcatccacttgcgcttggcgtcgtccaattcctagaaaaccgtgccgcggctgttgaagaaccctaaattcaattgtctgattaacagttggcttcaattgtgtacgggccttttcttttgcttcttcaattgttgttccagtaaaaactgccatttttatcccccgtgaatttaattaatttccactctttaaatttattactaaataaaaaggctcgcaacaactttacttgtcacagccttaataacttatttccgccgactttggtaagcgcgacgttttgctttttcaatcttgcgacgttttgctttttcagcccgttgcttttcttcacgttcacgacgaatcttaaatggattctggatgataagcgtttggacaacttggaaggcatttgttactacccagtataaggtaatagctgaagagaatcccaatgccatgaagaataccataatcggcataaaccacgtcattgtagttgtcattgagtttttttcgggcattgaagccatggataaccatgaactaataaatgtaaataatgccgctagaataggcataatgtagtatgggtccgggtgacctaactgaagccacaagaaagttccattccgtaaggctgaggtccgccagattgcttgataaagagcccacataactggtagctgaaccagtaacggaagcatcgaagcccatggattaactcctgcttctttatagagcttctgcgtctccatttgcatcttttgcattgactcgcgatcacgtgatgagtattttttctgaattgcctttaattgaggagcaagttcttgcgtcttcatcatggtctttgtttggtagaacatcaatggcagtaagatgatccggatgatgatcgtaaagataatgatccccattccatatccgccaaagtgctttgataaccaaatgataaattgtgaacagttatagataatgtagtggtcccagataccagtactatgactagtaattggcttattggagcaagcagctaaaaatagggtcaagctcatgattgctcccaagcttaggaatttttttgttttcttattcaaatcctaatcctcacttttttcatctaacaaatgtgctcgctttaaaacgtgcactaggtttttctttgtttctgccattgataaaccatctgccgctgaccgagcaataaccaagaaatcaacatcagaccgtaattgcggtttcacctctaataatgtttgacgaatacgccgcttaacccaattacgatgcacagcatttccaatcttttttccaacagaaataccgacacgaaaatgtttttgtcctggcttttccatttgatatacgacaaatttgtggttggccacggaattatgggtttcaaaaacccgttgaaactcactttccttttttacgcgatatgattttctcatttgtataatccccagccttaatttaagtagatataaaaatagggccgggcatacgacaactttaacgattcaaattgctcgtcaagctgactgccctgccccacacaataaaaaaagccactataaaagtggccgtggttatgcagataatacttttctgcccttttgacgccgacgtgctaataccttacggccgttactggtgctcatgcgcttacggaagccatggacacgtgcacggtgacgcttctttggttgaaacgtgcgcttcatacaattgcacctcctattaaattcgagtggtttggtttctagagtctaaaagacgatctcttcaaacatactttggtagtataacacacttaccgaaattaataaacggcgaatttttatttaaatttttttgattattaacaaaattagcaaaataatccacagcgttgtgtaaattcataatttgtggacaagttatcaacaatgtttttcagagattatccccagattcacacatgttgataaagttatccacaagtggtctttcaggtgttgataactctctattttactgctatatcaatagtatatatcaacacaattctgtggataagtgataatggaatctccttttccccatttttcacagcaatattattaatttacacacagtgttgtgtaaacttttttattattatccacttggttgtggaaaactttcccatgtaatgataaaataccgtttgtaatttaatactttaggaggaaattattttgactgagctcgattctctgtgggaagcgatccaaaattcatttcgtcaggataccactccggttacctttgacactttgattgctccggcaaaagcaatttctctctctcaaaatcaactggaaatcgaggtgcccactccggtgcatcgcgatttttggcgcaaaaatttaaatacacagcttaaagaattcgctcaacatgaattgggacgtaatattgagccgcattatattttagagggagaatttacctatacaaataaaaaaacagaagatgatccaactccttcttttgagatggacactcctcttaatcctcattacaactttggaacattcgttgttggagaaggaaataaaatggcacacgctgcagcatttgccgttgccgaaagtccgggcagcctttacaacccgctctttatttatggaggggttggtttaggaaaaacccacttaatggaagcgatcggtaaccatatgcttcaagttaatccaaattcgcgtgtcaaatatgtgacgagtgaggattttaccaacgattatattaatgctattcgtaataatacgactgaacaattaagagaagaatatcgtaaccttgatctcctattaattgatgatattcaatttttagccaacaaagagggaacacagctagaatttttcaatacttttaatgcccttcatgatcgcaaaaaacaaattgttatgacatctgatcggattccaaatgagattcccgaactgcaagaccggcttgtatcacgtttcagatggggacttactgtcgaaatcactcctcctgacttagagacgagaattgccatcttgcggagtaaagttgaggaagatcatattgatattggaaacgacacccttaattatatcgctggccaaatcgatacaaatattcgtgaactagaaggagccttaacaaaggttcaagcatttgctaatttaagcggtgagcgaatcacgccaagcttagcatctcaagcattaaagggacttcaccgcgtagccaaaaacgaaatatcaatcgctacaattcaaaaacaagtcgctgatttttataatataactcaaggagatatccttggtaaaaagcgagttaaacaaattgttatgcctcgccaaatcgctatgtatctttctcgagaactcaccgattcctcgttgccaaaaatcggcaacgaattcggcggcaaagaccataccaccgttttacatgctatcgacaaaatcgaggcagaactaaaaaaggatactgacttacaaaacgatattacaaaattaaaagctaaactacgatcataagctgtggataagtataataattatcctcaaacttatccacaagttatcaacaggtggataactcgcaataaagatgtttaaatagttttccacagtattaacaggccctactactacgactatattttaaactattaaatatatttatatacttatacaaaaggactgaaacatatgaattttacaattaaccgatctgcattcattagtcaactaaataatgtcttacgtgccatttcatctaaaaccacaattccaattcttactggattaaagatggtcgtaaacgaagacaacattgtgttaactggtagcaattctgacatcactattgaaagtgttattaatgctaatgatgctgagaacgatttaacaattgaagccactggcgctattgtattaccagcccgcttcttcagtgatattgttaaaaagctgccagacaaaaaagtaactattgaagttacaagtggttttcaagcagatattacttccggttcagctaagtttcaaattaatggccaagatgctgaaaactttcctcatttaccagaaattgaaactaacaaatcagtaacccttcctaacgacatccttaaagaagtaattcgtcaaactgttattgcggtatctaagcaagaaagtcgcccaatccttgccggggtgcatatgacgttaaaagatggcgtcctaacagctgttgcaacagatagtcatcgacttgcacaacggaaagtggtcctcgaaaacatcgataacagcatagattttgatgtgattattcctggaaagagcatggaagaactttctggaatgattagcgatgtccatgaagatgtacaaatgcaagtaaccgaaaatcaagtattgtttatttttggtaatactcatttctattcgcgattactagaagggaactatcctgaaacaagccagttaattccacaaactgctgatacaacagttgaactagaagctgggacatttctatcatcaattgagcgtgcttcgcttttatctcatgaaagccgtaatgatgtggttaagttaagtctaaagccatcagaaagtgttgtccgaattagtggtgattctccagatatcggtaccgttgaagaaaaggtagtcacgtctgctcttgatggtaatgatcttgaaatctcgttcaatcctaactacatgaaagatgctttgcgttcttttggtcaggcaacgatcaagatttcatttacttcaccattgcgaccatttaccttggtgccaacagaagatcaagaaaactttgtccacttaattacaccagtacggacattctaagaaaggtcttatataagttttataaaaaagagactacagaacgttttgttttgtaacctcttttttatttgccatagattaaattttattagtattgctagtttatattcagatttttgaccatagagcaaatttaaccgaattttgataaaaaaggctaaaataagttaatgcgctcagaaaggctaataacgcaaaattaaatcaaataatgtggtataataaaattacaaaagtaggtgaaaaaaatggaagaaaagtcagtgttgattgatagtccatttattacactcggccagttactcaaagaagaggggattattcctactggcggagcagctaaatggtttctaaaagaaaatactgtattagtaaatgatgagccagatgatcggcgaggacgcaaattgtatcccgaagataagattcaaattcctgaccaccaattacttgttattaagggtaagtagggataagcatgattctgacggaattgcatttacatcactttcgaaattatcaggatctaaccgttcacttcaaccctggagtgaacgttttaattggtcataatgcacagggtaaaacgaatatgctagaggcaatctatgttctttccctgaccaagagtcatcgaacaagtaatgaccatgaacttattaattggcaagaaaaatcagctctaataagtggcacagtagagaaaagtattggcaagattccacttgaattacaattctcaagtaaaggaaaaaaggcaaaggtaaatcatttagaacaagcgcgattatcacagtatgttggtcaactaaatgcaatattatttgctcctgaggacttgtcgttggtaaaagggtccccagctttacggcgccactttatggatcgagaatttagccagatgagtagcaagtacctctacaatgcaggccaataccgcacactcttacgacaaaaaaacaaatatttaaagcaactaaaatataagcaacaaactgatcgcgtccttttaggagtcctatctgatcagcttgctgcttttggtgcggaagtaattattgcccgtcaacattttttaaagcaccttgaaggatgggcagctgatttacatcaagagatttcactgaataaggaatcattacagcttgaatacgttaatcaattaaaggttaatgatgagactactgctgaagaggcttatcaggccctttttaaattatatcaagactacgaacagcgtgaaattgagcaggggacaacaatttacggcccccatcgtgatgatatccgctttctggtaaatgataaaaatgtacaggcttttggatcgcaaggacaacagcgaacgacagcactatcagtaaagctagcagagattgatttgatgaaagagcaaacaggcgagtatccattattattattggacgatgtgttatcggaactagatacaattcgacaaacacacctgttaacagccattcagaataaagttcaaacatttttgacgacaactagtttgagtgatgttgctcgccagctaattaatgaacccacgatttttgaaattgagcacggcactttgaataaggaggaagtaaagtgagcaacgaacaacaaaaagaaaccaagatggaattggctagcgaatacgatgctagtcaaattcaggttttaaagggattggatgcagttcgaaagcgtcccggaatgtacattggttccacttcagcccagggacttcatcaccttgtttgggaaattgtcgataacggaattgatgaagccttagcaggattctgtgatgaaattaatgttgtagttaatccagataacagtattactgttaaggataatggtcgtggaattccaattgatacgcaaaaagaaactggaaagtcagccttagaaacggtctttactgttctgcacgccggaggaaaatttggcggcggcggatataaggtttctggaggtcttcacggggtaggggcttctgttgtaaatgccttatctactgaattagatgttaaagttgctcgtcaaggtaaacgttactacatggattttgatcatggtcatgttaagtctgcaatgaaggtaattgaagaaggacttccagaaactgagcatggtacaaccgttcactttaagccggatccagaaattttccgtgaaacaacgacttacaatattaaaactttaactgatcgtttaagagagttagctttcttaaataagggacttaaaatcacgatcgaagacttacgagaaacagatcatgaacggaaagaattccattatgaaggtggtattcgtcattatgttgaataccttaatgaagatcaaaatgttttatttgatccaccaatttacgtggaaggtaaagaaaatgatattactgttgaagtttccttacaatatacagattcatatcgtagcaacttactaacttttactaacaatattcatacttatgaaggtggaactcatgagaccggatttaagatggctcttacacgcgttattaatgactacggccacaaagcaggtgttttaaagtcgaatgagaccttatcaggagatgacgtacgggaaggtttaactgctgttgtctccattaagcaccctgatccgcaattcgagggacagactaagactaagttaggaaattcagatgcacgaacagcgactgaccatgtctttgcggcaacatttaaccgattcttattagaacacccagacgaagcgcggcaaattattgaaaaaggtcaactcgcttccaaagcaagagtggctgctaaacgggcacgggaagttactcgtaaaaagagtggtcttgaaattagcaatttgccaggtaagttagctgataacaccagtaaggatcctgaaatttcagaattatttattgtcgaaggggattctgccggtggatcagcaaagcagggacgttctcgactcacccaggcaatccttccaattcgaggaaagatcttgaatgttgaaaaagcaacccttgatcgagttctagctaatgacgaaattcgttctctatttaccgctcttggaacaggttttggggatgactttgatattacaaaggctaattaccataaattgattatcatgactgatgcggatgtcgatggtgcccacattcggacattactgttaaccttgttctaccgctttatgaaaccaatgattacgcatgggtatgtttatattgcccaaccgccgctatatcaagttcggcaaggtaaatttgtaaaatacattgactctgatgaagaactagagcaggttgtaagctcactgcagccaagtcctaagccagttattcagcgttacaaagggctaggtgaaatggatgctgagcaattatgggaaacaacaatggacccagaaaatcggcacctattacgagtaaaactagacgacgcagaacaggctgataagattttcccaatgctaatgggaaccaaggtcggaccacggcgcgactttattgagcaaaatgctaagttcgttgaaaaccttgacctgtaattaactgttgtttactgctaacgcaaaaaaggaggaacgacattggctgaacaagatatgcctaatcggatcacggatgtaaatcttacgagtcagatgaaaaactcattcttggattatgcaatgagtgttattgtttcacgtgcgcttccagacgtccgtgatggattaaaaccggtacaacgccggattctatatggaatgaatgaattaggggttactcccgataagccttacaagaagtcagcccggattgtcggggatgtaatgggtaagttccacccacatggtgactcttcaatttatgaaggacttgtgcggatggctcaagactttagttatcgttacatgcttgttgatggtcacggtaacttcgggtcagttgatggtgatggagcggccgccatgcgttatactgaagcaaagatgagcaaaattgcagttgaaatgcttcgggatatcaataaaaataccgttgatttccatgataactatgatggtactgaaaaagaaccggatgtattaccagctcgttttcctaatttattagttaacggtgcctcagggattgccgtggggatggctactaatattccaacccataatttaggtgaggtgattaatggcctgcatatgttaatgaataaccctgatattacaacggaaggactaatgaaggctattcctggtcccgactttccaactggtggagtagtaatgggtaagtccggtattcgtaaagcttatgaaaccggtcggggaactattattgttcgagcaaaagttgatattgaagaacagaagaatggtaagcaacggatcattgttcacgaaattccatacatggttaataaggcaaagttaattgaacgaattgctgaattagctcggaataaagatattgatggaattactgatgttaacgatgaaactgaccgtgacggaatgcgaatcgtaattgatgttcgtcgtgatgccagtgctgaagttatcttgaataatctttacaagatgaccttgatgcaaacaacttttaacttcaatatgctagcaattgttaatggggctccaaagattttaagcttgaaacaaatcttgcaatattatctggaacaccaggaatcagttgtacggcggcgaacggaatttgaattaaagaaagcccagaatcgtgcgcacattgttgccggattgcggattgctttagaccatattgatgagataattaatattattcgtaattcacaaacaagtgaagtagcgaaaaatgagttgatgaataattatggtttatcagatcgacaggctcaagctatcctcgatatgcggttagttcggttgaccggtctagaacgggaaaagatagaggatgaataccaaaaattaatggcagcaattgctgattacaaggatattcttgctcatcgtgaacggatcaatcaaatcatttatgacgaattgatggaaattcaaaaacgttttggagatgaacggcggactgaacttcaagttggtgatattaccaatattgaagatgaagacttaattgaagaagaagatattatcgttgccttgacccacaatggatacattaaacgtcttccagttgatgaatttaagtctcagcatcgtgggggtcgtggtgttaagggaatgggagttcataaagatgattttattgaacaactaatttctagctcaactcatgatatgttgctcttctttactaattcaggaaaagtatactcaatgaaagggtatgaagttcctgaatatggtcgggctgcgcagggaattccaattattaacctgcttggaattaataataaagagaagattagcgctgttatcaatgtttcacatgaaactaacgatgatgataaatacctcttctttactactaagctaggaacagttaaacggacagcagtaacagagtttaagaatattcgaagtaatggattaaaggcgcttaatctccatgaaaacgatgaattgattgatgtagaagttattagtgaagatcagccaatgattattggtactcataatggatatgctcttagctttaaatcatcagttgttcggtcaatgggacgaagcgcggctggagttcgtgggattcgtttacgagatgaagactacgtaattggcgctgcccctcttaattctgatagcaaggtacttgtaattagtgaaaatggttttggaaagcaaactcctgcttctgaatacccaatcaaaggccggggcggattaggagttaagacagttaatgttactgcaaagaatggcccgctggttggtttaacgactgtcaatggtgatgaagatatcatgttagtgactgaccagggagtaattattcgttttggcattgaaagtgtatcgcaaactggacgatctgcggttggtgttcacttaattaagatggataatggtgcccgtgttgctacgattgcaaaggtggataaagaagtcgatgaggagactgaagaagtaactaataattcctcacaagaagaaaatcaaccaacagaaaattaaaaaaataaagtgagaaagtagatattttacgtatatatagttatagtgaccgcaacatttaggatttcttgttagatgttccttgttttaaatagaattttatgctatattttatgtctgtgagtatacgtaatgacgtctactttccttgttcttctcaaatagcgagaagagccagagtccataaggaggtgtaacattcatggaaacacgcaaatatgaaattacttacatcattcgtcctgatatcgaagaatctgcaaagagcgaattggtagaccgattcgacaagatcttggcggacaatggtgcaactatcgctgactcaaaggattggtcaactcgtcgttttgcttacccaatcgctaagtacactgaaggtacttaccacgtggtaaacttaactactgattcagaccaagctttaaacgaatttgatcgtttagctaagttcagtgatgatatcctacgtcacatgattgttaagcttgatgcttaattaatttgtcaataaagtaaagagaggagaaagatctatgcttaatcgtgcagtcttaactgggcgtttaacaagagatcccgagttgcggtacacaaccagcgggacggctgttgtttcatttacgttagctgttgatcggcaattccgaaaccaaaatggtgatcgtgatgctgactttatcaattgcgttatttggcgtaaatccgctgaaaactttagtaactttacgcataagggttcacttgttggaattgaagggcgtattcaaacccggaattatgaaaaccaacagggtaaccgtgtatatgttaccgaagttgttgtagataactttgcattgttagaacctcgtcaaaatggtggtgtgaaccaatcaggcgttcaacagccatttaacaataaccaacaatcgtttggtgctcaggctccacaatatggcagtcaatcacaacctggaaataatgctcctcaaagtaatccgtcaccaagtatggacaatggtttcgatcccaatcaaaatgctggcaaccagttccctggaagtagtgatgatggtggtcaatccattgatttagctgatgacgaattaccattctaaataaatttttactcagaataggagggtaatttcatggcacaacaacgtcggggcggacgtcgtcgtcgtaaggtcgacttcatcgccgcaaaccacatcgaatacatcgattacaaagacactgatttattacgtcggttcatttctgaacgtggtaagatcttaccacgtcgggttactggtaccagtgctaaaaaccaacgtaagttaactatcgctatcaagcgtgcacggatcatgggtcttttgccattcgttgcagaagactagtttccactagtaatattaattaaagagacctttttataggtctctttaatttttaaatgtgcgcccggcatgggtattagctaggcggtgagagtccgctatgggccgtagtagtcggaaccatgagctgaggacaagggtgtccactgcgaggtggaatctgaaggaagtctaaggcaaagtactgcaccgatgaacaagaagtagctataaggctggaactaactggataagactgcatgacaagttaaagtccaacactactcgaagttactttcagtaaagctaccggtgacatggtacgaaagttaatatccttacccggggagatctggcctacacgtttccgacaagaggaataagtttaatttccacagaaacaagcggtgcagtgatgtagcgttgagtaagccagaagtcagccgaggtcatagtagtctgagtaatcagatgaaggactgaacgacaataacttgtaacttatatcggaggtgtaatcaggtgcgacaatcgcagaaaacagaacaacaagctgaccgcttgtcgaggataggtttggaaaaccgaaagtacacaagggcgcgtagtaccgattatggtgaaggtaaaggtatgagtgtcactatccaagacttagtcttggaccgcaataaccttaatcaggcttatttgcgagttaagagaaataaaggggcagcaggcattgacgatatgacagtcaatgaccttctgccatatctcagagaaaataagacggaattgatcgctagtttgcgtgagggcaagtataaaccagcaccagtcaaacgggtagaaattccgaagcctaatggtggagtaagaaaactcggaataccaacagtggtggaccgaatggttcaacaagctgtggcccaaattcttacacctatctttgagcgtgttttctctgataatagttttggcttccgccctcaccgtggggctcacgacgctattgcaaaagtagtagatctttataatcaaggttatcgaagagttgtcgacttagacctaaaagcctattttgataatgttaatcatgacttgatgattaagtatcttcaacaatatattgatgacccatggacactaaggctcattcgtaagtttctaactagcggagtcttagaccatgggcttttcgctaagagtgaaaaaggaaccccacaaggagggccattgtcaccaatactggcgaatatctatctaaatgagttggataaagagttgactagacgtggtcaccactttgtgcgctatgcggatgattgtaacatttatgttaaaagtcaacgagccggagaacgagtaatgcgaagcattacccagtttcttgaaaagcgattgaaagttaaagtgaacccagataaaaccaaagtcggtagcccgctacggttaaagtttcttggcttttcgttgggtgtagaccacaatggagcctacgcccgtccagcaaaacaatcgcaacaacgagtaaagaaagcattgaggttattaactaaacgtaatcgtggaatatccctgacaagaatgtttgaagaaattcatcgaaaaatgcgtggatggcttcagtactactcaattgggaaactaactgactttattcaacgccttgacaagtggttgagggcccgaataagacagtatatctggaagcaatggaagaagcttaaaactaaggtaactaacttacagaagctggggctgtcccagcgtgatgcatatgtcttcgctagtacccgcaagggctactggcgaactgcacacagtaagaccttgagctattctctaactaatagaaaactggaacaactcggacttatgaatatgtccaagacgctccagtcaattcaatgtgattaagttgtcgaaccgccgtatacggaaccgtacgtacggtggtgtgagaggtcgataattgaactaatcaattatctcctactcgattatagaaaaggagtgactctaagatgaaactaaataaatatattgatcatactttactaagtcccgaagcaacagaagcacaagtagaaaaagttattaagcaagcaattgataatcattttcatactgttatgattaatccatactgggttgctaaaactcataaagcattagaagaaactgatgtagtaacagcaactgttattggttttcctcttggagccactacaactgcaacaaaagtttttgaaactgagtaagcgattaaagatggtgttgatgaagtcgatatggttatgaatatcggcgaaatgaaaggcaaaaattatgctaaagtagctgatgatattaagacagttgttaaagttgctcataatgccaataaggttgcaaaggtaattattgaaacagctttgctaactgatgatgaaatcactaaggcatctaagattgttgctgatgcaggtgctgactttgtaaaaacatcaacaggtttctcaacccgtggagcagcagttcatgatgctgaattaatgtcagcagctactaaagaaactcccactgaagtaaaggcttctggtggtattcatacaaccgaagaagcagaagcaatgattaatgctggagctacaaagttgggcgttagccatagtatgcaagttattggtaaagaatagaataatgtcgaaaatagttcagcggttggtgaaaatcagcctctgaactattttaatgttattatagattaataataaaacataaatgagggattgcgagtggatagtaagcaacaaattaaacaggccgtccaggttagtaaactttactatttagatggcgttacccaagcagaaatcggaaaaaaactaaatttatcgcgaccaacaatttctcgattacttcaatttgcacgcgagaaaaatattgttaaaatttcaataaatgatccccttagcaatattgaagatctgcagcaccaattaaaagaaaagtatcaactaaaggatgtcattattagtactccagaaagcaatgaaacggctgaaattttatcatctttaggtaaggccacggctcgttaccttgataaaaaagttaaggataatgatgttattggtgttagttggggaaggacactggtcagcgtagcacgtcaattgataccaaatgaccgtaaaaatgttcaggtggtctatttgaaaggaacagtggcgaactctactcataataattatgttgtagaggttactaaatgttttaataaatgctaccatacccaggcgcagattcttccgcttcctttaatttttgaaaataagcaaattaaagagatggtgataaaagataaatttattaacgagattttagatactggtaagcggacaagcgtggcactttttacggtagaaacgacggaacaagatgcaacgctatttgaactaggttattttaatgatcagcaaattaaaaccttgcaagagaaagcagccggggaccttgtttctcgctttattgatgaacgcgggaaaatcgttgatgaccagttaaatgatcgcacagttgctattgctttagatgatctaaaacaagctcgggaatcagttcttatcgctggtggaatgaataagttaaaagcaatcaaagcggccttagctggaaaatatgcaaatgtattagtaaccgattcacttgtggctcaacacctattatagttacccattagatgatataatctattgactaagtatttgatgtgatatgatagatttatccaattaataatttaaagctatttttaggaggactagcatgcgaaaaattttcagtcgtgagaactgggagttttattttgaacacccagccgtccgctggaatgtctgctatatagtgcttttaacaatcattgggcttattttagggtttatggataactggattattggactaattgttttagtaatcgcagttattggtggagctattagtattcggcggttaagaaaattattagtcgatgctcatgaatatttaaatgaattaacgtataaagtccaacgtgggcaacaagaagcattactggaaatgcccatgggaatgattatgttaaataagcgtcatgaggttgaatggattaatccatatatggcgcggtattttaatcttgaaattgttgtagggaagccgattgcagatgttgatgtaaaattagcggaattaataaaagatcatgcagatgataagcaaacacaagtagtgacatggcgtgaccatcaatttgaatttttggttcagcatcacggacaggtagtttatttattagatattacaaaatatgaacagattagtgcacaatataaggatgaacaaatcttcattggtaatatttacctagataactatgatgagctgattcaaggaatgagtgattctgatgtctctaatcttcataattacgtaacttcacaaataagcgattgggcagttgctaatcacttattgatgaagatcattgatgatgataactacttgattattggacatcaagcttcattaaaagaacttgaaaaacaaaaattcaagattcttgatgttatccgtgaaaatacatccaagcaaaattcgccagttactcttagcgtaggaattgcttatggcgaaaatgatctgataaaacttgctgatacagcacaaaataaccttgacctcgcgttaggtcgtggtggagaccaagttgttgttcgggctcaagatcaggaggcacgtttctatggtggaaagaccaacccgatggagaaacgaacccgggtacgagcacggatgattagtcaagcattacaagaattaatggctcaatcagaccaattatttgtgatgggccacaccaatccagatatggattcaatcggtgcctgtttggggattcgacggattgcggaaatgaacggtaaagaatgttggattgtgattgatgatgaacatccacactctgatattcaacgtttgatgcatgagattgataattaccagacgattaaggaccatattatttcaccagtcgaagcgttagaaaaagcgacaaataacagtttgttagtaatggttgaccatgctaagcggggaattaccattgctcctgaattatatgataaaatgcaaaacagacttgttatcattgaccaccaccgtcgcggcgaggactttcctgaaaatccattgcttgtttatatcgaaccatatgcttcatcaacttgtgagttaattacggaaatgtttgagtaccaaccacgtgaaggaaaaggacttaacaagcttgaagcaacggcaatgctaacagggattcaggttgatacaaaatcattcaccaagagtgctggtacgcgaacttttgatgcagctagttacttgcgttctgctggtgccgatggtttaatgattcaatcatttatgaaagaaaatccagaaaccttcatgatgcgtaatcatttgatttcaagagcggaaataaatgataaaatagcattatgtacgggtgaagagggacaggtttatgatcctgtcacggctgcccaggctgctgatatgttgctccaaatgagtgggattgaagcttcatttgtaatttttgaacgtgctgataacaagatcggaatttcagcacgctcaatgggaaatgtcaacgtccaggtaatcatggaaaaaatgggtggtggcggtcaccttgcaaatgctgctacacaaatcagtgataaagatattacacaggtcaagcaagagttagttgatattctaactaaacctgataaagagcaagacgatacagaggagtgatcataatgaaagttatttttacacaagatgtacgaggccgtggtcaacgtggtcaaattaaggaagttccagatggctatgctcaaaactacttaattaagcgtggattggcaaaacaagctactaaagcggcgatgagccaactaaagggtcaacagcgtgctgaagaaaaacatgctgctgaagaattagctgatgccaagcggatgaagaagattcttgaagatgataatacagttgttgaattaagcggaaaagccggtacagatggccggatgtttggttcaatttcaacaaaacaaattgcaactgctttacaaaaacaatttgaccttaaaattgataagcgaaagattgagctggcggctccaattaaggcgcttggctacgtaaatgtgccaatcaaacttcatccagaagtcgaagctcaaattcgtgttcacattgctgaaaagtaatgaggattaatagatttaaggagcggtatcgtcatggataatgcaccagtgcaagaagagccacgcgatattgaagcagaaaaagcagttcttggagctgcttttttaagtaaaaacgcgttggctgatgcgatggaatatcttgagccgcaagatttttatcggaaggctcaccaaattatttttgaaaagatggtccaactaaatgatgcggaccagccaatcgatccgttaacgatgaaaaatgtccttgatcaggataatcaaacggaaaatattggtggcgttgcttatattgctgaacttgcaacagcggttccgacggctgctaatgttgtctattactcaaagattgttcatgataaggcgatttcacgacggttgatcaatactgcaaccaagattatcaatgatagctatgccggaaatgataaaattgaagatcaacttgaccgggctgagcaagaaattatgtcagtttcggaaaatagtcgtcaaactggttttaaaagtattagtgacgttttacaagagtcaattaatcatgtcagtgagctctctagtcaagattcagagattactggactttcaactggatatgctcaattagatgagatgacgactggcctgcataaagatgagttggtgattattgcggcacgacctgctgttgggaagactgcctttgttttgaatattgctcaaaacgttgcaactagaaccgataatacggtcgcaattttcagtcttgaaatgggtgcggagtctttagcaaaccggatgctttgtgctgaaggaaatattaacgctaaccacttacggaccggacagcttacgcaggatgaatggcaaagtttatttattgcaactggtgccttgagtaacgctagtatctatattgacgatacaccaggaatcaaggtagcagaaattcgggcacgttgtcggcgcttagcaaaggaaaaaggcaacttaggattgatcgtaattgattaccttcagttgattgaagggagtaatcctgataaccggcaacaagaagtttcagaaatttctcgacaactaaagaaactggcaaaggaattagaagttccagttattgccctatcacagttgtcgcggggagttgaacagcgacaagacaagcgcccggttttatctgatattcgtgaatctggatcgattgaacaggatgcagatattgttagtttcctttatcgtgatgactattatgagcacgatgaagattcggaagataataataacccgggaaataatcaggatgacgatggatcaaatgctagtgaagttgaagtcatcattgaaaagaatcgtagtggtccgcgggggacagttaaattattatttgcaaagtcttataataagttcacttcgatttcctatatccctgaagataataattaaaaactaaatttctaagagggcatttcagtaaaaactgaggtagcccttttagtgcgcttaagacattaaaaatgttttaaaaaaaataaacggtatgatagtaattgaggaggcgtaaacaatgaaccgtcaaggcgtagaattaaaatggcttttattcggaatgtttcttggaagtattgggaatagttttgtctggccattaacaacaatttatattcacgatcagttgcatgagtcattaactgtatcgggaatcgttttactcttttattcgggagcaaatgttgtcggaagttatattagcggaatgctatttgaccgagctaacccgcggaaattaatgattggcgggacactgctagcgacaatcgtaatggctattatgattttcttcaatggctggccgatatatggaattcttttaacagttattggattctttaatggctggatcattacaatggttaattcttttgcgactcgttcaggtcgagatggtcgttatgtttttaatatgttgtattttgccaataacttgggaatggtgattggaactactattgtcggcccgctttatcagtatgcagatggcaatgtttcaccaatgtttttgattaccacaatcctttatacaatgttctcacttgttgttatctttttctttaaggatagtcaacaaacagttgcaaagaccgaagatatggaagctgaagaagagaacaagacagttaatattaagatacctcaagctaacttatggattaactggatcttcttcattgccttagttgtaatctggacaatgtatgaacaatgggcaagtaacctatcagttttcatgactgatcaaggaatctcgatgacaaaatatagtcttttgtggacattaaatgggattttaattgttgttttccaattaggaattacttggcttaatcgctgggttaatcggccatatgcgcaagtatttattgggatgtttacaattggtttctcatttgtcttattactttacgctcactcatatagctggtttgttgcggcaatggtcgttctgacaatcggtgaagccactgctctgccaacaatgcctgccattgtaaacagcctttcaccggttgctgttaagggaaagtatcagggaattctgaacgcattttcttctttaggaaaggcaattggtccgctatttggtggattgatgattgaagcgacctcttatcatatcctctttattatttgtgcgatttcaatttttgtaatggaaataatagtagtctttgttattaagataaaacgtgcaaaagcagttgaatattaaagaagtgattagatgttttataataattttgataatgtccatggtgaagaccgttatggaatggtaggaaaaacaggagatccttttagggaagaatgtaaactagggatttcttgttatcagtgccatgaacagccgttagtaattgcggaaagaaattggatggatacgaataatgatgactcgcaacggtatcaaattgtggtagtttgtgagcattgtggtgctgttgatgaatttattgttaatgatggtcgagaacaccaaattggtaaattaaaacatagtaaataccagccaacagaaaagaatattataaataatggagctgtgaactagaattgttcatggttctttttttaaatccgtttttattaaccaaaacttgagagatttgctatgatggtagttaaaatcaaattaaaagcaatgaggtgaatgttgatgaaaaccaagaaatatcgttacacaggaaaagactttgatattaagacggcaccaactaaggtaaaagattctgctgatgatcttaagaagattaaaaagaagatcaagaaaaatgtaaagtcaatcaagaatgcgcaaaagatgatgtatgcgcggcgtcattatggtgttttagtagtatttcaagcaatggacgcggcaggaaaagatagtatgatttcgcatatttttgcgggcgtaaatccagttgggtttaaggtggccaattttaaacaaccaacaggccgcgaattacgtcatgattatctctggagaatcaatcgtgaattgccaatgcgtggtgatattggtgttttcaatcgatcttattatgaggacgttcttgtttcacgcgttcaccctgctttaattttgcaatctaatattccagggattgagtctgttcatgatgttaataataaattctttgatagtcgttatgaagatattcgtcagtacgaaagttatctaacgcggaacggttacttaattgtaaaattcttcctccatgtatcaaaggaagaacagaagaagcgtttcttagcacggattgatacaccagaaaagaattggaagttttctgcagctgatattcgcgaacgtcaatattgggacgattaccaaaaggcatatgaaaaggcgattaatgctaccgccacaaaggaaaatccatggtatgttattccggctgatgataagtggtattcgcgtttaattgtatctgatattttgacaaagaagattaatagtttgccattagcttatcccgaggtttcgccagaacaagaaatgagtttactccaagcacgaaaagaactaatagcagaagataagtaaataaaaaggacgtccgaatgacgtcctttttatttacttggtttaaagatgtacttgtgagtaaagaagtagattgctaatgtagaacaaagtattagaatgttaaagtttttgtcgggtaaggccaaattctttgcgttgaactgttcaccaaattattaatttactcatcgttattagttaaattagattattcattcaaaaaagcagttttcaaatatatgtttaagtttataaatgcccaaaaattgatttttagtatttatatattaacttctaatgataataacccctgaaaatctattttcaagggttattatgttagtattttagtataataacaccaaaaaatagctttttagctttaaggagggaagataaataatgaaatacataccattatctaaatataagtattttattgaagataagacgaatgacccggcagcaattgaaagtgaatatcagagtcgactgaacggatatacaagccagaagacaactctgtttcctcttcttaactatcgcgatggtgcacagacaagtaaatatccaattttctatcttccattaccggaaattcaaaacctggcggatcagcttaggcgtaattctaatatgattaaggatatctctgtaacgcttccccaagttgcgattaatcaatttttgaattcattattactctctgaaattttctacactaatgatattgaaggtgtaaaaacgagtcgtgttgaaattagtactgttattcaggaaaataaccacccaataaatggtgatgatcatatatcaaagaaaaggcttggttcaactataaaaatgtaccagcgcacacaatcaggaaaaaaagttgaaatcaatgttcttcaagactatagaaaaatctatgattccttgttaaaaggcgaacttaatgaagatcgactgcccaatggaaaaatatttcgtgataagcttcctaatagcgaagtgctttcgatcggggatggcattaaaacagttcatcgaccaccaaccacggaaactgcaatcaaggttgcccttacagctttaattgaatatatgaataatgatgatactccttcaatatataaagcccttgtaactcactttttctttgaaaatacccatccatttcttgatggtaacggtcgaatggggcgttatcttttatcgtcatatattactaacaaatttgatcgctttactggcttttctgtggctactgcaattcataataatgttcagcaatactataaggtatttaaggatgccgatagtgcggaaaatagagctgatttaacattttttattcaaaaattattaatgatacttgttagtcagcaggaaaaagtaattaagattttgagtcaatctcgtgaaaagcttgataaagccaatgaaattattagtcagtgggtcaatgaacaccatcatcaattagctgcaacgtctgatagtttgtattgtaatgttctatatcttcttgcacaatcaaagctatttactaaccagttagatttaggaattaaagataatgatattattgaaactttgaagaagagtaatcgccgttatccaatgacaaagactaaggcagccattgaagaactagaagcacttggcgcaattgaaattgtttctaagcgtcctaaacaacatgtaattacaattttataataaaaaaaaagaccaccgattactcggtgatcttttttatatgatgggcagtcaggggatcgaaccctggacccacggattaagagtccgttgctctgccagctgagctaactgcccatgtctttgacaacataaataataatatcaacttccgatcattttcgcaagtgtttttctgaatttatttaataaattttcaaatccatattttaattaggtgtctaactgttataattaacaataaaattaaaattgggagtaattttatgacattaaataaggataaatttgagcaaatgaaccgtttattgcggaactatatgattaacatgaagcatttttatactgaacttgcccctgaattagatataactccacagcaagcacatacgcttttttatatagaaaaacacgctgggcttattcaacgagaattaggtgaccatttccatttacggaatgctagtgttactagtatggtgaaaaatcttgaacgcgacgggtatattatccggaaggcggatcaagagtcagcacgaattaagcgtatttttcttaccaaaaagggtgaagaaaagactaatgaggttaaagaaatatttgataaagcttatttgcagattattagccgcctcgatgaaagagatattgatgcaatagttaaagggatgactaatattaataacaatctaaaaaaataagttaggctcttgacagttaggtatctatgtgtttaaatattcatcatcattaaaagttagatatttaactgttaggaggcttatgctttgagcagaaataaatttagttttcgaagtttctttagtttaataaatcaattacatccgcagtatattaagctttttgtgggaatcttactaggttttatctccacgggtgctaacctatttgttcctcaactagcgcaaaagttaattaataattttaagagtattagtctaacgttggcaattttaacagttgtaatttttatagcaggattaattacaagtgcgttatcagggttattattaggaatttttggtgaaaatattgtttctaaattacggaaacaattatggcaaaaactacttaaaatgcctgtaaaatattttgatgatgttaaaacaggcgaaatcagttcacgattagttaatgatacgtcacaggtgaaggatttgcttgcctcaacattaccaaatgcaatgacatcgcttttacaattcgttggtgcactggttattatgttagcaatggattggcggatgacattgttgatgtttgtggcagttcctttagtgattttagtcatgctaccagtgatgaatcagtcgcgtaagattggtcgggttcggcaagatgaattagcaaaatttgctagtgattccaccgatgtattgggtgaggtccgattagttaagtcttcaaacggtgaagaacatgaactggcaaagggaaatcgtcgtatcgacaatttatatcatgtcggaagaaaagaagcgttgattaactcagtaacgcaaccaattacaaacatgctcatgatgataatgtttcttgggattcttggttacggagcaattcgcgttatgaatggtgcaatgacaatgggcgccttagtttcatttttaatgtatcttttccaaattattagtcctgttgttgtaattagtcagctctttaataatatggcaaagactagcggagccacggaacgtatccaacaaatcttaactgaaccagaagaatttgttgctgataaagatgaaaaagatattgtgagcgcaccgttgaaatttgagaatgttgattttgcatatgaggaaggcaagccagtcttacgagatgttagttttgaaacccaacccaatgcagtggtagcttttgccggtccatctggtggaggaaagtcaactattttctcattaattgaacgattctatcagccaacaggtggaaaaattttgatcggtgaagagaatatcgaaaatgtagacttagccaagtggcgtgaacaaattggtctcgtaagccaagatgctgcggtaatgccaggaactattcgtgataatttaacttatggattacgaagagaagtctcagatgaggaattttgggatgcattgagaatggcttatgcagatggttttgtcagtgaaatggaagatcagttagaaactgaaattggtgaacgagggatcaaactttctgggggacaacggcaacgaatagcgattgcgcgagcttttctccgcgatccaaaaatcttaatgcttgatgaagctactgctagcttggatgctgaatcggaggcaatggttcaaaaagcattgggagacttaatgcaaggaagaacgacactagtaattgcgcatcgcttaagtacgattgtcgatgccgataaaatctactttatcgaaaatggaacagtatccggcgcaggaacccatcaagaattattaaagacaacaccactatatgcacagtatgttaaggatcagtttaaataaaataaagactgcgaaaagataagattttcgcagcctttattttaagtatgaaaaaagcgactgagataaaatctcaatcgctgtaaacctctgatgggcagtcaggggatcgaaccctggacccacggattaagagtccgttgctctgccagctgagctaactgcccatatcctttaacagaatacttaaacagtttaacctgttattgatcaaatgtcaaatatttttcataagtttttagaaaatatttatgaaacttttccctgtgctataatagaggcactgatatatagcagatttaaagtaattaatcaattaacccaatggagggaatcattgatatggcaaagaaaattttagttgttgatgatgaaaaaccaatttctgatatcatcaaatttaatcttgaaaaagaaggatatgaagttgtcgtagcctatgatggcgaagcagctttagaacaagtagaagcagaaaatcctgatttaattattcttgacctaatgctgccgaagatcgatggacttgaagtggccaagcgggttcgggctaagcataccatgccgattattatggtaactgctaaagattcggaactagataaggtgctggggcttgagcttggggccgatgattatgttactaagccgttctctaaccgcgaactagtagcacgagtaaaggctaatttacgacggcaagcaactctgaaggcaccggcagaagaagaaaataataccgatattcaaattggcgaccttacgattcatcctgaagcctataccgtaactaagcgaggcgaaaatatcaatttaacgcatcgtgagtttgaacttttacactatctagctcaacatattggacaagttattaaccgcgaacatcttcttcagactgtatggggttatgactattttggggatgttcggacagttgatgtgaccgttcgacggcttcgtgaaaagattgaagataacccgagtcacccccaatggttaattacccggcgtggtgttggctattacctagcaaatcctgatcagaattagaggctgaaccattgtgagcagcaagttaaaattttatcaatcgattcgttttaaaatcgctctcgtattcgtgttaattttgatgttaacacttgaatgtgttggggcggtttttgtgcgtcaattagagcatcaaaaccttaatacgtttaagcaaaccattgaattaccgtcttacgttgataattctttagcagagcagctatcacgatcaaatactaaaaaagcaaacaaacaaattaaccaaatcctttcagaagttaataataataatatttctgaaatccgggtggttgatagtaagagtattgtgcggggaacaagcaacgctgataatcggagtgcaatcggtcagaaaacaacggaccaagcaatcaaagcaaccttattaaataataggtcgcataccgaaaatttatacgataattcaaatcacacgcgctactatgtcaatgttattccccttgtggataatagtaacaataacgttgtgggagctgtttacctgcgagctagtctagaaagtgtctacgctaatattaataatattactttggtatatctatctgcggcgatgattactattgtcttgagtttgatcttggcaattattatttcccaggaaattacccgcccaattgaagaaatgaggaaacaaacattacgaattgcccggggagactattctggtcaagtaaaagtattgggaaatgacgagttaggacaattagcaggagcagttaataatctttctgtccgggttgaagaggcacaggagtcaagcgattctgaacgacgacggcttgatagcattttatcccatatgtctgatggggttttagccactgatcgtcgagggaatgtgaccattgtaaataatatggcgttacagttactaggtgtcgaaaatgaagatgatttaattggtaagtcaattattgatgtgttggatattcgtcatgactataccgttcggcaactagtaaatggtgaacagcgcgagatgattattgatatgtcaaactctggcaataatttgatcttaaacgcctacttctcaccaattcaacgcgaatctggctttgtcagtgggcttgtctgtgtccttcatgatgtaacgagccagcaaaaagaagaacgcgaacggaagcaattcgtttcaaacgtctcacatgagttgcggactccattaacaagtgttcgaagctatgtcgaagcattaagtgatggtgcttggcaggataaagaaattgcccctaagttcttaaaggttgttcaggatgagacagaccggatgattcggatgatcaatgacctgttgagtctatcacggatggatgcagggacaacgaagctcaatctggaatacgtaaatatcaatgagttatttaactatatcttggatcgtttcgatatgattattaaaaaagaagaagatccaaaaaagaaaaaatataccattgaacgatactttactaagaaagatttatgggttgaaattgataccgataagtttacccaggtaattgataatattatgaataacgcgattaagtattctccagatggtggtgtaattacaacccgcttactggagacgcataatcatgttattttaagtatttctgaccaaggtttagggattccacgaaaagatcttggacgtatctttgatcgcttcttccgcgttgataaggcaagaagccggaagcaagggggaacaggtctgggactagctatttccaaggaagttatcaatatgcttggtggacaaatttgggttgatagtgtagaaggcaagggttcaacattctatatttccttgccatatgtaccttatgaggaggaagactgggatgatgaagaagctgaaaagtaattggcaagcaatcgccttaacggttgttgtgcttcttagtttattcatttcatggattgtctggaccaacccatttccttttgagggagcacgacacgaaaatttcaataataaccaatcacaacaatatacaccgcaatcaaggggcgatgtttatctcccaactaaagcagttgagacaaatgaaaaaggaactcagaatcaactttatagccctaaagctaatttaattctgagcgtaaaaaaagagttagaggattggaaattaggccggacaaatgttgtcaaacaaaataacagtgatgtttatttgagttatttgcgacggcggaactcgttaatgctgacatatccggatgaggtaccgagctcagtcttcaacgaaacattttcccagtcaattgatactgaccgggttaatcagattaaccatattattatcccgctaaacgggcaacatgagatttacttacttggtgaccaccattatagtgtgtaccgagtacgggtagagcagggaaaatttaaccatattcggcaactcttaaagtcaatggatcgaatcccagttgaccataaaactattaacggagtagcagtaatgatgtatccccggtcctttgagttaccagcattaggatatcaaatcactgcgcaaaacattgatacccttagtgctagtctaatgagtactaaccaacacacaacaattacggcaaatcggaatggcaacgagactacctatacggatggaaccaatcgtcggctgatatttaatcaccaagatggaacgcttaaatacgaaaattaccttagtacggacgatcgggaatcaacaagccagattttcccacacttctataataagttgacgacaattggaattccgcttgataatttgcgctatgatgaggtgagtgagcatggtcgtcggttaaactatcgggcttatgttaatagctttccaattttcaatagtgatggttatggagaagtaacgcttgaatctacaagtagcgggaatgaacgcttctggctaagtctttatagtcttcgagtgccattgccaattgatcaccagatggtcaagcttccatcaagtgcagatgtgattaatcaattacatgcaaccaaccggatgcgtgacatcaaggacttacgtgtcgggtatatttggaaaactgataaagatagtcatgttgtaaagttagtgccaacgtatttcattaagtatcgcggccactgggttgaatataccgagttagaaaagtaggagggttaaagaatgaattttaaacgtattcaatggatctttatccttgcctttttgctttttgatatctttgttggaagttcattaatcttagaaactagatttaccgtttctaatggtcagcaaaatcgccagtcaacagtgttaaaagaaatgcgcaatgactcgattagttatggcgagctttctaataagcagcaaaccggatattatattgctggaaagaaatcctctgatagcggagtcctagagcaagaagccgggaaattacgtaatcaaaattttcgtctttcttcaggaacactaactagtgagtttgataagccaattaaaacaactaaaaataatgagattcggcgtgtcgaccgtctattaaaaaataaaaagatggtaagtttaggaaatcattatcgctataacaaggaattatcggacaaaaatacccttgtttatacgcaaatgctagaaggaaagccgctattttcaaatgatgggcaaattcgttttcggataaactctgactgtgagataacaggttatacgcagacttacttgcaagatgttgaaattctccggcaacggtcaaatacgattagtcagcgccgagcaattacctggttgtataaacataatcaaattcctaataactcccgcattaggtggtcggtgctcagttattctaagctccttaacactactactgatgataaagcagtctatgtgccaacgtggactgttgaaatcaaaactaaaaactcaggagcaattcaacaattacaagttaacgcatttaatagtacagttatgaaggaaacaccagatagtgtgaatacgaactcgttaaataataagtaattgaggaggaactttaagtgacagaaacggatccattacgttatagtatacttgcgagcgggagtactggaaatgtaacttatttggaaacgcgcaaccaccggatcttgattgatgctggtttaagtgggaagcggattgaaaatttaatgaagaagattgatcgatcattaaaggatgtcgatgcgatttttgtaacgcatgaacacagtgatcatacgcatggtgttggtgtcttggcacgtcgctatgggatggatgtttatgccaatgaaggaacctggcaagcaatggccaataaagttggtaaaatcccattagcacaaaagcatattattgcaccaaatactgttaaggacttgggagacatggatattgaaagttttgcggtatctcatgatgctgcgcaaccgcaattttaccaagttcaccacaataataagaccttctgtattattacggatactggttatgtttctgatcgagttgagggaaccatccgaaatgcagatgcctacgtaatggaatgcaatcatgatacagaaatgttgcggatgggtccttattcatggccattaaaacagcggatattaggggatgagggtcacctttccaatgaagaaggtgccgatgcattgatgagtgttgttgggcggcgaaccaaagagattttccttggtcaccgtagtcaacataacaacatgcgttcgctcgcccacttaacagttgcaagtttgatggagcagcatgactttggcgtcgatcatgattttaaattgcaagatgctgaaccagaagaaccaagcaagttaatgacgttataataaagagatcacggtttttatcgactttattcaatgatttttcatatttaaattgtaatttgaagatagtaattctttaacttagtggagggtttaattggtgaataggataaaacaagcttttaaagatcgattgtggctaggcgtaattattgtcggcttatttgctggtcttatcggtggtggaatcgccttaggaattaataacctggtacaacatcatgaagaagtaacaagtacacgagttccagctggctctaataagtctggtggtacgaaggttaataagaataaggctgacttaaacggggaagcgtcccaagcttataagtccgttcaaggagccgttgttagtgttattaataaacaaaaagttcagcaatcaagtgggacgctaggaatttttggttatggcagtagtaacggaagcaacagtgattcttctagtgataataaattagaaaccgctagtgaagggtcaggagttatttataagaagagtggaaattcggcttatgttgtaactaataaccacgttgtcaaaggttcaaacgcactccaagtaattttaagcaatggtaaaaaagttaatgctgatttagttggtgctgattctgcaaccgacttagctgtattgaagattaacgctacaaatgttaagacagttgcatcctttggtaactctaattcgattgttcctggtcaggatgtgctagcaattggttcaccaatgggaagtgaatatgctaatacagtaacaaaagggattatttctgccaaagatcggacattaaaagccgggactgatggaactttgacatcggttatccaaacagatgccgctattaactctggtaattcaggtggtccattaattaatatggcgggtcaagttatcggaattaattcaatgaaacttgcttctgatacacaaggctcttcagttgaaggaattggttttgccattccaagtaatgaagttgtgacaattattaaccagttgattaagaatggtaaaataactcgtccatcactcggaattagtatggtggatcttagtaatgttacttctgatcaacagcaatcagtcttaaaactaccaacaagcgtaaacaaaggggtagtgattatggatgtgaatagtggttcagttgctgatactgctggattgaaaaagtatgatgtcattacaaagcttggtgacactcaagttacagatgcgggttcattaaaggcggccttatataaatacaaagttggacaaaacgctaaagtcacttactaccgtgatggtcaacaacacaccgcaactttgcatttaacaaagagtgctgatacaacatcaactgatgactcacaacaagataataattagtgaattgggagcgagacagaagtcacttttgacttcgtttttcgacgcgaagctagcctctgggagcccccgcaagcaacaataggtctccaacgttcggttttgccggacgttggagaccattgttgtactgtgtatgtgcttttaatgaaagtaacttaacttctgtcttgcttcctttcattaaaagcctcttaattaaaaggggtataatattagttatcaatataaaggatggtgggtaaaatgaataatccacggtttaaatacccagatacaaaggcatttgaatttgtagtacatcgtttagaagaacgcggagtaaacttagacgaacttgcgaagattgtgtatgagacgcaaaaaagttttgaacctgacctaacaataaaagaatgtcagaaatttttgattgatacaatgcataaacgtgaattattaaatagtacaatggtagcccttgagctcgatcggttaaccgaagaaggaaaagtcgatgaacccctagcaagtattatcaaaaatgatgctggtgtatttggggtagatgaaaccctagctttacaaattgctaatatttatggaacaattgggacgacaaactttggttactttgaccgggttaagagtgggattattgccaaatttgaccacgataaggttcatgtaaatacatttattgatgatattctcgcggcgattgtggcggctgtttgtggaaagattgcccaccagtacgcttgattaaaataatctcattgacttttaaataatttatcattaaaataaacataattcgtttagaggagtaaagcaaatgagttatcaaactttacaattaaattatagttggcaaagccggtaactcagggatagctgtagtacagatatgacctgggtttattcacagattatatctgtaccggctgctttatcatgtacaaataaggcctgtacggatttcacgcacgggctttttctatttcactggataaatagtgggatttccgaaacgtggagctcctttttattttgaaaggtggagatagggatgaaacgaattatgggctatattattattggaattgttgtgattggtggttattttggacttttaaggcttcatcaacagaccacaaaaccggtggtagggattttaacgatgatgcatcatccggcattagatcagattcaaaagggggtcgttgccggattagcagaagaaggataccaaaacggaaagaatatcaaaattgaataccagaacgcgaatggtgatcaaggaaacttaaatactatggcaaataaattagtgaatgatcatgcgaaagtaatcgttggtattaccaccccagcttgccaagcacttgctaatgcgaccaaggatattccgattgtgatgggcggaattggtgatccggttggtgccggtttagtaaagaatgaaagatatccagaaggaaacgttacaggagttcatgatgtgaatccgagtgaacagcagattgccttagtaaagaaatttataccaaatattaagaccctaggagtaatttacacatcgagcgatacctcttctgaaagtcagtaccaaacgatggtaaaagcagcgcataaattacatgtaaacttaaaaacttatacaattgcgaatgctaatgaacttaatcagacttcacaaacaatgttgagtaaagtagacgcggttattgttcctagtgacaatacaattgctggatcaatgggagtattggtgaaaaatgcagatgtggtcaataaacctgttttcccgagtgctgatacaatggtaaaagatggtggagtagcttcgattagtcttagccaatacgggcaaggaaaagcagctggaaaaatggcagcacgtattttaaaaggtgaaaaaccaggacagatggcagttaataattaccatcatggaaaaccggttcttaatttaaagcaggcacataagttaggaataaaagttccagcagattttcaacaagaagcagaacaacatggaacagtctttaagtaagataatgggaaaattccgaataataagaaaaattaaagaagataacattcgctaggtaacattccgttgtatatttaccacagattgtgttgtaaatcgttagaaatacgttaaaatgataatgtgaaattgcttgtggataagtcagtggataactaacagtaactttaaagtaattttataaatgttggtatatcaataaaaattattgttcaaaacttatccacaagctgaatatgtgtttgtggataagtggaattctttgtcaacgttctgcaacgacgcttactggcgcaagggatagccaagtcgttgctgaacgattgttcctgtagataactgtggataagtaatttttaagaaaacgcttttttaacaaaaaattaaccgaacattcgggaaaagtaaaaaaatcaacgcaggcctgtggacaactttgtggataaactgtggaaggtagtggatatcttgaatataaaaattattggtgtgggtaagttaaaagaaaagtattttaaagcgggaattgctgaatatgctaaacgacttggacgttattgtaaatttgaaattgttgaggttcctgatgaaaaagcacctgaatctttaagccaagcagaaatggatgaagtaatggcaaaggaaggggaacggattcttgataaaatcaaagatcgcgaatatgtatatgctttagcgattaaaggtaaagaacgttcttctgaagagtttgcaaacgaaatcaataaattaacaacttatggtcacagtgatattacttttgtgatcggcggttcattagggttaagtccagcagtattaaaacgggcagatgcccaaatttcgtttggaggttttaccttgcctcatcaattaatgcgtttagttttaagcgaacaaatttatcgagcttttaccatcatcaatggcctcccatatcataaataaagaatttattgagttttggttagattattatttatcgttgttagcgatggtatagtgtaaatatgaagtgtaatggcataagaattaaaggatttgatttaaaataggcatacgaggttaccaagtaattcttttaggggtaatagcaggaatatgcattttagtgatgcaaggaaaagcaagtgcaatgatagtaaatgaagcacggctgacattgcctaatgaaaaaagaattgagtatgatgaatttgaacggtaccagtttcgggcaaaacagttacgaacttggtggcaagtcaagcgaccaaaatataaaattgattggtcattttatcataagaaacggggatactgggattagctcaggtcctcgtttttcttttaacttttcaaaaaagctattaaaatgaagatattaaaaggaggcaatgataatgaaaaaagttgggattatagtcggcagcgttcgtccaaatcggcggagcatgcaagtagcaaactggttaaaagttcaattaaagaaaagtacaaaggttcaatttgacatcatcgacctaaaagaagttaatttaccgatgatggatgaacctaaaattccttatttgggtttatatgttcacgaaaaaacgcgtaaatggagtgagttagtacaaagctatgatggttttgtgttagtttttccgcaatacaattggggctatccagcagttttgaaaaatgcgattgattacttaggaaaagaatggcaaggaaagccggttagtttagtaacattcggtggacatggcggcttgcaagcacaaattgcaatgaaattggtcgtaaccggcttaaagatggcggcgcttcctgttgatttacaaattaacttgatgccggatgattcaactgcgactgctgatcggaagttgaatacttataatacgcaagcagcgttattaatgactgcttttgaaaatgagttaagctagtttgtgattaaagtagcaaattattgtaggacattaatataaaattggttcaatttgtgaatattatgacaaacatcgtgatattgcagcagattaggcaagattattattacaaattgggcgataatgaacaaaaaatcaaaatgtttctattgcaaaaataaaacgcttgcatgataatggaatcgtattcaaatgccatgaggagggtatttttaatgaatagacaatttgatttcttaatgccaagtgtgaacttctttggtcctggtgttattgccaagattggggatcgtgcaaagatgctcaatatgcacaaaccattgattgttactactgaaggtttatccaagattgacaatggtcctgtaaagcaaaccattgcttcattggaaaaggctggcgttgactatgccgtatttactggcgctgaacctaaccctaagatccggaatgttcaagctggtaaaaagatgtaccaagatgaaaactgtgactcaattattactgttggtgggggttctgctcacgactgtggtaagggtatcggtattgttttaactaacggtgatgacatttccaagcttgccggaattgaaacattgaagaatccacttccaccattgatggctgttaacactactgccggaactggttctgaattaactcgtcacgctgttattactaacgaaaagactcatttgaagtttgttgttgtttcatggcgtaacattccattggtatcattcaacgatccaatgttgatgcttgatattccaaaagacattaccgctgctactggttgtgatgcttttgttcaggctattgaaccatacgtttctgttgaccataacccaattactgatagtcaatgtaaagaagctattcaattaattcaaactgctttaccagaagtagttgctaatggtcacaatattgaagcacggactaagatggttgaagctgaaatgcttgccggaatggccttcaataatgccaacttaggctatgttcacgcaatggctcaccaactcggtggtcaatatgatgctcctcatggtgtttgctgtgccttgctcttgaccactgttgaagaatataacttaatcgcatgtccagagcggtttgctgaattggctaaggtaatgggctttgacactactggtcttaccctttacgaagcagcacaaaagtcaattgacggtatgcgtgaaatgtgccggcttgttggtattccatcatcaatcaaggaaattggtgctaagccagaagactttgaaatgatggccaagaatgccctcaaggatggtaatgccttctctaacccacgtaagggtactgttgaagatattgtaaagctttatcaaaaggcttacgatggcatctactaataattaaataaacacaaagaggctggaaatcagctcagtctctttactgttttacgtattaaactgccagccaaccttacggaggtgggactatgaactagccaagctaattctgtcccctctttttttgtctacttttaattcttaatattttgaatttttttcacaaagttacttgcaagcgtattcttttgaaactataataaaaattattctaagagagaataagaggaaaagagaaaatgatatatttacttgctttaattccagcaattggttggggtgcgatgccattaattactggtaaaattggtggttcaccagttaatcaaatgtttggaatcggtgctggagcttcaattgtgggaattattgcatatttgataacaaaaccaaccgtcagtgtaactgctttttggttctcgctagcgatcggttgtttatggacaattggacaggttggtcagttcatctcgtttaaacatatgggagtttcaaatacgatgcccctttcttcagcatttgtgttagttatgacgtcgtttgtcggcatctttttctttgatgaatggcaaggagccagagcattaagtattgggttgacagcgtgtgtagttgtaattattggggctgttttaacctcgatttcggacggaacatcggataaaaaggtttcgactaagtgggtattatttttattagtaacaacaattggttactgtgcttattcgatttttcctaaaatgccacaggttgctcatgaaagtagtcagggtattttcctaccagaagtattaggaattttacttggttcagtaatttatactatttgttcgggtaacgctaaagcatttaagcaaaaagaacaatacttaaatattttaggaggactttcatgggggattggtaactttgcctatgtttttgttggtaaagctcttggagtagtgactgcttcaatttttggtcaaatgaatgttattatttcaacatttggtggtatcctacttttgcatgaaaccaagaccaagcgagaaatgatatatacagtagttggaattatcctaattgtaattggtagtattttaacagtaattgctaattaattattgaagattttaggtaatatcaataaatgagagaggaaacgcgcaaaatcagctttttaaccgattttacgcgtttttttagtcttatattatttcccaggttatattgtgctatttcttatcaagtagatcaaacctaatttgtccaagttgtaatttttcaggttgtttagccccgtggaaaatcagtttaaataatcgattttcaacgccagccttgaaaacaagttgtttatcgccaatattaattgtataggtgtcaccttcacttactacttctgcctgcaagagggctgaccattgtttagcagcctcttctggatcactaacattaaagattgcttgcttaacaaaaaggtcacctgccggatggaatttaattaagccctgtttcttgaggtcttcccggcgttgatcatcgttgttgccccattgaataaagaatggtgcaggtaaatggttaacaagttcatcattgacatagaaaatcttccattgaataagtttaccggcaggatccacgcgctttccatcagtaatatcaccaacattaagccccagaccctctaatcgctggtgagtttcttcaatattgtcagtccgaatggcaattgttgtgatgcgctgaataccagcaacataatcttcaacggcatcatgaattgctgagttattttcatatgggaatgccttagctttttccttattagcgatggttaagagctcaatgtaattaaggccaaaataatctagtgcattttttgttccccaatattcgtgatgtccaccaggggtaaaggctaaacctttagagttgaagtaatcaattgcatcttgaaggttagttacatcaaccattgtatgatcccaatttaacgtttctgtcattttaatcacccttgttctgtttgcctaattcctttgttcgtttaacagcagcaaggacagcattttcaattcccgctgaaaaagtgcttttatctagttcatgctgggcggtgatacccactccgccagcagaattattaatatcaagtaattcggcagggtgtttaccactttgttctacaaatgcagcggctgcgcgtagattctcaagagcaagtttgtttgcttgttggcgaggcattccggcaagcacacctgcgtttgtaaaactaattagaaagttatagatatagtttggtccagccacgccatatccagtaaatacatctagcaaggattcatcaatgtaatcgacttttccaaaactatttagaaagtcttcaatgacagtttgattagctcgattgtttttaacgacgccgctataacccatggcaacatcagtcaaggtattggggatgatccgtgtaattgcaaaaagatcttcctgtgatgaaagttgtgcaactgttacgccggcaataattgaaagcacgtccttttggtagtggtgggcgacaagttctttcatgatctcttgccagttatcttgtggacgcactcccagaataacaagatcagcattctcaacagccgtccaatcaggttgttgacttgcttgaatatgataagtatcagtcaaataattaactcgattgctcgaaatatctgttatcccagttgtttcaggagtaattacttttttcttcagtgcagcccgcagcattgcttccaccatttgaccaccaccaaatgagtaaatcttaagtgtcattgaaacatcatcctttctatatgtacctaacctaatcgtagcgtatttcaaaccgagacgctaatttaaacacttctttcaaaaaaataaattcacaaattggtctacttgaaattaaattaacaaggaagcgtttgctgtataataaaattgttagttataaatataataaaagggcttttgtttgttaaaaaacaaaattttcaatatgaggtaattggattttgatggagtaatattagttgaattggtctatgaaatagttgtaaaatgtaagcgtttatttaaggaggaaccataatggcatatcaaagtatcaatccatttacgaaccaagtagaaaaaacgtttgaaaatacaactgatgaagaattagaacaaacattgactacggcgcatcaattatatttagattggcggaagtataatgaccttgaagaacggaaacgtcaaattttaaagttaggtcaaatattacgtgaacggcgtgttgaatatgcgacagttatgagtaaggaaatgggaaaactaattagcgaagcagaaggcgaagttgatctttgtgcttctttctgtgattattatgcagcccatgcagatgaatttatgcaaccaaaaatcattgcgacaacgagtggccgcgccaaagttttgaagcaatcattaggaattttagttgcggttgaaccttggaatttcccattttatcaaattgcccgggtatttattcccaactttattgcaggaaaccccatgattttgaaggatgcatcgaattgtccagcatcagcccaagcatttgctgatgccgttaaggaagctggtgcgccagctggcagtttaactaatttattcctttcatatgaccaagtaaataaggcgattgctgataagcgggtagccggtgtttgccttactggttctgaacgtggtggtgcaaccgttgctaaagaggctggtgctaatttgaagaagagcactttggaacttggtggtaatgatgcctttattatcttagacgatgcagattgggaccttgtcgaaaaagttgccccggcagcccgcctgtataatgccggacaagtatgtacatcatcaaaacgttttattgtacttgaaaaggattatgatcgtttcttaaagatgatgaaagatgcgttctcgaaagttaaaatgggtgatccgcttgatccattgacaactcttgctccactatcttctaagaaggctaaggagaagcttcaaaaacaagtagatacagctgtagaaaatggagccaaagtttactatggtaataagctggtagatatggaaggacaattctttatgccaacgatcttaactgatattactccagataacccaatatttgatacggaaatgtttgggccagtagcttcagtttataaggttagttccgaagaggaagcaatcgaattggctaataattcaagctatgggttaggaaacactatctttagcaatgattccgaacatgcagagcgagtagcagcaaagatcgaaactggaatgagttggattaatgcaggctgggcttcattaccagaattaccatttggtggtgttaagaattcaggttatggtcgtgaactcagtagttacggaattgatgaatttactaacaaacatctaatttacgaagcacgacaataaaaattaattaaacgacgcaaataaagggatcgcaagtttggattgcggtccctttagtattacctgggaaattattgaattcttttcaatacaatcttgcaatattgtcttacttcttatatacttagttacataagtgattaactacaaaattgctatttggaggaatattcatatgactgcgaaaagaaacagccatcataaatctcgattacgacaattatttgcaacacgtcgacgtcggtggattggcatcggtggcctaattgtaattataatttttgtattagtttcaattcgacatgcaagtgaggaaaaagcaacagaaaaaaatgaatataatattctacgggttactgagcagtcagattttaatctgacaggaaagattgaaccagtccagatgcaaacattaaccttgccatctggtaacctgcaaaatcttaatgtgaaaaacggagatcacgttgcgcaaggagaagcgctcttaaccatgcataatgatagtacacaagatagtgttactgaactgcagggagatcttagtaaaagtcaacgaacgatgaatgtccaacaacagacgattaataatttacgccaacagttgaatgggatggggcaaggtgatgaagggtacaatgacctgcgcaatcagcttaccgaagcgcaaaatgcatatgcagacgcacaagcaagtgttgctgccactcaacaacagcttagcaccgcttcaagcaaggttaatcaaacattaacagcaccttttgctggttatgttacggttgaccaatcaaagcaaaatgctcctgtaattactctttactcagatacgcttcaatttgtcggtcaagtttcggaatatgattatagtaaacttcatcaaagtgctgatctaaaggtgaaggccttagcaacaaaccgaactgctaatactcaggtaagttatctttcaacaattccaactaaaaatagtggaaataataccaaatatgaagtaactgctaatgttagtgctaataaatttatggcggggcaaacagcaaaagcttctattaaacaagatggagttcaaattcccaaatcggcagttcgtcatgggaaggtatttgttgttgattcagacaatcgagttcgcgagacagatgttagtggccgggcagtcaacagctcttatgttgtgacagacggtgttgatgctggtgatcggattgtgactaaccctaacagtaagttgaaaaataatgcaaaggttgattaatatgatcaagctaaagaacattaataaatattaccgtcaaggtagccaacgttttcatgttctccatgatattaatgttgacattgagcaaggagaattagtagcaattatcggtgaatctgggtcaggaaaatcaaccttgattaatattgtaggctttcttgatgatgattttgagggaacatacttctaccaaaatcacccaatccatgattattcgcgaaagcaattttcaaatttacgaaatcaaaatgtcggtttcgtttttcaaaatttcaaactgctacgtggatcaaccgttgcagataatgttggattacccttgctatatgcaggaaaacgacgtcgtgaaattggcgaacgtgtttctgaagtcttagagcaagttggtttagccggatatgaaagtcaatttcctaaaaatatgtctggtggacaacaacaaagagtatctattgcccgggcaatatcaacgaacccgaaatttttaattgctgacgaaccaacgggagcactcgatacagaaacaagtcaagaaattatgaatctttttaagcgattgaatcatgaagaaggaacaacgattattatggttacccatgatccccatgtcgctgaacaatgtgaccgagtaattaaaattattgatggtcgaattgtaagtgacagtaaaggcggtgaatatcatgcagacaattgagttgatcaaatcagctatccagtcattaaaggcgaataaaaagcggagtttcctaacgattatcggaattatgattggtattgctgcagttattgctatccttggaattggggacgggattacgaaaacgatgtatgataagttcggtaataatgctaagcaaggccagcaaacaaccgaaatcgtctataatcctgataatgttaattcgactgtcaatggattcacgcaggaacaagttgctgatattaatactcaatttggtggtgaaattaaaaaggctgagattgagcaggaatcagataatctttcaacacatgcagatattggtgatgcgactaaatcagtgacattaagcttattaaaggaaccaacccatacggtaaaactgattgcgggtcacaactttggtaaacgaacttttgaactaggggaagctaatgtcctaatgagtgaaaaagtagctaaacggcagtatggttcagcacaaaatgcgcttggcacaactgtaacaattaataatgtcacttataaagttacgggagtatataagacacaggcacaattcactgatgatgggaaccaaaactcatacggagttgatttattattaccgaagaaagtttactatcaaggagatagtgctaaagaaggaaatacgcttaaattaacctttagccagggtgtaaatgccagtgctatttcccgcagagtcgcaaagtacttaaaaaataatagttcagcagcgactcaaggaacctatcagtacctagacatggaaaaagcccttaagcaattctcttctcaaatgagtattattactactttcattagttttattgcggcgatttctcttttcattgccggaattggggtaatgaacatgatgtatatttcagtttctgagcggacgcaagaaatcggaattcacttagctgtgggggccacaccatttaacatcatgatgcaattcttagtggaagcagtaattcttaccatgacaggtggattattaggctttttaggcggcgcaggattggcgcacttactagcaccgcttttatcaagtgcgattggtggtggcggcattcatattcacgcccatatttcacttaatgctttcttgttggcatttggaacatcggcagctgttggtttgatttttgggatcttgccggcacgccaagcagctaataagaatttgatcgatatcttgagataagaaaatcctcagttttttgctgaggattttttacgaattctgcagaatgtaaaaaatatcaaattattgagtataataaaaagataaattaaagtgaaatattaggagataggaaaagatgagtaaaaacaggggtaaattaacggttgtttcattactagttgtaattattgtggtatgtgggggatatatgctattacatccatcctcatcaaagaaagttgctagtgaaaaagctactaagaccgagacaatcacaagcagcagttcatctaaagaacataaagcagctacagaagatagttcagataaagttaaggatgatgattctgatgattcgtcttcagtagctgatactaatgatagtgaggcaacttctgcatctgccacagtaagcagtggtaatcaaacagcccaacctgcacaaagtcaaaatacaacccaagcaacggcggtaagtaattctggtcaaactgctagtcctaaagctaccacgaataactataagggaaactgcagtgtcgccaacacaaataaccggtggacaggaagccgaaagacaacccaagctgcatcaactcaacaacctgtaacagtggaagatgggatgaactttagctaccgggctgcgcaaaaagctggcgtgattgataataatacatctgttgaagagttttacaaaaatgccaaggaaggtaatggctctgtaacctacaacggtcaaactatttactacaaagctaagggtaataatcaatatcaagttacaaccgctaaatagtttgattactaaaaaagtgtccggcattttgtccagacacttttttagtaaaaatactatgaaaaatgtaaaatatactaattgtttgcgctttagtatataatgaatatgtttattaagtgatcattcagtatagaaatatacttaaaggtttggatgttattggagtacttttatgcaaaaactatctattaaacaactaataataattacattgtgcttattagtgctggtggttggctgcatgactattcaccagcgtcgtcattttaataagaacgttaagatcgataatgtggcagttggtggattgactgctaagcaagcattaaagaagttacaagataatccacaatcgccaaaaatttatgttaacaatgaattagtatttaaggataagcaatcagtagcaaagtttagtagtgctgacaaacaaaaaattaaaaatgcattacatagtcagtatactttcttcccatcatctaaggcaaagaacattgcgattaagcctcaaaatgttaatcaagatgaagtatcaaagattgatcaagcagtcagtcaaaaggtaacagaactaaataatggtcgaaaagctcctgttgatgcttacgcggtatacgaaaatggccgagtacaagtaaaaccagcagttggtggtactcaatacagtttagatggtttgcataataaagttgaaaatgaaattgctgggggaacagttcatctgaagccaaaatatacgactccactttctgcaaatagtaaaactgttcagaatgaaaaagcaaagctcgaagaattatcaaaacgaactgtaacataccaagtccaaaacaaaaaatatcaattaaattgtggtgagattattaccagagcaacctatcaaaacggaaaataccactttgacactggagcagctgattcaaagattaatgaaattaataatacccaagcaactcttggcaaatcatttgaattcaaaacccatgatggatcagtgatcaaaacaacagatgctggctcatatgggtggaaaatcagtaagaaacaagctggaaagactcttacgaatgcattggttgcaaataagcaaacagtaaacgccaaaaatgatatctatggtaaaggatataatcaacaaggaactgggtataatactacaagcaacaatggtataggggacacatacgccgaagtttcactagccgaccaacatgcctggttttataaagatggtaagtgtgttcttagtactgatattgttagtgggacgaataataaggataatgaaactcctaagggtgtctggtatatcatgtaccagcaaacaccgtctgtccttcgaggccttaacgatgatggttcgaaatatgcaagtaaggtccaatattggtcaccatttactgatagtggatgtggatttcatgatgcaagctggcgtcatgactggtcaaaacaggcttatcttgctaaaggtggtggatcgcatggatgtatcaacatgcatccagatgttgctggtcaagcctttcatgacttacagaaaaatgagcctgtaattatctactaaaggagaatttattatgcgcccaagtgctgaacgctcaataatgattgcggttatttgtttcatattaacaattattatttcattcgccatgtctgagggatggataaagtagggatttaacgatggatttagaaaagaagaaaaatttggtaattattaatctattttatgtaggattaattttgatttactgtattttacatgcaggaccactgaatttaatggtgtttttgggtatgttagtggttgcaaatttaatggggatgttaattaaataatggtttagaaaatgattgatttaactttaccacaagcattcgtttcgggctttttaaatgtttttgaactaattattatttggtggattatagaatgaagttagccacccagttggtggtaaataaaaaacgccattcggcgtgacatcaggtatcatattaagtgaaccaaacctatatgaaaggatgtccgtcaaatgacgcacttaaatgataccatgtctactagtttattgactactcataaaaagaatgctcatcttactaaagaagaacgtgtgatgattgcgactttaaagtcgcaaggactttccaatcgcgcaattggtcgccaattaggagttaatcatcaaacaattaataacgagctcaaccgtggtacggtccgccaacttcgtcgtcaaaaatctaatggtaagatttacgaatattcttactacatctatagttatgaagctggtcaggccacatatcttgaacatcaccgccattctggtcgtcgtcgcttatattattcttcaaagcaatttttacgattagctgatcagctaatgcttggtgagtttgacgaccaccattactccccacaagcggttatttataaggctcgagatttaatgaatgatggcaccctgatcccaaagtcggttgtaactttatatcaatggattaatgagggtgtgcttcgtacgtccaatttagacctctttgaaaagcctaaacgtaagcatcatcgaactcatccgcaagctaaaaggtgcttaggtcctaatattgctcaacgacctcaaactgcggaccaacggtccgaaattggccattgggaactagatacagttcagggacagaaaaacggtaatgacagtgttgtactagtaatgactgatcgcctttcacgagttaatatcacgagtaaaattgctggtaaaactgcgcatgcagtaaatcagttctttataaatttacgccagaaaatgggcacagatgcttactatcgcatctttaagacaataacctctgacaacggttcagaatttagtgagttaacacaagttcacgatcatgttttctatgctgatccgtattccccttgggaacgtggatccaatgagatcaataaccggtttctccgcaaggagattaccaaaggtgaagctataaataactatagtagtgctcagatcatagcgactaatgattggatgaatcactatccacgagctatgtttaatggacattcgtcaatggatatctatcgtaaggccttctaccaagagatatcacagctccatcaaccaataatcaattggtcagtattatttatttgagtccagtggctaacttattcttgaaatttaggctaattattatttatagactagtgacgggttatttgaacaggaaaattattttagttgatttccttgcaagcttagttattatttgcgttcctgttctagaaggttcattagagtttccattaataatgatatatttatggctgtttgataggaaacatgatcgtcagcaaattatatataataaacccgtggtgctagttaattttttcctagaggaaaatgtctaaacatgttggtaaattaacaaaaaaatcttatttttatggtcttaaaattcatgtgatcgttactaagactggctttccgattacttactcaatcacgaatccaggtgtccatgacgtgaaagtgttagagactttatcggaagaagcgaatcttcccaatatcctaggggacaaaggatatattagccataaaatccatgaaaagcttgcccttaagggcattactatatccgttccgccacgtaaaaacatggataaatcagaaaaactagaccatagcttacttggaaaacaaagaaaaattaggttgtcaaaatttcaactcacattctgttaaagggctagagagtagatttgaaagcatattgctggcttacagtgttctattaagtcgagcacaacgacgttttgaaggaactttgagatattctttaggatattaaaattaactagcaccacgggtgatttatagtatactatgtcaaaaggaggagttaggtgaacaatcaaatcacactagcatatttagatcatgatgatctagatgctttacaagttgtaagtgttgtcagtttttatgaatcgtttatcgatggcgcagatccacttgatatgcaagaatatttacagacacaattgacaactgaaatattggcagtagaattggcacagtcaaccagtaaatttattggtattaaggatcatcaaatactcattggttatatgaaagtcaatgatgaaaaagatgctatagagattcaacggctctatctgctcaaagattatcaaaacaaagggttagggcaacggttactcgatgaagcgaatcgttatgctaaaacgaaacaaaaacgttatttacgtttggctgtttatgaaaaaaatcatgcagctattcgtttttatgaacgttatggatttaaaaaaatcgggatcaaacattttcttttaggaaaacaagatcgtatttgtccgattttagaaaaagaaatctaaaaaaacgtcctcacttttgatgctgaggacgttttttagactggtagtggaaccataattcgctttcttttttgataaaacgctaattccgtcacaccttttgctttggtggctaacttcattctataatccaccattttagatattccggatgcaagcgatgtttatgaaaaaaagtatctgtattttttttacagttattgggatctttgctactatcaagattttatttaaaaagtaaatggctgggaagaattttttctcctcagccattttttcaactaatcaacttttacaaatccatcttgaacaaatttcgttccgtaggtcagagtgttttccacgggacactttgcggcaacgtcagcgaggaacttcttgatgtcttcatcagactcgctgctgcgaagatgtggttggtaacggatctcagtaaacttacgaacattcttaccatcagcaacgtcttcacggccaaggtcaccttcgattgttacccaaaaagctcgtaagtcaaagttacgttttttagctaatgcctgagcagtaattgcttggcaggcaccaaatgacgcaaggagaatttctactggattcatccccgtatttgtactttcaggttcatcaaaggtaatttcaaaaccacgggtacctgctgaaacttgcatccccgttgttgtcttagttgctgttactttatatttactcataaccgtgccctcctttaatacccatagtgtaatcgagacgatacttttggtcaatgagggtgctcaattataaggtgatttcatgtgatgatttttcgccattaaggattgccatcacatcatcaagtgaaatatccaccatatttttgaccgctaaattagtaaagaaggcaatgtgaggcgtaagaataacattatccatttcgtgtaattctttaacaaggggctgatcatcaagcccttgttctcgacgatttgtggccgccaccgtttcttcaccttcaaaagtatcaagggcggcagctgcaattgttcccttttttagggcggcaactaaatcagctgtattaacgactggaccacgactagcattgactaaaccggcagttggtttcatcatttcaaagtcgttagcagtcaataaatctttagaagttggatttaaatcgacgtggagactaacaacatcggcttgctttagtaattcttctttagaaacgaactggacaattccatcgaggtcagtgcgcggattcgtgtcataaccaagaacagtggcacctaatgcatgaagaagctttgccagggttccgccaatgcgtccaacaccaataattccaatcgtggcagtatgaatttccgttgattgttcatcactaaaccagcggaagtcattttcggcgacttggtggtcaaagcggtaagttttccgaagcaaccggaaaatctgcattaatgcaaactcggcgacactccgcggtgaatatgctggtacattggtcacgactaggtcattttcattagcctttttaatgtcgaccatgtcaaatccagctgtccgcgttgcaatctgtttgagcccattggtatggagcttttcataaatatcagccggaactttactacgttgctgaatcacgagtccatcaacatcggcagttaattcaacagcatcgtcaatcaatttcggcgttgtgatgatttcgatattatgttcttttgcgtattcgttaatggcgatttgttcatcgtcccgcacactagtcattaagatttttgtcatgttaatcctccttattaatgaaggctgcaatgttatcaagagctctggttagattttccatactggtggcgtaactgattcggacgtaaccttgaccgccagcaccgaagaaggaaccaggaattacagcaacttttccttcattggcaagatctgtcgcaaatttaaggtcatcattaccatattgttcaggaatcttggcaaatacgtagaaggctccttgaggattaatcagctcgaaccctaatttttggaggttattaacaacaaaatctcgtcgttgctcataggcatctttcatttcttgagtagctgtttttccttcgttagtaccaaatgcggctactgcagcggccattgctggattagaagcagcggttactaacatcgcgtgaatggcactgactgatttcatcaattcttgcggcccagcgataaaaccaatgcggtacccagtcattgcatgtgactttgaggcaccatttaaaattagcgtttgttcgggatgtaattagcgattgaagtatgagtagctccgtaaacaagttccgagtaaatttcatctgcaattacaatcaggttagttgatttaaccgtatcggctaatactttaatttgatcttgggtgtaagtaacaccagttgggttggaggggtagttaagaactagtccctttgcgttaggatgttcttctaggacgctttggagtcttgcgggtgtgagaataaaatcatcgctgcttgtatcaacttcaatcggaatcccaccaagaatctttgtgacagccatgtagaaggggaaagttggggttggaatgataatttcgtcgccaggattaataatggtagaaagagaagcgaaaattccctctgttgcaccaactgtaaccgcaatttcgttttctggatcgtattctagctggtaacgatcttgcataaaatgagcgatggcttggcgtagtgctaaggttccacttcctggagcatagtgtgaatcattggcattgatgctatcgattgcggcctgcttcatcgcggctggtacattaaagtctggttcacctaatgttagtttaatgatgccagggattgagcttacctgataatcaaattcgcggattccaccaggagtgagtttagtgaaattattgttaagacgattaaggatttcttttttagtagctggcatgataaattcctcctatatagtatgtagatttagaaataaaagaagccctgaatgctataggaataacatccaaggcttcttgatcagattggaatgagtataaaagaggctctcggatgtttgggggtcatccgggaacatcacaatgacaaaatcactgctggttagcggacggtaattgcgctaaaccagaagacatacgcttgattcaagtgaattgtcgcagtgatcatcattgtgtcctccttttgattaactgattactaataattctaatcattttttaatttttgtcaagcgttgattgagaaaaactattaattacaaaaatatttattggttacaaatgtaaatataacaaagtttgaaaatgtttgtgattattagttcgcctttagtttgatattaaaattatattctacaattttttttatttttttgtgtcttttttgttgtcttactccacaaatgtgatataatattaatcgtaaaggaagtgagtagcaatgcggatcgacatcaaacattatttggaagttaaccacttgaccatttatcaagtttccaagcgttccggttacggctacacgactttacacaaatcgtttaacaaaccacagtctagttcgacctcgcttaacctgcgtgatcttgatgccttggctcgtgctcaggacaagagcatgtggaaggtccttaaagaactagaagagcattacctcgaatgagattgtggctttgctgtagccacaggaagttaaatgcgttaacttttaacttctagaatacttagactacgaaacttagaaaacaaaatagtatatttaattgaggaggaattgcatatggctcaaaacccaatgaatccatttgacaacgacatgaatgacatcttcaatcaattaatgggtggcatgaatggtttcaattctgataatcggcgttacctaatcaatggtcgtgaagtgacaccagaagaatttgctgaatatcgtagaactggtcaattgccaggcggtgcaaatcctcaacaaggtgggcaacctggccctcaacctaacgcaggtaaggacagtatcttacacaagttaggtcgaaacttaactcaagaagctcgtgaacatgaacttgaccctgttattggtcggaacaaggaaatccaagaaacagctgaaattttaagccggcggacaaagaacaaccctgtattagttggggacgctggtgttggtaagactgctgttgttgaaggattagcacaagcaattgtttccggcgatgtaccagctgctatcaaggacaaggaaattatcagtatcgatatttctggtcttgaagcaggtacccaataccgtggtagctttgaagaaaacatgcaaaagttggttgatgaagtcaagaaggctggaaacatcatcctcttctttgatgaaattcaccaaattatcggtgccggttcaactggtgattctagtggttctaagggtatgtctgacattattaagccagcattatcccgtggtgaactaacagttatcggtgcaactactcaagatgaataccggaacactattatgaaggatgctgcattagcacggcggttcaatgctgttactgttaatgctccaagcaaggctgatactgtagctattcttaaaggtatccgtgacttgtacgaacgtcaccacaatgtaaagttaccagatgacgttctccaagctgctgttgattactctgttcaatacatgccacaacgtgcattacctgacaaggctatcgacttaatcgatatgactgctgctcacttagcagcaaagcatcctgcacgtgatgctaaggcaattgaaaaagatatcgaagcagaagaaaagaagcaaaaagctgctgctaagaaagaagattacaaggctgctcaagatgccaaggaaaagattgctgacttgaagaagcaattgagcgaaaactctaaatctgaaaaggttactgctactccagaagatgttgctaaggctgtagaacaaattactggaattccagtttcaaagattggtgctagtgacgttgaacgtctaaaggacatggacaagcggcttgaaggcaaggttattggccaagacaaagctgttgaagcagttgctcgtgctattcgtcgtaaccgtgctggatttgacgaaggcgattcaccaattggtagtttcctctttgttggacctactggtgttggtaagactgaacttgctaagcaattagcccttgatatgtttggcagcaaagacgatattattcggttagatatgtctgaatactctgaccggacagctgtatctaagatgatcggtgctactgctggttatgttggttatgaagacaacggtaataccttgactgaaaaggttcgtcgtcacccttattcaattattcttcttgatgaaattgaaaaggctaacccacaagttatcaccctcttgcttcaagtacttgatgatggtcgcttaactgatggacaaggtaacactattgactttaagaatactgttatcattgctacatcaaacgccggctactccaacgatgctccagttaagatgggtcggaacgaagatgaagaagacttaattaagaagttgactgcttacttccgtcctgaattcttgaaccggttcaacgccattgttgaattccacagtttgactaaggaagacttgaagcaaatcgttgacttaatgcttgctgaagttaaccggacattagctaagaagggaatgcatgttaaggttactgatgctgcaaagcaataccttattgatgaaggttacgatgaagccatgggtgctcgtcctcttcgtcgggttatcgaacgtgaaatccgtgataaggtaactgattactaccttgaccacctcgatgcaaagaaccttgttgctgaaatgaaggatggccaacttgtaattgttgacgctaaggacgcctcaaaagacgatagtaaagaatatacctcaccatctgaaaaaaaggatgaagaaaaaaacgataagaaggaagaagacaagaagtctgacgaagataagaaagacgaaaagtaattttcctttaatgtagaaaaagacataggatgactctgaaatgagttaacctatgtctctttttgctttaaataataaacattattaatgatctaggcaatcactatggaggctaaaaactaattaggatagttgaaaattgatggtaagatctgattttatgcataaaattattgggattaaggagactctcttttaaaacgaattgcctaaaaatatcgaaaaaatagacaaaaataagtgaaaaaatagtctattttggtgattggcttatcaatccatttattcagacgacaaatatattagcaaattatgattagttaaataatcaatagaccacaagtgctattatatcaacgtttgttcgaattaccagctgttaaataagggctgaatagtgattgtttattaccccactttatctgtatcattctttcacagttgtctctaaataagacatttgggcaaaaatgaaacggtaataatttgtggattttagtgtaaagataaattcgtttagtaacttataattatcgcaggaacagatttgaaaaaatttaaattttttacgggctttttcaaatagttttaaacaacaaaaatgaaatgttgatacatactatttgctaattgcttgattagccattaaatattgatataaaggcatttcaaccatagttgcaaaaatattcgtttgattttcgtttgattaatgaatggctatttcgctaataagtaaagcaacttaacgggtgaatagttaaaatgcaaaatgatcttttcggaaattgcctctcttgtaatccctcaaaaccttgatatagtaggaactgttaagtcattaagcaataaaccttgcatgaataatttattttcttttgaatattttttcataaacgggggtttattaaaatgagaaattcgaatacaaataattggcgttcaactgctctgattgcgggggcaatcttgacagcaggtgtcgttaccaccacttcaacgacagatgtacacgctgataatagtcaaaacaatgcacaagtaagtaatgaccaagttacttacgaccaagttcgagcaactgctgatcagcaacttgcacaattgcaatcagctaatgatagtaaaaaagctcaacaagctacggccaacgagcaatcaaatgctgcggatcttgcacaaaccaacgcacaaattgatcaattaaaagctagtcatgctgctctagaacaagaacaagccggtgctattgcacaagcacaagcttctactgctgcttctattgaagcacaaacttcagctgctaatgctgaataccaacagcaaattaacacacaacaacaaaacgaagccactcaacgtgcagcaaatgatcaacagtacgcacaagctgttagtcaagccgctgaaaatcaacaagctgttgctgatatcgatgcacaatatcaaaaggctttaagtgatgccgctaatacgcagacaagccaagcacaggctgctgccaataattacaactcagctgttgctaaggaaaatgatacttaccaaggtaagctatctgctcaacaagcaactaatgcagaaaatattaaaaatgctgaagcatctcttgcatccgcaactgctaatgctaacaagccatatgaagtcgcaactactaatgatgttgccgttactggtcgagttgctaaaccacaaacagatgttaaagttcctgcttatgtaacaaaatatggaattcatctagaagttcgtggttataatggtgctattcctgtatctgattatacttatcctgaatttgctaatacttactatggtgaataccctgatagtactgtaatcacaaacaaggctgctgaatcaactccacatgatatttcagaaatgccattaaacttccaaccaggtctattaagctatgatgctaaaaatgaccattcagaaaaagtttctgctgatggtttaacggctgaccaagttcaagtattacgggcattagctctttcatgggaaaatggtttccgtaacaatgttttccaaaactaccgtgaattttacaatgtggttaataagaatgatggttttgtaaacgttgctccagttaatttagtaagtactgactttactgataacattgcaaatcaagttgttgctaaccggacaaagtacaatattgataataataaccatactgttatcagcagtggaatgcctgccgaagcaacttatactagcgttattaatgatgcaaccaagaacttgaaaaagaatttaacaagtgaattcaatggtaagacagtttacactgacgttaacgaaaacttaactactacgcaagctggaacgccaacccttcttaattacgctattaatctctacaactcaatgcagggtatgtactatggtgaattagtaaacccaacacacatcggtggacatgcagttaaccttctttgtgctggtgttcgaactgtgggaattggtttccaaaagttgactgatgaaatgactgctaagaatggatcaggtgtttctgatcgcaagaacccatcatatgctgtaacgtttgatcatgtcggatttaacattgatcatgatgctaacttaactaaagaagttcaaaaccgtaatgtatggggtacttcaactgttgatgcgcaattaaatactattaagactgctcaatatcacgttaataaggtgccaggcacaaagacagttacgccaactgctactgatgtgcaaaaagctactgctagcgaacaacaaaaattagctgatgttaaggcacaagcacaacaatcccttgatgcgttagctagtgcccaccaggctagcttaaataagcttgcacaacaatataatgatgcgaaggctcaagtaaaggctaactatgatgttgcagttactaaggcagctagtgttcgtgacgctgcccttaaggctactggagttgttgatcttcaagcttacaaagctcaattagacagtgcctaccaaaacttagtaaaggcagaccaagtagctgctcaaaaacttgctgctgatcgtgacgctaagatcgccaacatcaagaaagctgaaaatgtaaagcttgatgctaagattaatgaacttgttccaagcgttgatccacaaatcaagcaattacaagatcaacaccaagcagttattgctcatggtgatgctgttcttgccgaactaaaggctgaaaataaggctgtttataacaaacttgctgaacaattcaatgttcaattagcagctattcaacggcgtgaaaatgctaagagagctaatgaagttcgtttagcaaataatactgttgtccttccttcagcagtgaaagttgctaatgacggtaatactgatactgttgccttcccaacagcttcaaaccctctacaagctgaaactactggacgtgttcaaactgtttcagcaccatcaattgtaaagacagctacacaaacacctgttgcagttacaccagttgttactacagtaaatcatgctgctgaaaacactgttaagagtaatgaaagttcagctccagttgtaacacaaaccactgcagttaatggtacacaaacatcggttgcttctactgctgataacaaagccactaaagcagacaacagtgagaagtcagttgtaaaagctgatactgttgctaagaagagtgaatcatcacaaaaggttgatcaatcttctatgtcaattgttgctttaactaccactgcattacttggtacacttggtatcacttacagttcaaagaagcgccacaactaatccgaaacgattaataaatacaacaaagaggctgagaatatcccaacctctttgttattttaaactgttattctcttttgtatcctatagcttatcaatcaatggttgcataaaattattattgattcgggtaagcttatgatggtttcctaagtttagttcataggctaatcgctcgggatcattttggtcattaactttaatgattcctcgtttcttaaagttaaaattttcggcaatgtgctgcatcgctttattgctgcggtgagtatcaacccgaaaattcttaattccttgcatttggccaactgttagtaagttagaaaatagcaatttactaagtccttggccccgataattactgctgatagctacccggtggatggtagcataaggctcatctggttgttgccactgtccctgtgtaatgttgcggtaggttggttcgggtgtaagttgaagagtcgcagtagccactactttattatcattaattaatatccagtttgtttgcatcacaatatcttgagtaaaggtttcctgatctggataaccgttttgccattgcggactaccatttttctttagaagctcttttgcatcatcaattattttcataatcgccgttaaatcttgaagctgggcgcgtcgtaaatatatttctgccattattatcctcccctgattaataatatttctattgtacgacatttagccttattcagcggagaaaataagcgagattatatttcagaaagaagtggtttgcgttagaatgaaaagcaatgaaatgaatggaggataagcgatggcattaacatggacaattatttggtggtgtttgctactggttattctcttcaatgaaattgcggccatttatactgttttccgcgaaaagcgggatattgctgcaacttgggcatggttattggtgctaacgctgattcctggttttggctttatattatatgcattctttggacgaaaattaccacataaacaattagcccgaataaaatcccaaacgcaactaaaattaaaacaagcactagaaaggcagaagcaacaattcatcaatatgccgaagcctaaagatcaaaccgtccagatttatcggcggaccatcatgctttttcaaagtattgatgactcatttttaacgcggcacaatgccgttaatatttttacaaatggtaatgcgctttttaagaaaatgtttgatgatattgcagcagcaaaaaagagtgtccatattgagttttatacaatttataatgatcaaattggtaatgaattacggacgttacttgaacaaaaggccgctgagggagtagaagtgcgagttctctacgattcatggggatcgatgggagtctggccaagtttttatgatcatttacgtgaagtcggtggttatgcggccccgttcctgatgtcgcgaagtaacttctttgattttcggataaactaccgtgaccaccggaaaatcgttgttattgatggtgagattgggtatgttggtggttttaatgttggcgatcaatacctaggacgcgtttctaaatttggtccatggcgtgatacccaccttcgaattgtcggtggtggcgtttatggtcttcagcgacggtttatcggcgactggaatgcatcaatgaaaaaggatgaagataagattgtgcattaccatccttactttcaaccaattagagttcatggggacgttgcattgcagactgtctctagtggtcctgaagcgccattggaaaaaattaaaatggggtatttacgtctaattaatgcagcgcaggaccatatttggatccaaactccctatctgatccccgacgatagtatattggatgcgttaaaagtggcagctcattcaggaatcgatgtacggataatgattccttcaatgccagatcatgcttttgtatatcgggcaacgcagtattatgctcgtgagctcgctaatcatggtgtaacaatttattactatcaaaaaggtttccttcatgccaaaacaatgatgattgatggtcggatggcttctgttggatctgctaaccttgactttcggagttttaaattaaacttcgaaattaatgcctttatttacaatcaaaatacggtagacgatcttgagcgaatttttgttaatgatattcgtaactgtcgggtgattacaccagcaatgtttgcagagcaaccacgctggttgaagtttaagcaaacagtgtcacgtctgctgtccccaattttataatgatagaacagagctgtgacattagttaggtcacttccacaaaatacgaacagcgcagtacaacaatggccttcagcgtccggcaaagtcgaacgctgaaggcctattgttgcttgcgggagctcgaaaacgaagtcacgagtgacttctgtctcgctcccgtttttagctaaagaatatatgttcgttttatgataaaattagaggagtaatttaggcgatagaaaggattaaagattatgggaaccctgggatttgttttaggaacagcagcgatggatcatcagcaagtgttgattgatcaattagttgaccagataaagaatgcatctgctgatgagagcttttattatttggtgcctaaccatattaagtttgaaactgaaattaatgtccttgctggtcttcgtgatcgtcaaggatttagcggaagtgacagattcgcctcttcacgcatacaggtactttcgtttagccggcttgcttggtaccttttacgagatactccagcttttcaaaaacaacacctttctaaaatcgggatggcgatgctcacttcccaagttgttcaagaacaggcaagtgagctccgtttatatgcaagcgaagtaaaacaacctggctttattcaaaagatgacagctcagcttgaagaattaaaaaatgctaacataaccgccgatgacttaactgatattatttcccgggtgaagtccgcgaatgacccagcagctaatcaggcgtggcttgctaaaatgcatgatgttgagattatatatcatgcttatgaagatcggctacgggaccggtacattggtaataatgagttatatcggcaattagtgtcttaccttcaaaaatcaccagaagctgctaagatgcacttctttattgaccgttttgctcagtttactgcaaatgagcaacaggtagtggatgcattaattacgaatgccgcatcgacaactatttctttaactcttgatcgtggatatccagatcagaaccatccaaatccccaggaacttcctcctaaaaataacttgttttattcctccgcgatgcaatttcaccgtttgtggaaatttggtcaaatgcatcaaaaagaagtaaaggttttgcaaaatgtagcgtttgcgacgactcctcgtgttggtgcggaattacaacaagttgattcgtattttaagcgttatgcaagcgaaccaattggccacagcgagcgggaagacctttcttgtcccccaaatattcaatttatgacaactaccaatcggatgactgaattgaataatgtggccaccaagattcgccaattagttgctagtggtaaatatcgttatcgtgattttcttattcttagtcgccaccttgacggctatcagacaatgattgaaccagtttttgcggcacataatattccagtttttaatgaccatgaacgcttgatggataaccatccactagtaacacttcttacgacattattagaattaccgcagcggggctatcgaacagcagatatcatccaattgctgaagacatggttacttgttccacggacaggcactggcgatctgatggggctaagtgatttccaagcagctgttttcgccactgagaattggtgccttaagcaggcaattgaaggaaaaagtgcttggacaactaatgatccagaaaagattaagcaattatggcaggcacccggaacgaacctaacagaaccaaaatatgcgcaatcacggttgaaaaaattaaatgaccagttagcccttgtaaaagattttgttgcgaatcacttattgccagttttcgaccagtttaaacaagcacaatcaggccaagaacttgccactgcgttataccagttcttggccgctatgggagttacagaccggttatacgcttggcaacaataccaaagtacccgagatttagaccttgcgcgtcaaccacaacaagtctggactaccttttgccaaattctccaagaatatgtggaaatcttgggccaacaagaactacgggatggaactagtgaggtccttgcagattttagtgaattgctccaggcagggtttgcggctgcccagtattcccagattccggcaacgttagatcaagtggtagtctctgaaacgggaattgtccaaagtgaaaatcgaaaagtagtttttatgattggatcgactgatgatgtgatgccagaaatgcaagaaagcgatagtttgctaactgaccaagataaggatgttttgagtgcttatcttgatgaagatttccaataccttcctggaacggcaattgaccaactgattgatgagccatttgttcactatactggttttatgaacgctaaggaacagttgattttctcggcaccgcaaactgatagtgatgataaggaactcagtatatcgccatatatgcatgatatgtctcgctactttggtcaacctgttcgtgaatatccattagctactagcaaggccggacaagagaatgctattgattttgtaagtgccccactcgcaacaataaaccggttagtcgaagttagccggcaaattcgtgatgagcaaggagttggcattgatcgtcaaccggttatgcccgttggatggcaaacagttgctgaatcgttggttaagttagctaagcaatggcaacaatcagcagatactaaggttcaagcagaaggaatatcactaggtcagcgtctatctttagttgctgcgggctttcattatcaaaacaagattgattccctgggaaataaattggctcaggcactttatctccgaacggcacccgatgatgagcgtggacgggtattatatgcctcaatctcgcagttacaagatttttatattaatcagtacgaatattttcttaagtatggtttacggttgcaaaaacgagatgagttaaccttatctaatgaccgtatcggcaccttcttccataaagcgatggagacttttgttacaacaattcgagaaaataatttgtcatttgcagatcttgcccacgaagataatcagatgcaacgtgaccagctgattgaccatgcattagttacagctcaaaagaatcagccaactttattgcgtctcattaattcttcagcccaagcccaattccaatatcaacaattaaccgcaattgttaaaacaatgttaattacattatgccgccaagctgaatataccggctcacaaccagttaaaaccgaagttcagtttggaagaattggtaaccagcagccgggcaaccttggctctcttgattatcaacttaaagataatcatcatatttatctgcggggacgaattgaccgaatcgataatcttaagcaaggaaacgacaatttcttgacggttgttgactataagtcgagtaatcatctttttgacctcacttcggcttattatgggctctctctccaacttttaacctaccttaatgggttacaggcaaacttagctgaattggaaacgaataattcacgactggcaggggcattatatcttcgtttgaataatccgacaattaaggctgccgagttaaagaagagttccctcgatgatttgaaattaaaagagcaccaatacaagggaatcctcttgaatgatccacaattattgcgggagttagataagagtttagataaacaggcattcttatacccccttaaggaatataagaatggaaaaattaaagctaataaagaagcgcttctcgttacgccgcagcaacttgattggttgcaaaacatgaataaggaacttgtgattaatgcgggtaatcaaattttgagtggtgacttgaaactgaatccttaccggttattaactggaagcaaccgtcgtacaggacttgattacagtgactttttagacgtatttcagtttgataatatgcttgaccagcaaaactaccgcgacctaaatcctaatttagcaaaagaagcatttgataatgtagttcaagacgatgatgaggaggataagaagtaatggctggatttaaaccaacgcctgctcaatccaaggcgataaatgaccgtggcgaaaatatcctagtttcagcttccgcgggatcaggaaaaacggctgtgctagtaaatcggacaattgaattgattaaagaagggcaaagcattgatcgaatgctgctcgtaacatttacggacgccgcagcaaagaatatgcgggataaaatcagggcagccttgcagaaaatagtacaagattcagctaatcccaaagatttacgtgaccggatgagtaatcaaattaaccggcttgcggctgcagatattagtacaattcatgctttttgtttaaagttaataaagcggtactattacttgattaaccttgatccacaatttcggctcttaactgacgaaacagagcggttattacttcaagaagatgtctggcatgaagttagtgaagaactgtataaaaacgctgaagaaaaagttccgggcagagcttcctttagcgaactagtcctcaacttttctagtgaccgtgatgaccaaggactcgacgacttgattttacggttatgtgaaattgctaatgcccaacctgatcccgaaaagtggctccaaaaattaccagataattatgatttagggtctggctcactattagaatctaatttttatcaacaacagctaaagcccctggttatcgaaaagctcaatcagctcattcaagattatcgtgaattagtaacaagagctagtgacaacggtctagatcaagcagccgaagttattaaaagtgatgaagaattgatgcatcaacttctttcttcactcggggggattaccgtcagtgatgtttgtcaaatgatggcgcagcaaaaatttggtagttttcggggacgaccagcggcagatgatccacggattgatgtatttaaagacattcaaaagcagcgtaatcagctaaagaagcagtgggaacaaacagttagtatttacttgggaaagcaggaagcacaggaaccaattgcaaaagaagaattgctaactgagctaacgactttccgtgatcaatttacagccttgttaagcaaagcaactgaaagtcaattagacgctaaaactgttgattcattgcaaaaagaccagcagatgatgcaggagcttttagacttattgcaaccacctacctggaatactattcgggacttatttgctaatgctaaatttgcacgaatgggcggcaaaccgaaagacgatgagctagctgaagaagtatataaatcactgggaagtactcgaacggggataaaaaagcaatttgatcagttggttgatcgcttctttaattatcgtgaagaccaatttcgattaatttcaacgaatgcccaggaacttttacgcgaattgagtgcggtaacgattaatttccgtcgacggtatcaacaaaccaagttaaatcggcatgtccttgagtttagtgacttggaacactacgcgtacgctattttaacgccatcagacgaccagccaaactggcaaaccctcgtcaaagatctgcaaaatcattatcaagaaattatgattgatgaataccaggatacgaaccgccttcaggaaagtattttgatgaaattgacatctcctgaacgcaagaatctatttatggtaggggatgttaagcaatcgatttaccgattccgtgaagctgatccaacattatttcttgggaaatatcaaaactatcgtcaaggtaacgacggggaagcgattgttttaggggaaaatttccggtcgatgactaatgtgacgagctttaccaatatccttttcgaacaactgatggatagggaagttggtgaaattgattatgacgaagatgcccatttaaaatatgcggcaacttattacgaagaaaatcaagataataaggttcacccaacagaagtgttactgtatgacgccaatgctcttgatccagaaaaagaagatgttgaacatgaggatgataaattagctggagaatttcggatgatcgggatgcgaattaagcagatggtcgaaaatcaagagttaatttttcatccagaagatggacagatgcatccaattcagtacggtgatattgttttgcttgagcggacaaaggcaattaataattcattgatggaagagtttaataaacttaatattccattgacagttcacgatgttgaaagttattttcaagctactgaagtgcgagtaatgatgtccttgttgaagataattgataatccacaacaggatattccattagctgctgttttgcgatcgccgattgtcgggttaactaaccaagaattagcttttatccgtcttcagaatcgatctgttgattactacgctgccttgcaatcatttatgggtaattaccagcgaaaggctcttcaccatcaatcgctccttacttctgaacaggtaagtgccctctatgaaaaagcagaccacttcttaggcttgcttcgtgtttttcgacaaacagcccaacagcaaacccttgttgacttgatttggcagatctatgaccaaacaggttatcttgattacgttggagcaatgccaggaggccaccaacgacaggcaaacctccatgccctttatcaacgtgcacactcttatgaacaaagcagttttaagggtctttatcaatttattcgctttattgagaaaatgcaggaacatgataaagatttaggcgtagcaccgacacagttaactgcaaatacggttaatgttatgacgattcacggaagtaagggtctgcaattccctgtggtatttctaattgatgccacacatggctttaacaaaggagcagctcgtgaaaatgcagttgtcgatgctgttgcgggggtaggaattcgttacatggatgatcaacgggtcatttatgacacgccgcaacgacaagcagtgattgaagaaatccagcgcggcgaacgagcagaagatcttcgggttctctatgttgcattgacccgcgcagaacagcggttaattattacgggatcctttaatgaagaaatgcggacacagagtcttgttggttcatggcaacggtggcagaaagcatatcagagtaagaatttactaattggcccgcaaccacggatcactgcaaattcatttatggactgggttggccttgcactagctcgttatccagaattcaacgcgcaacaattgagtcgtggaaatgtcacgctagaaaaaagtactcttgctgatactaaagttactggtttggcggctgatcctcactttattgcaaaaacatataccgcacttgatgttagcgatggattggcaaaaattgggcaaaatgctagtgctaatgtaacggaaaagaacaatacagtcgcaactgatgcttctgaacaaaggattgatcaaattttgcgttatcgttacccccatcttgtcgctactaaaacaactgcttaccaatctgttacagatgtaaaacgagtctttgaagatcctgacacacgtgatatggcgcggtgggattatgatcaacaacaaagggtaaagacgcaagggatttacttaaataataactttgacgttccagctttcattcagcagactactcatgaacccgtggcaacagaaattggaacagcaactcaccttgttttccaaaaacttccgcttgatgaaggtccgattaacgttgaatttgttgatcaagaaattcaaaaattagtaggaaaaaaactgatcaatccagttgtagcagcacggatcaaccggaaaggaatagtggacttttatcagactgaggttggtcaaaagatcttaaagcatcccgcagattatcatcgtgaagtgccgttctcaatgattatgaatggtcatgaattatttaaaggggtaaatgttagtgatgatgaacgcattttaattcacggaatcattgatggttacttaaaaaatgacgagggcattgttctagttgattataaaactgatcaccttaacaaagattatcgcgactttgatttagcacggataaaggatcgctaccgaggacaattagagctctataaagaagctttgaacttaatggaagggattccagttgtccaaatggggctttacctgttagaattaggagagttcgtgttatttacaaaagagggtgattagttggcgacaattaaagatattgcacagaaagcaggggtatcggtttcgactgcttctcgagctttaaaccataatccacgaattagtgaaaaaacacgacaacaaatagcgacgattgctaaagagatgggatatcaaccaaattacaatgcacagaacttaacacggggcgagtcaaacatggtcggaattatttttccagtaaccagtgatactgcgcctgccaatccgtttcatattgacttattacggggaattagcatggcattaaagccgattcactatgaaatggttgtggcaattgcgccaactacgaccgaccttttgcaaagcgtaaaatcgatggtcgaacagtccaaggtgcataactttttagtactttatacggttaaagatgaccccattactaattacctgcgccaaaataaccttaattttgtggtaatcggtcatccagacaaggcccaagatcgctttgtcgacaatgataacgtagcggcagggcaagcggcgactgattatctgatggatcatcaggagactagtcaccccgtctttcttcaatctgcaagtaattgggtatttgaacaggataggcatcaaggttatgagcagagtatgcaaaatcatcaccttcctgctcttagctggcgatattcaccaacgggaccgcagttaaagattttattaaacaacatccgcaaatcgattcaattgtttgtgttgatgacttgttgctggtacgattaatacggcaactacaagaatttaatttaccaactatttgttttaacaatagtcggttgatggggatgttaattaatcaagaagaaaaggttgacttacaaccccgcaaattgggtcaacaagctgttgaattactttttaatccagaagagcaattccgaatcgttgattttaaaataaatagttgatagaaaggaccacggaattacttgtcacggtcctctcttatttttatatggagggaaatcggaatggagaaggtttacattgttgctgctcagcgaacaccaatcggtaagtttaacggtcagttagcttcaaagtctgcagttgaattaggagcgattgcaattaaagcggctgttgaaaaggcaaagctcagcggaaacgatattgaccaagtattaatggggaatgttattcaagcaggaacgggacaaaatccagctcgtcaagcatcaatggccgctggcttaggtgagcaggttccggcaataacgattaatgacgtctgtgcgtcgggaatgtccagtgttaacctggcagcaagtttaattcgcgcaggacaggctaatgtaattgttgctggggggatggaaagtatgtcccaagccccatatgttcttcctaaagcacggaatggttatcggtttgggaacggaaccttacttgatgcaatgcaaagtgatgctttaaatgacgtttatggcggttatccaatgggaattactgctgaaaatatcaatgataagtatcagattactcgtcgccagcaagacgaatttgctttgtcgagccatcaacgtgcagtaaaagctcaaaaagcaggctatttcgattcagaaattgtgcccgttgaagttaagcagaaacgaaccactgtaactgtaaaggttgacgaagcaccacgaccagatacttccctagtggctttagcaaaattaaaaccagcttttaaatctgacggaagtgtgactgcaggaaatgcctcgggaattaatgatgggggagctgctttggttcttgcttctgaaagtgcagtcaatcaattaggattaactccattggctgagtggcaaggatctgcagttgttggtcttgatccagcattgatgggtctgggaccatattatgcaatcaataagctcttaaaaaatcagcagatggcggcggatgacgtggatacttacgaaattaatgaagcgtttgcgacccaagcccttgtctgtcaggacttgcttcatcttgatcctagtgctgtcaatccttggggtggagcaattgcgttaggccatccagttgggtgttcaggcgcgcgaattatcgtcacgatgattaatgaaatgcattgggataatcatgaactcggcattgcttcgctgtgtgtcgggggcggaatgggtgaagcggttctgcttaagaaaatttagtaccaagaataacattcatcgtaaaaggcaagtaattgaggaaaattgaagtttttctctattacttgccttctttattttattaagttaaatacgttttaaataattaactataacaggcctgttttgcgggagctaaacagtaataactttaaattataaaaatccacaaccgttttctaaaaatttgcgcaagcggttgcacaacgattttaaatttgatattattaatattgcaataatgtatgaagcgcttacaataatcataagtgtcttttagaactattttataagttaaggagttgttagcaatgagtcaagaaaagtccacgggggctggattacctactctatcaaagagtactatctggatgatcaactttggattccttggtgttcagacagcttttactctgcagagttctcaaatgagtcggattttccaaactattggtgccgaccctaacaaccttggctggttcttcatcttaccaccattagctggtttgattgttcaaccaatcattggttattattcagaccgtacatgggcaccaaaattaggtggtcggcggttaccatacttactactgggaatgattgtagctgttatcgttatgattttgcttcctaattcaggaagtttcggtttcgggtatggttcgctcgctgccctttggttcggtgcaattactgttgctttacttgacctttcatcaaatgtggcaatgcagccatttaagatgatggttggtgatatggttaacgatgaccaaaagagttatgcctatgggattcaaagtttcttatctaacacaggtgctgtgttagctgccgttttcccattcattttaactgcttggtttggggttcgtaacactgcaaaacgaggcgttgttccagattcagttattatcgccttctacgttggggcagccttgttagttgttactagtttatttacagttttccgggttcatgaatatgacccagcaacttacgcaaagtaccatggtatttctgaagatgataacaaagagggtggaaattggttcacactcttaaagcatgcaccaaaggcattctggacagttacccttgttcaattcttctgctggtttgcattccaatacctctggacatactcagctggggctattgccaaaaacgtttggaatactgttgatgctacctctgctggttatcaggctgctggtaactggtacggtgtacttgcggctattcaatcaatcgctgctgttatttggtcatacgttttagctaaggtgccaaacaagtaccacaagcttggttacggtggtagtttacttcttggtgctcttgggttcatttcagtgttctttgttcatgatcaatggacgttgattgtttcatacacccttgtcggaattgcttgggctgcgatgaacacttacccattaacaattgttacaaacgcattgactggtaagcacatgggtacataccttggattattcaacggttcaatttgtttaccacaaattgttgcttcattattgagttttgctttattcccattatttggacactcacaagttcacatgtttatccttgctggtattgtaatggctcttggtgctctttcagttgccacaatcaaggaaacttatgctgaataggagttatttaataaaataagttaattaagttataataaaggcaggttaaagactacctttatttcagatgaaaggaattgagatttcaatgaaacgtacatttgatattgccccttggcatgttgctactcacaaatgggacccacaagacaagcgtttacaagaatcaatgactagtttagccaatgagaatcttggtatgcgtggcttctttgaagaaggttacagtggtgaccatatggaaggtatttacctcggtggagtttggttccctgacaagactcgtgttggttggtggaagaatggttatcctaagtactttggtaagatgatcaacgctgtcaacttcatgaagttaatcattaaggttaatggtgaacaactcgacttagcaaagcaaacaccaaaagactttaagcttgatcttgacatgaagcgtggtgtcttagaacggtgttttactgttgaaattggtggtactgaaatgtacttcaattttgaacgttttgttagtgttacccaaaaagaattagttggtcaacgtctccacattaagaaccgtggcgacagtgatgctaaggttgaaattactagcatgattgatgctgatgtatacaacgaagacgctaactacgatgaacaattctggaacgttttaggcaagtctgctgatggcgaacatgctgaattaacttctatgactaagaagaatgattttggcactccacaattcatcgttggaatgaagactacttcaaagactaaccttgaccacgtggatgacggcactgacgaaaaacacgcttacaacacatttgctggtactgtagctgctggtaaagaagttaactttgaaaagcgcagtatcgtaatgacttctcgtgattacgactcccaagcagatattgaaaagaacttggatgtattaggcgatcaacttgataatcaaagttttgacgacttactcgatccacatattaaagaatgggcagatcgttgggttaagtctgatgttgaaattgaaggtgacgaaggagctcaacagggtattcgtttcaacctcttccaactcttctctacttattatggtcaagattaccgtcttaacatcagtccaaaaggattcactggtgaaaagtacggtggtgctacttactgggatactgaagcttattgtattccagtttaccttggggttgcaaacccagaagttgcacgtaacttattaatgtaccgttacaagcaattagatggtgcctttgttaacgctaaggaacaaggacttgatggtgcattattcccaatggttaccttcaacggtatcgaatgtcacaacgaatgggaaattacctttgaagaaattcaccgtaacggggacattgcctttgccatttacctttacactaagtacactggcgacaagtcatacgttcttaacgaaggggcagaagttcttactgaaatttctcgtttctgggctgaccgtgttcactactcccaaaacaagaacaagtacatgcttcatgccgtaactggtcctgatgaatacgacaacaacgtaaacaacgactggtacactaaccttctttgtcgctggactcttcaatacacccttgacatcttagaccaagtagatgaaaaggtagctaagaagcttaatgtttcagaagacgaaaagcgtaagtggaagggtattgtagacaacatgtaccttccttacgacaaggaaaaggacatcttcccagaaaacgatggcttcatggacaaggacttgactccagtttctgaaattccaagtgaccaattaccacttaaccaacactggtcatgggataagatcttacgttcaccatacgtaaaacaaggtgacgttatccaaggtctctgggacttcatcgatgactttactaaggaagaaaagaagaacaacttcgacttctacgaacaatttactgttcacgaatcaagtctttctgcttcagtttactcaattatcgctgctgatattggttacgaagacaaggccgttgaattgtatgaacgttcagcacgtcttgaccttgataactacaacaacgatacttctgatggacttcacattacttcaatgactggttcatggcttgatattgttcaaggatttgctggtatgcgtgttcgtgatggtcaattacactatgcaccattcttacctaagaagtgggattcataccaattccgtcaaatgttccgtggccggatcttgaaggttaaggttgacaagcatggtactaagattgatcttgtatcaggtgacccaattaccatcgatcttgacggtaagaagcttgaattaaagtaattcttggaggcatttgagatgaagtttgaagatttgaaaggttttgcatttgaccttgacggtgttattgctgacactgctcgttttcatggtcaagcatggcaccaattagctgacaaggttggaactgaatggactccagaattggctgacgcattaaagggtgttagtcggatggattctttggaattaatcttgaaggctggcggccatgaaaatgactatactcaagaagaaaaagaagctttggcaactgaaaagaatgataactatattaagttagttgaaactctaacacctgctgatattcttccaggaatgaaagacttcttagatgaattgaaagctaacggttaccacattgtattagcttctgcttctaaaaatgcgccaaaggttcttaagtatttgcaattaactgattactttgaaggaatcgttaatccagcaaacttaagccatggtaaaccagatccagaaatttaccaagaagcagctaaattaatggatcttccagctgaccaagtagcaggacttgaagatgcccaagccggaattgaatcaattaaccgtgctggtgaattatcaattggttttggtgctgatttgcaggatgctgatgttaagttcgataagactggtgacgtatccttagctgctattaaagcgcaaatgaattaagatccaatttctctcttttaacaatccgtaaagacgtacttagaataatctaggggcgccttttttatgtgaaattatgaaaagaaaaatcgttataataacaaccatcattctaattagttgcttatgggtagtagttgcaattaactttaatcggccgtcctttcagccagttcaagatgaaacacagtcaagtcaacaaccgcgaccaaaatttaccgaccaacaaattggggttttggcgggattggcaatatctcccgactggttaaaacaaaatattgctgcaaatcaactcgtttatggaattgttaagccctctgataccgttccagcaggagtaaatgattatagctatttagtagccgctgacgaccaagatggaacggcaattttctttaaagttgaaggccagactgtgatcataaaatatacttctcagcgaaatgcaaaattaaaaacaaaggacttaaccttggcgcaactaagaaaagaattctaccaaacgaggtcacaaaaaaagcaagtagataactatgtagcaggattgcggaccgagtaaaatttaaggcatcttaaaaatgctattttcagggtattctttagtgatgagtactgtataatattcaaattaaaggaggaaactgtgatgtcaatttatggcccatatgagcagattttgtcaaatattctttccctcacaactgatcggatcaaagaactaaatcagcaaacagtgcaggataagcaaccaaaactttatgaacatttaattgctcgggtgaagacttccgagagtatggcggaaaaatgccaacgaaaaggctatccggtctctactgaatcggccttacgaaaatgtcgcgatgcagttggaatcagaattgtttgtaactttatcgatgatattgaccgttgcctttgccaattacgtcaagctgactggtgtgaggttattaaggaaaaggattatattacaaatgcaaagccaaatggatatcggagctatcatgtcattattgatgaaaaagttccatatcaagatatcgaaggaaataacccgggacatttttatgttgaaattcagttacgaacgattgcaatggattcatgggcaagtcttgaacatgagatgaaatataaacataatattaaaaatccagagcgaattggtcgcgaacttaaacgttgtgctgaccaattagcatcatgcgacgttcaaatgcaaacaatccggcaattaattaattctagtgaggaaggcgaataagatgcgaatccttgtagcagaagatgaacagcagctatctcatgtattaagttcagcgatgacagcgagtggttatcaagttgatattgctaataatggccaagaagccgttgagcaggcgaaagaaaatgcctatgatgtcataattttagacatcatgatgcctgttaaatctggactggaagcattaaaggaaattagagcaactggtaatcgaacatatattatgatgttaacggctatgggtgaagaagatgataaggtaactggtcttgatgccggtgctgacgattatttaactaagcccttttccttaaaagaactacttgctcgtttgcgctcccgtcaacgccgagatgattcttaccaagtagatgttcttgaatttggtgatttgacccttaacggtaacgatcaatcgcttgaaagccataattcgattagtttaacgaatcgggaaaatcgtttacttcagtattttattttgaatgctaataaagaattatcagcgaatgaacttattaaccacgtttgggatgagaatgaaaccgctgatcaagaagatctctggattaatatctgttatttacggcaaaaattacaggcaattcaatctcaagtaacaattagtggtgaaaaaactggaccgtttatgattgcatgctagggggtcaaggaatgattcaacgttttcgctataaatttattgcaatctcaactgcggcattattatttgtaattttgacaattgttggcagtatttgcaccctcacttactatcaatcgcaccaagaaattgaacgggtattgacgattttggtaaataacgacggccaaattccccgaaaagggatccggactactgacaatagtcaacctcaattttcacgtgagggccttcatcaatatcgttattttgctgtactggttgataataaaaatcaagtaacggaagtgcaagatgatcatattgcaacggttacgccgcaggatgcccgagcaatgacagaccgtcttgtaagaagaaaagtgcatagcgggcagttgctatatcgaggggtaaattatgcttataagattcggaataaaaacggcgagaaagtaattgtctttcttgatgaatcactcctcatggcccggacacgatcactaatgcatacagggttgatcttagggataattgttttagttctgtataccattgttttaaccctttactcgcgtcgtgcaattcggccaattattgaagcagagcagcggcaaaaagaatttataactaatgctagtcatgaattaaaaacgccattgacagttatttcagcgaataatgaaatgcaagagattatcaatggtgagaatgaatggacaacaagcaccaagcaacaggttactcgcctgacaaagttaattaataacctggtgtcacttgcacgcatgcaagaacaaccgacattaacgatgttgccggtaaatgtaagtcaaattgccggggatgtggctagtagtttcaagagtgtgatttcaaccgaacagaaacaattcaatgtacagattgatgaaggcttggtagcaaacgctgatgaaaatacactacgggaactgttgaatattttgcttgataatgcgaataagtattgtgatcctcagggtgaaattgattttacagtgtcctcgtctaatcatagtaaaaatatagttattacgattgcgaatagctataaagatggtaaaagcctggatgctaaaaaattctttaaccgcttttatcgggttgatgaatcgcatactcaaggaaaaaaggcaggctttggtattgggctttcgatggctcaatatatcgttaaacaattcaaagggaaaattacggcgaagtatacaaatggtaagttagcttttatcgtaacgttaaaagaagtaggaaagtaagaatgaaattttggcgacttaagattggaatatatgcagttgtttggagcctaataattggtatgctgacagcggcgtatttaaacttagttaactgggtaattgatttagtttggcatcaatacctagatccggcagttagtagtaaatggtatccgtttttagtatgtattccatggtggattatagaatgaagttagccacccagttggtggtaaataaaaaacgccattcggcgtgacatcaggtatcatattaagtgaaccaaacctatatgaaaggatgtccgtcaaatgacgcacttaaatgataccatgtctactagtttattgactactcataaaaagaatggtatctgtcaagttttcataggtagcctttaaatatacagttttagtgggttagtgccttaaaaagttgtcccattggtctacttgtggccgtgttaatcggaattattccttgtactgctccaattgacggctttgtcggtgcctttcttagaaactctccagttcgaatatgcatttcctgtaataggctggtttgagccactcgaggatgaactgttaattgttctaggattgtatttaaactagcttgcagttcaccattcattcgggcttcaattaaaccaatcatggctttagccccctgcttagtccatgacttgccctgtttcttcatccggtaagtaaaagcccggtgagaactttcgactgaaccaattaaatgaatatccttaaatccacgcatttgtggtgagaggatataccgccaatttcgctgtagatactttcttaaacgcattaggtcgtctgcttgtttttccgttaggttttgtgattcataagtatctaaaattattgttagctctgcttgatcatgatgacgaacggctttaattgctcgcatggctaattcgttgtgccggcctaaagtatgttcaattttctgtaaacaatgatagcggtcgagaaagtattcaccatgtgcaccttgaggaactagacttaatagcttagctggttcgtaacctgggccagcgtcactggccaaaaagatcgtttgaccggcaagcttataatggcggtctaaataatcacttagtcgtgcttcaagccgtccttggtgcccaacactgagaaagtcatgccgattaatgatttgattagctactcgctcataaacccgataatggtgcacaagagtcagctgacctgcttcttttttacctttaatcataaaggcatcaccctcaatagttaaatttttaggcatatggcgaggagtagcttggtgttcttttgcttgagtttgtttagctacctgatttcctaactcatgcacggcgtgcattaccgaatcggcagtaattccgctgtcaaatacaaggttcaaaatgtcggcagtattgcgcattgtagttgtttgggcaatcttagccatcatcattaagtagtgtggcgataaacgacgacgtggtttaatttttaattgttggtctaagtaaaattcacgtttctttgtcccagcctgataataccgtcgttgaaaagtcaccgggccaaagataaaattaagcgtccgtggctgtttattaattacttgatagttcgctggagcttgggactttaagcttcgatctaagctttccaaaaagttttgcatgattacttgtcctaactccaataccccttttaaaataatctgttcagcttcaaataaactgcctgatttcaccaaattctgctcgatttctgttaaaatatccatgaggaaagacctgcctttgcttagtattcgacacactaaaggctactggtcttttctttttttgccaaataagtaaattggtctacaaaaaagatttccacgaccagatgaattattcatccaacctatgaaaatcttacactaacaaagaatgctcatcttactaaagaagaacgtgtgatgattgcgactttaaagtcgcaaggactttccaatcgcgcaattggtcgccaattaggagttaatcatcaaacaattaataacgagctcaaccgtggtacggtccgccaacttcgtcgtcaaaaatctaatggtaagatttacgaatattcttactacatctatagttatgaagccggtcaggccacatatcttgaacatcaccgccattctggtcgtcgtcgcttatattattcttcaaagcaatttttacgattagctgatcagctaatgcttgttgagtttgacgaccaccattactccccacaagcggttatttataaggcccgagatttaatgaatgatggcaccctgatcccaaagtcggttgtaactttatatcaatggattaatgagggtgtgcttcgtacgtccaatttagacctctttgaaaaacctaaacgtaagcatcatcgaactcatccgcaagctaaaaggtgcttagggcctaatattgctcaacgacctcaaactgcggaccaacggtccgaaattggccattgggaactggatacagttcagggacagaaaaatggtaatgacagtgttgtactagtaatgactgatcgcctttcacgagttaatatcacgagtaaaattgctggtaaaactgcgcatgcagtaaatcagttctttacaaatttgcgccagaaaatgggcacagatgcttactatcgcatctttaagacaataacctctgacaacggttcagaatttagtgagttaacacaagttcacgatcatgttttctatgctgatccggattccccttgggaacgtggatccaatgagatcaataaccggtttctccgcaaggagattaccaaaggtgaagctataaataactatagtagtgctcagatcatagcgactaatgattggatgaatcactatccacgagctatatttaatggacattcgtcaatggacatctatcgtaaggccttctaccaagagatatcacagctccaccaaccaataatcaattggtcagtattatttatttgagtccagtggctaacttattcttgaaatttagggtatgtattccattgggatttttgattggtttcttgaatgagcgatggggtaattacccgttaacgattgaacaagtgctgacgcaagtaaggttgaaagggcaattaaattatcataattggtggaagtcttttattcttggcttattggccctcggagcaggagggaacatcgggccggaagcttctacaacagtcttaactagcagcatgattaattggcttggtgaccgtatgcgctgggcaacttcaatgcgccagaaagtttctctttggtacggtaaaatgcaaacgcaagatttagcccgtgctcctagattcagtcagctttttaaaaataaatatcaacgagtctttgttatttcaggattagttggaattggaatagtaggcgcggcgattgtttttaagctttttcctgaagaaggtgtttttgggatgcatcaccggatcattaattgggagtggatcaatttattaacgagtattccaacgattatcattgggattgcttttgggtggctgtttgttcacttagaaaattgggctgcactgataattaatgcaaaaataagtaagatttggcaaggtgggatttttgggttaattttagcgatcagctcgttgattacaagcgatatcttattttctggtgagtttagaattgttccttttacccacgaagccttcaatcattcaatcatcttcctattagttatagcactcgtaaaagccgtaatgagtaatctgggttttgcaatgggatggcggggaggaactattttcccggctatcttttcgagtgtcgcggtaggaactgcctgtgcgatgatgttgcctggagacgtacggataaatgcaattgttgtaatcgcggcaagccttacctttattttagaaaaaccgttattaacaattatcctgctgttattattggtaccgattgaactagcgccggttataattgtagttgcatttttagtaggaaggattattaaactttttcctgctagtgaatagagaatctttaatatcttttgtgtaataaagaagattgagtacttgctaagcgtgaaaaattatttaaatttcgttttattaatattttgttgtttatatgagaaaagtcctgtatctttattaaaaacaattagagaatggggcgataatgtgtttagcagaattggtcaattaatattcgataatgaagctgttgcaaagacttctgattttacaatgggtcttgagattgaaatgcaacgagtagacgaagatggcaacctaagccttgagccatatccgtcagcgattggggatgagaagactaatccatggattaccaatgattttttagaaacaatggctgaaatggtaactccttctgcccaacatgctcttgatgcaatgcattatttgtatgttatcaataatacattgcgatcagctcttgctcccggcgagttattatggccgttatccatgcccccacgacttcctaaagataagactaaattacggttagctaaaatgggaccgaaaaaagaagcttatttgaaggaatgggcaaaacgtcatgggtactcgcaaggaacgccctgtggagcgcatattaatttgagtattgatcagcacattattgagctagtccttaatgctttcccggaacgctttaatagtaagcgtgaagtgcggaattatttatatactatcttggcacaaggttttgtccgatatcgatggcttcttacgtatctttatggtgcaagcccaattgttgaagaaaattattttgaaccgggaaaagagttgcctcatccgattcggagtgtgcggcaaagtcaatacggttttgggaccaaatttaccggtgattttactaatctcgatcgttacattgcacggattgaagaaggagttaaagcagggatcttaacatcggattacgaatttcatggtccggtgaggttcaaaggaaacacggatttaaaaaagttgcctgaacatggaattgagtatttagaattacgaatgctcgatttagatcctagcagttcagtaggagttcgaactggtacactaagatttattcgtttattagcaagttacttgatcatgcagccgccattaaaagaaaacgaagtagaagaaatgttggtgactgccgataaaatgaatgaagttgtagccgaggaaaatccccaagcaacttgtagatatcaggccaaagctcgtgctgtcctcaaaagtttagagcggtatgccaatcaaatccaactcggtccagaatattccgaagttctggaagacttagaagatcgggtcgaaaatccgctaactaccccgagtgctaaactcttaaactatgtaaagaatggttcactcaccgagtatgcgttgcgtcgtgccaaacgttaccaacaagcggcacaggaaacaatccatccttttaaagggtttgaagatggacgaatctatactgctgatgagcttcgaaaagaattaacattgtaaccttttcaaggagaagctagctccagtaagcaataataggcctccaacgttcgattttaccgggcattggaggcctattattctatgtttttttctgaaagtaacttagcttatgtcacagccctccactatttatttagccgcttttttcgctctagtaattaagtcagcaaaaatagcgcgcgaataatcgtaatgtttaaacatgttttctggatgccattgaactgctaaaatttgatcagagttaatggtttccacggcttctggtacctgatcatcagcccatgccgttacatgaagtggttcagcaatctgatttagtgattgatgatgacgtgaattaacatatggtctgggtcctactaagttaaataatcgacttgccttgtctgtattaacgtggtgggaaggaaaatttcctggggcatcttgggaatgcttaagggtttgatggggattttccgaaaggtcttggtataaagtcccgccaagcgcaacatttaatacctgcattccacgacagatccccatcattggttttccagcattaaatgcagctgtagcaagactaatttcaaattgatctcgtttaagatatgtgggacctaatttttgatgcggctcttcgttgaaaaaggttggatcgacatcacttcctccagcaaagataatcccatcaaaaagatcaaggtaggatggtgctagtgaagcagcaacactaggaagaataacgggtaatcctcctgacttgataatggcttcgattaatgggcgaggtgcgaaggcagcatttcgctcgttaatgatgtttgtagcttcagttaatgtatctgcaggaatagcaattcgtggatgcatataacccctcctcatttagttctcatgatattataatcaaagcataattcatttggaatagcaatcaatatttttaataaaaaaagatataatagaagaagaaagaaggaatgtaaagatgcttgaattaactaatattaactcaacgttcaacttaaataatgaggtcaagattccctgtgtgggatatggtacatttaggactccggcagatgtagctgaacaggccgtgaaagaagcaattgaaactggttatcgacacattgatactgcggctgtttacggaaacgaagaagcagtaggcaaggggattaaggattcgggaattaagcgtgaagacctttttgtgactagcaagttatggaatactaatcgtggctatgaacaaacgaagaaggcttttcaagagacgcttgatcgtttgcagatggattatttagacctttacttaattcactggcccgccaatgaaaagcagtttggagatgatgctgccaagattaatgctgaaacgtggcgcgcaatggaagacctttacaatgaaggtaaaattcgggcaattggggtaagcaattttatgcctcaccatattgcggaattaatgaaaacggccaaagtagcgccagcagttgatcaaattgaggttcatccgggttggccacatacggaagaaattaaatacttacaagcacacaatatcttagttgaggcatgggctcctttaggtggtcaaggtgctaaagtattaactaatccaacaatgattcaaatcgctgataagtatcaaaagacgccagcgcaagtctgtttacgttggattctccaacaggggattcttccattaccgaagtctgtccataaagaacggatgataagtaaccaaaatatatttgatttcgaattaactgatgaggatatgcgcaagattaatttattgccaaatcttggcggtcaatgtgctgatccagatgaggttgatttttaacgataaaaaatatgaaattgatgcagtagtattgggtatccagtcaaataaaaatagtatgctaaaaagtctcgaaccttcacggaagaggcttttttgatataatttcttttagctaataatgaggagaatttgaaaatgaaaaatgcttatcgcgcttttcgccaatactcttgccagttcaggaaaaattggcttgaatatttaatattatttggcggtcttgatattttaaaccagtttctggtaattccattttttcgctggataactacctttgtcctgcaggcaggagaaattccgtttatttcatatcaaaatattgtaattattctgacccatcatccattagttgtagtgatccttttaattgaattaatatgcctaatggtaattatctatggcgaatttatgctcttgttgaagagcttttgtggaattggcttgccagagtttagctggcgccgaatgtttaggcaaacaaaagaaactttatcgttactaaattttggatcgttaattctattattaggttactttttacttattattccatttgcggatatcatctttcgaactcccctgctggcgaaaattcaagttcctcagtttattgttgattatcttacccgtaatgcatggcttattggtggattgaccttgttctatcttttgatgacaatgatcggtattcgtttaatattgacaatgccgttaatggcttatcaacatttacggttaagagctgctatgtctcaaagctggcaaatgacaagtaagctaagatggttgaagtttttaattcaaattgtgctgatgacaataattgtaggtagtataacggttgttttttacctcatgatttacattctccaggttgttttggatttattacccgggaaattatctttgattactgctatctttaacttgtcgatcttacagcttggtggggaagtactagcagtatgggcaggaacaattatcttactggtagtcgttaaccccttaactagcattagtgaactagcgacaactcctgaacatccatcacgaggattgctaacttcctttatgcttgtcttccttgtaatcggcttggcgactcttgcaaataatactttttacatgatgggaacggggattaaacgcccaataactatctctcatcggggagttactgaaaaaaacggggtgcaaaatactattccagcaatggaaaaaacaagtaaacttaagcctgattatattgaaatggatttgcatgaaacaaaggatcaccagtttgttgtgatgcacgatgaaaatcttaaagacctaacaggagtaaataaaacacctcatgaactaacattgaagcaattaacacgactaacagcacgcgaaaatggctatcatgctaaggttgcgagttttgatcaatatttagcagcggctgagaaatatcatcagaaacttctgattgagataaaaacaacaccccatgattcaaaacagatgctccagaattttaatcgccggtatgggaaaaggattttgcaagatcatgaccaagttcactcgctcgattacagtgctgtgactaagctaaaaaatattaatccgcggttaacagttttgtatattcaaccctataatttgggtaatccccagggagttgctgacggtttttcgatggaatattcaacattaaatcaggacttcattactcaagcccagtggcaacataaaccggtatatgcatggacggttaatgacaccgatttaatgaaacagactatgtataaccacgctaatgggataattaccgataatttaggggaattaaatgcggcaataaaagattttactggaaagcagagttatgctaatcgaattctaaattatattattgtcgttcctacaagtgggggaattgaaccgtaaaaaaatactcgagaacagataagccgttaaggcgatcagttctcgagtatttttatccaacgtgatgcttcttcaattgcctaataacaattaacgccactattccaccgatcattccttggataaagtttgaacctaaacttaaaaaaccagtaattacatggtacataacggtattgcagataaagtagattgcaatcattacgattgttccgaccaagattgcggtccatttgccccaggtggtgttgccatattttttataaatccagccactgataaatccttctaaaccatgagcggcaaaggaaaataaggcatcttgggggaagccggaaataaggtcaaggaacattccgccaaagccaccaacaattgtccctgctcctggtcctaaaagcatggcagcaatgaatacaccagcatcacataagttgacgttaccatgtgtccatggaatagggataagaaagaagcggccgaggacaagagttaatgctaataacattgcggcaataattgagcggcgtaaccgaaaagtagattccatattaaaactcctaacatagtcaattgtgagtaattttacaataattttcaaaaaatttcagagaaaaaatgtgtcgttatttatctatcgatacaaacaaaaattaacttaacatcttatatcatagtaattacattgaaatattatgtaataaaactgataattgattttcaactgataatcaatattcctattttatatattgattaaatgaaaataatgcgtataataaattgtgaaaatcagaacatgatatgaggtgtgtgttatgaaggttattattgttggttgtacacatgcgggaacaattactgccactcaaattttacagaatcatccagaaacagaagtcacaatttatgaacggaatgataacgtttcattcctctcatgtgggattgcggtttacttgagcggtgatgttggtgatccagatgcgatgttttattcgagccctgaacaacttgctgccatgggtgcaacagttcatatgcaacataatgtaactgatattgaccctaagactaagacagtcacagtgacagaccttgtgacaggcgaaacaaagaccgaccattatgataagttagttgatactactggttcttggccagtaattccaccaattgaaggtgtagatggccctcatgtttatttgtgcaagaattaccatcatgctaaagaattatttaacgttgctaaagatgcgcaacgaattgttgtgattggtggaggttatattggggttgaattagtagaagcttacactcgtcaaaataaggacgttacattgattgatgggtctccacggatgcttcataaatactttgaccgcgagtatacggatcggattcaacaggaatttgtagatcacggcgcccactttgcttttgaccaacgcgtaactggatttgaaaaccacaaaaatggtgtaaccgttaagacggataagggcaactacgaggcagatattgctatcctctgtgttggcttccgtcctaatactgatctcttaaaaggtaaagttaagatgcatgataatggggcaatcattacaaacgaatacatgcaatcatctgatccagatatttacgctgccggagattcaacggctgttcactataacccaactggcaaggatgcatacattccattagctactaacgctattcggcaaggaacaattgttggaacaaatctctttggtaatacaatgcacgatatgggaacccaatctagttctggcttaaacttatatggaacaacgatggtatcatctggcttaactttggagaatgccaaagaagcgggctttgatgcagctgcggtgacagttgaagacaactaccgtccagaatttatgccgacaacaactcctgtattaatgacattggtgtgggataagaagactcggcaaattcttggtggacagtttatgagtaagcatgatgtttctcaatctgctaacattatttccttatgtatccaggataagcacacgattgattatttagcatttgttgatatgcttttccaaccacactttgatcgtccatttaactatgtaaatattcttggccaagcggcggtaaagaaacaagctgaattagaaaaataataactaaaaaggttagaagagaaaaagttttcttctaaccttcttttttacgcttatttttaaaaatcgccgttcatgattgaatcttttacaatcatataatcgaccttccgaatagcttcaaggtcacgaccacccgagtaagagatggatgattgtaagtcttcctgcatttcggttaaagtgtctttgatggagccacggtaaggaacgagcatctgctttccttcaacatttcgataagcacctttttgaacctcagatgcagaaccccaatattgtttgtattgttttccatcaatgttgatgacatgtcctggtgattcgaggtgaccggcaagcattgagccaatcatcaccattgaagcgccaaaacggacagacttagcaatgtccccattatgtctaataccgccgtcagcgatgattggtttccgcgcggctttagcacaccaacgaatagcggataattgccaaccgccagtaccgaaaccagtctttagcttagtgatgcaggctttaccgggaccaaccccaaccttagtagcatccgccccagcattttcaaggtcgcgaacagcttcgggagttgcaacgttccccgcggttacaaaagtgtcgggaagtttttctttgatgtattggatcattttgatcacaaaatcagaatgaccatgggcaacatcaattgtaatatactctggatttaattgttcggattttagttgatcaataaaattatactcatcatccttaatcccgaccgaaatcgaagcaaataatcctttttcgtgcatcattttaacgaaagctgctcgtgtctctggattaaagcggtgcatcacgtaataatagtcattttggacaagccaaattgctaaatcttcatcgatgacgctctccatatttgcaggtacaacagggatcttgaatgtgtgagggccaaacttgacgcttgtatctgcatccttacggcttttgatcacacatttatttgggaccaactgaatatcatcataatcgaatgttttcattagggcagctcctttttaaaaatttaccgtaattattatgcgctaaaatatatgaagcgtcaatgaaaatagcgtacatttgctgagtaatatcaaaaaatagttcgataaactgttgacgacaatgaattaatccggtaaaatagcgaagtaaaaacgttaattttagaaagtataactatgaggtgaaaataaatgtcatcagttgttattgttggtagtcaatggggcgatgaaggaaagggtaagatgaccgattacctaagccaagaagcggacgttgttgttcgttcacaaggtggtaataatgcaggtcacacaattgcatttgatggtaagaagtttgccctccgtctagtgccatctgggatttttgctaaagacaagttagcggtgattggtaatggagtggttattaatccacctgcattattaaaggaattgcattatcttcaagacaacgggattgacatttcaggtttacggatttctagtcgttcacacatcaccttcccataccatattcttcttgataaatgtcaagaagaggcaaagggtgatcacaaggtgggaacgaccaagaatgggatcggtcctacctacatggataaggtttctcgtgttggtatccggatgtgtgacttacttgagaaagacacctttaaggaaaagcttgaacgtaacctcgctgaaaagaacgaattattcactaagttataccatgttgacccaattaactttgacgatatttttgaaagttactacgaatatggtcaagaattaaagcaatacgttactgatacagctcaaattgtcaatgatgcccttgatcaagataagaaggtcctctttgaaggtgcacaaggggttatgcttgatgttgaccaaggaacatatccatacgttactgcttctaacccaattgcggggggagtatgtactggtgttggcgttggtcctaacaagattgaaaccgttgttggaatttgcaaggcttactctacacgggttggtgctggtccattcccaaccgaattaactgatgagattggtgatcaaattcgtgaaacaggtcatgaatacggaacggttacgggtcggccacggcgcgttggttggtttgatagtgtcgcaatgcgtcatgcacggcgggtttcaggaattagttgtcttagccttaacttgcttgatgttttgactggcttgaagactgttaagatctgtacttcatacaaacttgatggtaagcaaattgattactacccagctagtttgaaggaacttgaacgctgtgaaccagtttatgaagaacttccaggatgggatgaagatattactggtgcaaagaagtttgaagacttaccaattaatgcacaaaactacttgaagcgggtaagtgaattatcagaatcaccacttgcaactgtttccgttggtgctgatcggattcaaacgattatcgttaaggatccgtgggaattagcacataaataaatagatgagagcttctaatgtttgaataatctttaagcattggaagctttttatttctcttggctcccctatggtataatcaaggcaaatacacgttataggaggcaagatgatgacacagccaacactaacagtagaaaaacattatttaaattggccacttaaccgtcctttaaatcaagctgacataatgcatgagttgggtgtgcatgcatccgatgaaaatggccaagatttaacgagtaaggtgatgatgaacctaactcaagtggatgttaacaaagtaggagaataccctgtgatgttaaatgtaatggataataacggacaaagtgcccaggcaagcattaccctaaatattcaaccgatgcggacacagaatgcacctaaggaaactgcaacgtccccaaagtcaagacggggatggttatgggttattatcgtaatcgtggttatcttatgtgcatggtgggcgatcagctctcataaccgacaagcggctaatcaagcggcaactgatagtcagcagagcagtcaaataagcaacaattcaagcagtatcagcgatttaacaaaagataatcaacgtcttgctagccaagttgcagaacttaaaggggcaacccaacaatatcagaaagaccatgatcaacaagcattagaaagccgacttgataagatccaaagtcaaatccaagacttgcaaaatcaagttcaaagtaacagcgtgaagcaagatttaaaccaagttaatgaaacagttaatgaagtacgggaaaacccagataatgggacgaaaattgtcaacaatctaaagaataaagacgactttcaagaaatttggggaaatattagccaagaagtccagaagtggttagacgagtttgctaattagtgagtttgacagcgacaagatagacccttaaaatggtaataataattagcgaggttccccgttaaattgttagggaaagactcaagtaaatgctggatccttccttagattagcggagggccttattcttttgaaagattttaaattaattaaggaagtgacatgatggctcatgagatcttagatggctcaagtatgcaacgtgcattgacccggattacttatgagattatcgaacaaaataagggtgtcgataacttagtatttgttggaattaagacgcgggggtatatttagcaaagcgcctcgccaagcgactaaatcagttggaaaatgtagaaattcctgtggcagcacttgacgtctctctttatcgtgatgatcgtcatgtaccagattatactcaagaaccaaccgtaaaaactgatcaattagatattgatattactaataaacatgttattttggttgatgatgtactcttcactggacggacagttcgggcggccttagatgccttaatggatatggggcggccaaaccgaatttcactagcggttcttgtcgatcggggacaccgtgaattaccaattcggccagattttgttggaaagaatatcccaacagcaatgaatgaaactgttcatgtagcagttgaagaatatgatggccatgaagatgtaacaatcgagcataattaaaagggaaacgagacaaaagcccctgtaagcaataaagacctctatcgttcggttttaccgatgatggaggtctttgttatactgcactatttacttcttatgggcgtaacctaatccttttatcttagctttcgccaccaatccaccgttgaatgctcattaaatacccgggtaccaaattttttctgaaaccatcggacttgtttgggcgtaaatccccgaaatactaatggtaattttttccagtgagaataaagagcatagagaagaaggatgtattgttctttactaatatcatctactggaatctcactaaccatggtcatcgaaatacctgttcccagagcagggaatgtatcgagactaattttgtagatgggattattactgatgttagtggtaaatactattaatgcttgtttttgtcgcggacgataaacttcttcaattcgcttattaatcttgtgaacttggcgtttagttggattgagaattatattacgcatatgaaacctctggtcgaacatttgtttagagaacagtatatcatacttagaaacagaataaatcatgtaagtcttttactgatataattttatttattctttccgttgtaattacactattcttattaatgcggtatgattggattagtgagttcagtattaatcgtgcaggacatctaatgcaaaactggtttgcaatttttggaatggtctttggtttcgtgattttaccgttaattttattctggttaacgcgtcgtgagcgagctgaaaatgacgaacgagtaaaataggagaatagaaaaaacgctcaatgactgcacaaatcattgaacgtattattttagggaataatagtagccgatatcgcacattatctgctactagtaaatgttaagtctaattgaggcgaataactaaaaaacaactattggcaccaccctagaagaaagaacaatttaactttgggagtttattaggatttttgtccttattaaaatgagaaaaagttaaggacactttagcagtcattaagtaataaaattgatctcttcacgaattgcttttgatgttaaagcttcaattcgatgatattttaccaagtaatttatcaatagttaatagttttacgagattatgcactcactgtgtacaagtgataccaagaatacactttgttctaacaagggtattattttactatatttttactaatcgtttatattaagataatatagtttggagtttatataggagaaaaaagatggatattcgtaaaattaatatgttaaatggaattaaggaaggatttattactgttttagatactaaaaaattatcagaatgtactactaatgatattgtaaatagcgctgaaattagtaaaaaactttctacaactattaccaaaataaacaagatcttctccatgaaattgaaaatgatctattgggaggtctaaaagaagctctcgtaattgatcgggaggagctaaaagatgtcaagcatttaccaagtgcagacgaaattaaggaattagcagaagtggcatttaatcatacgttggctttttgtaatgaaaataagcatgcgttgtcaaatttgctttcctcaaatggagatatgcagttttatcaaatgattattgaagtagcaaataatgaatttgatgcgcgagttccatatttgtttggggatataaatattaaagaagctaatgtaaaatcgtcattgccattctcatttattaaaaccctctatatcaatacaattgttaatttgttaatgctttggggtgccgcaccagactctttaagcattaatgaaattaagtcaattgcaggcttgattcaaacaaaatcaccagttgaattgattcaaatttataaatcatatttaaactagaaaatgaggagccgaaaattttttctcggtctcctcatttttattatcaaaaattctttttaaattaattgcccttccaataacgtgcccgggtaagcagttcccgtgaacgctggtcagctggtcgataacccttagtaaataggtgtcggaagtacatcatattatagaaaaagccaaagaaaacagaaggccatgggaattggaacagggcattaagtccaaagaaaagggctaccaaagcataatcgagggttaatacaatcattaaaatgaaattatagtaatccgcgcgaaaaagagctggcagtggcccgaaccaaagagttgtccaagaaaagccgactttggcgattcggatatcccctggtcattaacgattttagcgtaatttggtgggagggggagattgtttaagttaaacggattttggttatcattattgttattaccaaatgggttttgcatatctcgtccacttctttctataaataataatattaacacattgagtgagggataggaaacgtctctatcaggctttcaaggaatgttaacaattatatggtaaactcaaagcgataaccatgaaagggggaatcaaggatgctttttttcctaaacgataatattcaacgaaacaaatcaggaattgagcatgcgcaaattaagcgtctgcatctgtttgaaaaatatcatcaaccagctaagattgttacccggcaatattcgaatgaattacacttggtaacagcagaagcagggattgatgatcgtaactttattaacttgtttgattattttcaggaggcttgtgaggtcccgcaaaagaatattcggattaaagatattccggttaacccccattgggagcacaaggctgatgggattaattataattattatcaaaatggcaaacgtattctctatattcgtcggcgcagtgatactgatcggcgggtaattaatattcaatattttgatcattatggaaagcttctcaaagttagttggtttgacagccgcggttttatctcggtcgaacaactttatgactgggatggaaaaatggcaacggaaaactattaccgtccagatggaaccttagcaatccagctagcccaccagcatgataagcggggaagggaaattaaaacttaccatctttttaattaccatggtcgtgattatcaattcagtggctttgaccagttaacccggtttttcctcgatgagttggtcactgacaagcaaatctgtggtgaaggtccggttggctttgtcgttgaccgagtttatgaactaggctgggcagttctgcacatgaagcaccgggtttttcgggttcttcaactgcataatgaccatgttaataatcctgatgatatgcttcattctacccttaattataactatgattggggacttaagcacctccaagattgggatggggtcattgccttaactccgcaacaacaagaagatcttcaagatcggtttggcaagtttggtgtaaagatctaccggattcctggtccgattgttcctgcggcagttattgataagcatcatgttccttttaaaaagcgaacgaaaaaacaagttgtcatggttgctcgcttgtctcccgaaaaacagcaagatcacctattgaaagcatggccacaagtactagccgctgttccagatgccaagctcgatttttggggatacgctaatgatgattttgataagacgctcaataaaattgtcaaagaggaagcgattaatagttctgtgaccttccatgggtatacagataacgtcaattcggtttacgaagatgcgcaattactcattttgccaagtcgggctgaagggttaccactatctttagtggaagctcagtcccatgggttgccgattattgctaatgacataaaatatggtccttcagatgtcgttattgatcaacaggatggattgctgaccaagaacggtgatattgatggacttgctcaagcgatcattcgcttattgcgagatcaagagcaattagcgcagatgagtgaaaatgcttatgctgatagtgagcgttattctgaaccaaacgtgatgaagttatggaatgaattggttgctgacatgaaggaaaagggggaagagtaaagtgtacttttttgtaaaccaatacttattaagtagcaactccagtgttgaacatgctgaattaaaacgactagccctatttaaaaagcatggtggagaagctaaattggtgacccgtgacttcgacctcgttcttcatgataccatcaaaaaatttggtttaactaacgaccaaattgttaatatgtatgacttttttgcaaacacgactgattaccaaggcaaaaagctccatactgaggatttacctttaccaattgactatcaagtaggaactggaaataactatcgcgaagtaaaagatggtgaccgccttgtttgcgaagttcactttgcggctggaacgattgggcaagttaaccatgttgattactttgatcttgctggtaatatgactcttcgccaacaatatgatattcgtggttttaaggcagctgacgaattttttggtgaagatggacaggaatactatgcgcgttattaccgccccaatggagaagcgtatcttgaacggtattttgtaaaatcggttgaaaataccccaattaattcgctgaatgtcttacgtaattatcaggggcaagatcgcttctttgattctttagaagacctctttattttctttttggatgaattgaataaggcaaatggtgaggataatgtgtttattgctgaccgaccagctgttgcgattaaaccggttcaatcaatgatgacaaaagcaaagaaatttttgtggcttccgatgaaccaggttaacgatggtcagaacttaataaatggtcccttaaatccgatgttgcaaggtcctgttactacggatgcggacaagtgggatggtgtaatcgtcatgactgctaaacaagcggagattctccagcaacaaattcacaatgctgtaccaatctatgtaattaatgggacccccgttcttgctaactatgcgcggattaatgaagctgatcggacaccgggtcaattgatttacgttggaagattggcagaagataagcaaactagtcaactaatcaatatgtttgcgcagattcatcagcaagtatctgaaagtaagctaactttctatgggtatggcactggtgaagatatggataactataaaaaacaggttaaaagccttggattagatgggtcaattgagtttgctggttaccagatatcattagatgaggcatatgatcaagctcaattatttgttgatgcaagtcgaatcgatgcacagccattagcgatgggcgaggccttaaaccatggggtaccagttgtttcctatgattacctttatggaccacgtgaaatggtaatttcaggtaaaaatggtgagatcattcctttaaataaccagggacagtttattcaaaccgtcgtcaaattattacaagaccgagatgaactgcaaagcttaagtactggtgcctatgacaatctagatgaattggtagaagaaaaaacttggaagcaatggcaacaactatcagctatttagtcaaaattggttataatatattcagaagacgaaaagcagaaaataatcaaatgtttttgaagcctttggtcgttatcctttgataatctaaagacggaaaatgagggcggaatgatggataattatcaagcaatgaatttttactatggacttcttaatttgcgtgccggtttttttaaggctgacttatgcgaaatactaatggcgatcgcacagagcgtacctgataaaaatcaacaatcagcaacggcataccatactgtagaagagaatttgagccaagaccataagcaattaaatcgtgatcaagttgcatttgggtcattttatgaagatggtcatattttacataatgtcaaaattaatacccaatcagactttttcctcgatccgacccgggaagatactgtcaagtggcatgttagttttacggttgctaaaaatgtccgtccggccgatcaatttattgttcaactatcgccaaatttgatggttgcgcctaatggtcatcctgaaaagccaattcctgattttagtgatcaaaatgggactgttattgcaatgggagcttatgaccaggataagcacgaacttgtctatgcttttaccaattacgtaaccgagcatcgacaaataattggtgaattagagggagaattagcagttgatcctctaacgactccagagaacgaatttggcttggaatgttttataagtgttgatgattaccgaaaagactttacgattgatatcgactatccagatcttgctaacgacatgtttctcgggatttctagccggatgatgcattttgataaggatcagcagctttttgaggacattatctatgttaatccagcacaaaaagaccttaatcatgcctatattgtctttaatacgagtgatctagtggaagaattatctaatgccatcgtcaaaccgtcaacaatgcggattgagatttatcgtaattcacggggattaaaattacctcaatcatatggggtaaactttcagcgactaagggatattactaatcgattcccggtagtggaaggcgatcaccttgtcgagacaccttatacaatgtcctttgctgataacaagatgcgattgaattttggcgccgatcacacgaatgattcctatattattagggtaattggccaatataatggtgaacttgatggaacagtacgattgcgggctcgtttatttgggatggaccagcaaaatgtttatatgagtaattctactgctgcaacagctgctggaacttcaatgatcgcaagggggcatgctatttctaaggagaagttagcggaggagacagcggacacaacagaagatttgaagcaagacgaacattttgtcaatgtggaagaacctcttgaatctacagcagttgaagaagtgcgagaagaagctgatattccatctgcttctgatggtcaagaacaatttcctagttctcaagcggaagaagatgaaacgccaatcgaagaaaagcaggcggaagctcctgcagttagtggagcagtcggcggggatgaattatcaatctcctttgacgtcactcctcaaacggcaccggcagaggttatagaagaagctgaatcttcagatgacaaagaggagcttactatatctgaagaatccgcagtgtctgagtctgctgttgaaattaaagttagtgaagaggagacaagcgcagcacccctaccaatgccgggacgacgaccaccgcgccggcacagtcgttttcaaaatacaatccggtcgaatcattcgttgcgtcatttgcggagattctaatagaaaaaataaagtgtcaggagagattatcctggcattttatttttaccgaaatgtaatcgcttacataaaatgcttgcaattaaaaataaaggtgttaacatttaattgaagccaagtaaacgtttacattaatggataaagggaaaagtgtagtagttttatggagagaggttttattttatggaaaataatcattggtggaataaatcagttgtttatcaaatttatccaaaaagttttcaagataccaatcatgatggtgtcggtgaccttcgtggaataattgatcgtctcgattacattaaggaattaggcgtcgatgtcatttggttgaaccccatttataagtcaccacaagttgataatggttatgatatcagcaactatgaagcaattaacccgactcttggcaacatggatgattttcaagaattgatcgattgcgttcatgaacgtggaatgaaattggtcatggacttagtagttaaccatacttctgaccaacatgactggtttaaggaatcacgaaagggcaaagacaatccatatcgtgattattatatttggcgtgacggtaagaagggtgaagagccaaataattggggttcctacttctctggcgctgcttggaaatatgatgatgaatccggccaatattaccttcatctttttgctccagaacaaccagacctaaattgggaaaatccgaaagttcggcactctgtttatgacatgatgaactggtgggctgccaagggtgtcgatggttttcggatggacgttattaacctaatttctaagccggatggattgcctgatgctaacaagaacgaagacgagaaatacgccaatgttgaaccgttagtatcaaatggtcatcgcattcatgaattcttacaagaaatgaataagaatgttatgagtaagcataagatggtgacagttggtgaaacaccgggcgctacaccggaagatgccgagaagtatgccagtcttgataataaagaattaaatatgattttccaatttgaacatatgggccttgatagtaatcctaatccagcccttggcaagtgggatgatcgcaagacgacccttaaagacttacgggcaaacttaacgaagtggcaagaaaaattgtatggtaaggcatggaattcactttattggaacaaccatgatcagccacgcgttgtatcacgttttggtaatgatcagacggaagattaccgggttaaatctgccaagatgttagcgactatgacccacatgatgcaaggaacaccatatatctatgaaggggaagaaattggcatgactaacgcctatttcccaaagcttgaagattacgtcgaccttgaatcgattaatgcctatcaccaacttgttgatgaccaacatttacttgatggcaagacaatgatgaagtacattgcgatccattcacgtgataatgcgcggacaccaatgcaatgggatgatagcgaatatgcaggattttccgaccataccccatggaaaaaggttaatccaaattataagcagattaatgtcaaaaacgcattagctgataagaattcgattttctattactatcaaaagttgattgaactacgacacacgatgccagtaattactaatggaaagtatgcattagttcctggtaatgaagatgatgaacaggtctttgcatatactcggcaagatgatgacactactttgttggtaatcttgaactatactgatgagactgttaaccgccattataatgtgccagctgatgcgaagttactaattagcaattatgaggatgatcaaaatggcactatccggccatacgaagctaaggtttatcaatactagagtggggatgaataatcatggataaatcacgttcgaattcgaaacaaaaagttgaaacgaagcaggttgatctggatacagggatgccagatttgccaaagaaagagctatttgcgattacatttgcttttctgggaataaacatggctttctcactgcagagttcccagatgagtcggatttgtcaaacgattggggcaaatcctaacaatctaggtttcttcttcatttttccaccattgatggggatgattgtacaaccgattatgggaaagatgtcagatcggacatggaatcgctttggtcgtcggttgccctacctattatttgggactccaattgcggcattagttttgatcatgctaccgttctccggttcacttggcttcggctatggttcaatggctgcgatgatttatgctgcggcagcggtatgtttgatggatttatttagtaatatttgtatgcagccatcacggatgattgttggtgacatggttaataacaagcagaagaactttgcttggtcatggcaacaggtcttttctaatggtgggggaattttagcaacgatcttaccatttatctttacgatgttcggaatgtccaatactgcaaaacgaggggtagtgccaaataccgttatctggtcatacctttgtgcagcggcggttctcctgtttactggactatggacggtctttaatgttaaggaatatgatccggaaacatatgcaaaataccaccacattgatcccgaagaacaaaataagtcagtcagcctttggaaattaatcaagacggcaccgcgcgctttctgggaaatcaacttggttcaattgtttagctggtttgcgatcatgtacgtttggacatacacgactggaacctgtgctcgtaatatttggcatacgtctgatgttacttctgctggttatcaagctgccggtaactggtatgggattttaactgctgtttatagtattgctggtattgtttggggattaatttatgcccatgccaaggctggctcacggaagaggtggtacacatttgggatgatcgtcggtggtttagggttagtctggatgacctttgtcacaactaagactacttcaatcattgcaatgatcatgtttggaattggtaacttcagtatcaacacgattccatttaccctcctcacttcatctttaaacggtaaaaacgaaggtgcctacctcggactcttcaacgttggaatctgtgtaccgcaaattgttgcatcgttatgtagcttcttcctcttcccacttgttggtcacaatcaaccaatgatgcttttgcttggtggcatctccctccttattggggctttagctgtccaagcaattcatgaaggggtaactgttaaagaagtgtagcgctaattaaatctctccttaatataaaatagttaaaataaaagcgggactggaaatttatccggtctcgcttttgcaatctatttaattgtgatggcttccaaagattgatcttctttaacgtgcagcaacgcattgactgtatcaagtgaagtcatgaggggaacattttgcgcgattgtactttggcggatctgaaagccaagtgaatcttgttcataatcatggcgcatagtgttgataacaagatcgatttgcccggcttttaagagtcggttgagttcatcaatgttagatattttttgatggacgtgaatgccgttatccttaaagtgcgatgctgtttgtggggtagtgaaaatttggtagccaatctgagcgaaccgttttgctagtgggagaatgtcttcttcatccccattttcaatcgtaaagagaattttgccattgttagggacttgaacgtgtgctccagaaaaggctttatgaagtgctttttcataggtggtatctgtccccatcacttcgcctgtcgatttcatttctggactgagataagaatcaacgttcgctaacttgttaaaactaaagacaggagctttaacatgaatggtttgtggttctggataaagaccgttagtaaaaccttgatcagcaagtgactggccaaggataactctggtagcaacttgggccatttcgattcccgtaatcttgctgaggaatggcactgttcgactagctcgcggattaacttcaaggatgtacacttcacgattatgaacaataaattggatgttcatgatgccaatacatttaagagcaactgctaatttttcggtagcagtaacgatttgttgtttaatgtcatcatcaaaatgttgtgggggataaactgccattgaatctcccgagtgaacgcccgcatgttcaatatgttccataattccagggataaggacgtcttttccatcgcaaattgcgtctacttcacattcccgtccttcaaggtaggcatcgattaaaatagggtgatcagcagtaatggaggcgttttgttgaaggtattgttgcagttcttcttgattataaacagtctccatggccttaccaccgagaacataacttggacgaacaagaacgggatagccgatttttttagccgctttgataacggcagagtgagtagttgcggttaaaccgattggctgcttaagatttagatcagtgataactttatcgaatacttctcgatcttcagcagcatcaaggtcgtcaacggttgttccaagaatattaaccccatttttagcaataccttctgctaaattaatcgctgtttgtccaccaaattgcacgatcacgcctactggttgttcgagatcaatcacgtttaggacatcttcaagcgtgaggggctcgaaatagagtttatctgagaccgagaaatctgtcgaaacagtttctggatttgaattgatgacaattgcttcataaccagcccgttgaattgccttaacgctatgaacggtcgcatagtcaaactcaactccttgaccgatccggattggccctgaaccaaggacaaggatagatggcttctttgtccgttggctttcattttcatggtcatatgcgctgtagaaataaggggttgaagaagtaaattcagcagcacaggtatcgatcatcttatatacggggagaatttcattctgttttcggaatttccgaacttcttgtggggaagtatgccaaaggcgggcaattgttacatcgctaaagccatattttttgctgattatcagtgtttctgcatcaaatggcttggtactaagatcgtcttcaagttccaccaagtgtttgacgatatcgaggaaatagggggaaatcttagttaagtcatgagtttgcttaagggaatatccacgccgaaatgcttctgctaaataaaataaccgatcatcttggggataacgtaacttcttttcaagcatatctgttggcgcatgatgagcttctgctgaaaagaggtctttttcatcaatttcgagtgaacgaacagccttatggagagcttcctcaactgtccgaccaattgccattacttctcccgtggctttcatctggctgcccaggtgtcgatcagcctgagtaaacttatcaaacggccagcggggaattttgcagacaacatagtcaagtgccggttcaaattcagcaaaagttgtcttggtaacgggattcttaatttcatcgagggtaaggccaaccgcaattttagcagccattttagcgattggataaccggttgccttggaagcaagggcagatgaacgggaaacccgcggattaacttcgataacgttatactggaaactttgcggatcaagagctagttggacgttacatcccccttcgattttgagggcacggatcagcttgagcgcgcaatcacggagcatctgatattcgcagtcgctaagggtctgattaggggcaaatacaatggagtcaccggtatgaattcccactgggtcaaagttttccatacaacaaacgaccattacattgtcagctgaatcccgcattacttcaaactcgatttccttataacccgcgattgacttttcaattaaacattgggtgacaggggataattccaagccattcttggcaacagtacgcatttctgcatcattatggcagatcccgccacctgtaccacccatagtaaaggcgggacggacgattactggatatccgcattggtgtgcgaattcgactgcttcatcaacagtattaactgtctgtgaagccggaacaggttcaccaagctcattcattaattccttgaatttttcacggtcttctgcttcatcaatcgaatccagcttagttccgagaagttcaattcctaattcgtcgaggagaccagttttagataaggagacagctaagttgaggccgatttgtccgccaagggttggtaaaattgcatcaggatattcttgacggataattcgagagagggagtcaaccgttaatggttcgatgtagacatgatcagcaatttccttatcagtcatgattgttgctggattagaattaacaaggatggtttcgtatccttcttcgcggagggcaagacaagcctgcgtgccggaataatcaaattcagctgcttggccaataataatagggccagatccgatgacgagaattttatgaatatcagttcgtttaggcataggtgagggcctccttattactgtcaattaatgccatgaatttatcaaaaagctgttcagcatcgtggggtcctggcgcagcgtctggatggaactgaacggaaaatgcaggatactttgaatgctggagtccttcaactgtgccatcgttcacttcaaggtgggtgatttggaggtcagtatcatcaatggaggatggatcaaccgcaaaaccgtgattttgagaggtaaatgcgatttttcctgttttaagattacggacaggatggttaaaaccgcggtgaccaaatttcatcttataagttttagcaccattagctagggcaaagatttgatggcccatgcaaatgccgaaaatgggcacatgtttttctaattctgcgacagtttccgcaatagttgtcatttcaagtggatcaccagggccgttcgaaaggaggatgccgtctggattgaacgccattatttcactgatcgaggcgttataaggaaggacaattgcattgcagtttcttttatttaattcacggagaatgctatttttcattccgaagtcaagaacaactacagttcgcttagttcccggattagcgtaggattctttagtagatactttgctaataatgttctgggttggcgaagtttgttttaactgttcaagcttatctttgatatcggtaacattatcggtcataattccgcgcaatgttccatattgacgaagcttacggactagttcacgtgtatcaattccttggaggccaggaatgtggtgctttgctaagaaattagggagcgagtcagtcatgcgccagttgctgggaacacgagcgacatgatgacaaattatgcccttgatttggggatacaatgtttcgttatcttcactattaatcccatagttaccgatgagaggattggtaaagactaaaatctgattggcaaatgattgatcggtaattgcttcttgatagccgaccatccctgttgtgaagacaacctcaccaagagttgccttggtagcgccaaaaccctcgccggtatagacagtaccatcttctagaattaaatatcgtttcatgagtttcatcctttcttgcaaaacccttccactgatcacataaactagttgcacgttgtaaaaaagtttaataaaaaacgcttaaaccattggtaatgggcttaagcgtatacgaaaaattgaatatatatgtataattcaatgttagtaatacaacgctgcccttgttagcctcacgggaccaaattaaaggataatgattgatactaaactactgtaattttatgcttttgtcaagtcactaatgaatttttatgcaaaaacatgtttattataaacaaaaaactgcataaaggattttaggtattataacaaattttatttaaaataaaagtaaagtctgcaaattttgtctgcaaactctacttttttagaataattaggcttggtaagtttccttgataaagagaactgaaattgcacctaagagagcagaaataccggtaacaagcatcatgttgacttgggaactaccaagtaatgggaagagaccaaaactaagtagtgaggcaaccatttgtggtacacagattgaaccattaaataggccaaggtaagtacccatgtgtttaccagataaggcatttgtaaccattgttaatgggtaggtgttcattgaagcccaagcaattccgatcaaaacgaaggagaagataagggcgttttgtgaatggataaagaagattgatgtgtatccaacagccccaagcaaaagactgaaagcatagccagctttgtggtggttattaggaactttagccagaacatatgaccatacaactgctgcaattgattgaacagcggtcataacaccgtaccagttaccggcagcttggtaggcagcagaagaagcatccgttgttaaccaaacattcttagcgatggccccgaccgcataagttgaaaggtattggaaagagaaccagcagaagaattgaactaatgcgacattccaaaatactcgtggagcatgctttaagagggtaaaccagtttccaccttttttattgtcttcctctgaaataccatggtaacgagcataagttgcgggatcatattcgtgaacccggaagatagtaaagagacaggtgatgactaaaataacagcgccaacgtagaacgaaattacaactgattgaggaacaacaccctttttagcagtgtttgatataccccaccatgtcaaaaggaatgggaaaatggctgctaaaacggcaccggtattacagattaaactttgaatcccgtatgcataactcttttgatcatcgttaaccatatcaccaaccatcatcttaaatggctgcatcgccatatttgatgaaagatcaaggaaggcgacggtaatagccccaaaccagagggctgctaacgaaccgtatccaaatccaaaacttcctgaattaggcagtaaaatcataacgatgacggcaatgaccatcccgattaacaggtaggggagacgccgaccaccaagttttggcgcccatgttcggtcagaataataaccaatgattggctgcacgatcaatcctgcaagtggcggaagtaagaagaaccatcccaaattattaggattagcaccaattgtttggaagatccggctcatttgtgaaccttgtaacgtaaaggcgatttgaaccccaaggaaaccaaagttaatcatccagatggtactctttggtaaaattggcaatccactcgtcgaagtttcttggtcttggttaagtacgacagactcatcttgactcatgaaaaacaactcctaacgaaaaaatgtataaaataattgcaattcgagcttgtgtaagctcttacacgaataatataacaaacttatttcatttgtgcaaccgcttgcaaaaaagaatagtaaaaagtcgtgatctgtttcaataaaaagatcacgactttttaatgctctaatgtttcttgcctaggagtcttacgctatttcgcggtgtgatatggattggaataaattgtgagtcatcatcgttcaataggctcctaactgcgatgagtcccatttgataaaagtcctgagttacgcttgtaatagttgggatggtaatatcacagagaaaagtcccatcgatactaataaatgataggtcttttggaatatcaaggcctagcaaatgagcctctctgatcatgcccacagccaccatatcactagctgtgatgatcgcgtcaagattcttattcattagtgttttgagcatattttgctgaggaccaaaactgtaatccccatattcgacccatcccatatgagggattaatccgtgttcagtcattgcccgttggtagccttgaagtcgttgcttaccggttgaagaacgatcgatgccggctaatccaatccgtgagtgtcctcgttcaattaaatagttagcggctgaataaccaatttcctcgttatttgaacttgtaaatttaaatccaatatatcgggaatcagtttcgtcatagaccgatactaaccgacaaggggtattgctttcttgtaaggtgcgagctgcttgttcgtcgagggaggttgcgactagcagaatgccggcaacatgccgttcgagggcaacgctaattgcttgattaagcagtcgggcgttatggtttccagcgtaaagaataaacatttggtaaccagctttatctgtttctgcttgaatagcagcgatgatatcatttgagaaattcgtttgagtattatttaagataacggcaattaacatactactattggcagctaattcagccgctgcaaggtttttcttgtatcctagttctttagcgattgtttcaatcttagccgcggtttcgggacggtaggatttcgcctttttggataaaacacgagaaacagtggccgttgaaacgtgggcccgttgagcaatatctttaattgttggcttcatagacggacttcctttattgttttcttattaaacctattataatgaaattgcgattttttgtaaacgctttcaatgggggcttaatcattatttaaaacaaaaataggccgaaagaaaaattcttccagcctacatagctattctttatttccgtttcgtaatgataatttcacgactgcctcacagcgtgctgtttggggcatcatgtcaattggttgaatgtagtcaacgtgatagacactagttaaccgccgtaaattacgggcaagagaagccataccacatgagacgtaggcaaactttcgcggcttaacttttaagatttgcttgattaattggtcatctaacccggttcgcggaggatcaacaacaagggcatcaaagttgagtccttctttttgccagcggggaagaacttcttctgctttgccgacttcatatttagcgttagtaatattatttagcttggcattttcgttagcatcagccaccgcttcggggatgatttccattccgcaaacagattttacccgcgatgcaagtgaaaggccgattgtcccgatcccggcatatgcatcaattaaggtatcatctttgtccaattcaagggctttagaagcttcttcgtacagcacttctgtttgttcaggatttagttgtaagaatgaacgtgctgagagtttgaaatcgagtcccatcaagctttcaaggattgaatcttttccagcgaggtggatcattttatcaccccaaattaagggtgtatcacctgggttaacgttttgcataactgaaacaactgctggtagttctttttcaatgcgttcaagcaattcgcgtttgtgaggaagtttagcagaattagtaatgaaggttaattggacttccccagttgaccatgattcacggactgctaaggttttgatgataccgctattgttcttttcatcataaactgggatttgcaagtcttcgatcatcttcgtaactgctcgaactgtctccattgtacggggcatttgaacagcacaagtctccatatcaacgagggtatgactgtttggctggtaaagaccggctgctactttgccattgaccattcggatttgaaactgggccttgttacggtaaccgtattcttcaggggctgcaatagttgggcgaacatcgtaattacggtagccgtatggttgaaacttttcgagactatcgatgattacttgccgtttaaactttaattgttgttggtaagcgaggttttcaagttcaaaaccaccagcgatatcagcgtactcatctcgtggcgttacccgatcccgactctttttccggatccggtgaattttagcttcaagatagcgtgggagaacgcgtgtaacttccgcgactacgacttcatttggcagggcaccagggacaaaacataccttgtgcttatagtagccgattccgtgcccgttaacgcctaggcgacgaattgtgagggggaatcgtttcccaacccatacatcaacatcttgttcatgttgtttagtttgtgtcatattatttctccgttctattaattcaatgtgttgactattttagcacatctccaaataccactggacaaatatgtcagagatgaaaaatcgcgtaattaattttcggaatgataacttagccaaacttatagtcaattattatggaaatagtcaattaagtgtgcatattactaataatatgttttttgaatgagtaaaattatagtagaataacaatgtgaaatgttgcataaataacttaaaggaagtgacacgtttgaaaattgctgcaattgccgggtcaaatgctaatcattcatacaaccggatgttattagaatttattgcccgtcattttagtgatgatgatattgatgtgattgatattcgtcaagtgccaatgtttaatgaaaattataagggaaagattcctgaggctgttgctgatattgatcgtcgtgtttcaagcgccgatgctgttatcattgccagcccagaatacaaccactctgttacctctgctttaaagtgtgtaattgaatggctttcctatgaagttcatccattagaaaataagccagtcatgatcatcggtgcttctacccatgaccaaggctcatcccgttctcaagttcaattacgagatattttaatctcaccaggtgttaatgcttatattttccaaaacgaagagttctttatgagtgatgccgctaatatcattgataaagatggtgacattactaacgaaacgactattcatttcttagaaaaatgtatgcgtgaattcaaacactacgccaaggcaatcaatcgtatggttgctgaaaagaaggaggcgaagaagtaatgaaaatccttgctttagttggaactaatgccaatttctcatataaccggattttgcttaaatacatgaaaaagcacttccgtcaaatggctgatattgaaattgctgaaattagccaattgccaccatttagcgttgatacccctctttctgaacaaacagaggtatggaagttaaagcaaaaagttaaggctgcagacggagttattttctcaactcctgaatatgaccatgggattccagcagccttaaagagtacagtagaatggctttcttacaagactgatgtattaaaacgcaagccagttatggttgtcggtgtatcttatggacgccaagcttctgcaagatctcaagttcaaatgcggcagattctggtttctcctgattgtgatgctaacctattaccaggaaatgaagttctgattggtaatgctagtcattccttctccaaagacggtcggttaattaatgccgaagcacgtgataaccttgaaaactgctttacccattttgtggaatacattcaaatctttgaaaatgcaaataaggagggactggatatgtccgttaaacaaccaacgatcagtgaagcttacattaatttccctactggtcggttgacattaaaagaagttcaacaaatcttcagtacaatcccatttgaaattgacttaattgacagtactgaccatttcgcatggttctctgacaagccaaatcgggaacacgttcggaatgtagcttctctcggggaaactgttcaagaatgtcatccaccgttggctgttccggttgttatgaagattattaacagtttccggaatggtgaaaaagacgttgttacccgtccattatggatgaatggtcaccgttcattgattcaatactacgctttacgtgatgttaatggtcattaccttggaaccatcgaatttactggtagtgtggaatacattcttaacctcttcgaaaatggtgcatggagtactgatggtaacactggtgcatctaagcatgaggatgctaatgacaacagtgaagaagctgacagcgttgatgcatcaactggtgcttcagaatcaagtgatgatgataacaccgacaatgctagtgaagtggttacaaccccagcaccagcaacaaacgatgatactgatgcggacgctacaacaggcgtatcagatgcaggcagcgtagacgcaaatgatgatgaggcagatgctacaacaggtgcatccgaaaactagttatgaataatgaattgatggcgcagcggcatgtgatgactcatcacgctctcggaactcgcataaatttaacgatttttggcaacaaatacttttcattgttaaagaaatcaatggacctaattgaccactatgaggaccgattaacggttaaccgtaatgaatcagaagtgatgtcggtgaaccatggtgcagggaaaactccgaaaatggtatcgccaacgacttttgacctcattgagctggcagtgaaatatagtcgtgaaaactttggctttaacgctttgattggcccgttagtaaaattatggaaaatcggttttgcaggggcgcacgtgccaagtgatgctgagatcaaagagcggttgaagttgatcgacccttataaagtattgctgaaccgagaagcacggacggtatatttagaagagccggggatggaattagaccttggcggaattgcgaagggctatattgcggaccgtattcgggatctttggattgaagctggagttcccgcgggaattatcgacttaggggggaatctcttatttgttggtaagtcgccacggcgggatgatgggcagtggatcatcggtgtgcaggatccgcaactgcatcgaggtgaaaatttggcaactgtccgcgaaccggcttgttcggcagttacatctgggatttatgaacgatttttgatcaaaaatggtcgtcgttatcaccatttactagatcctcggactggatacccattagagactgatttgagcagtgtgactgttttcactgatcaatcggtaatgggtgaaattgaggctaagcgactcttcttcaatggtgaaccaatcacaggctgggaagtgcgtcctggtaaccgtggcgctatctttattcataatgatgaatcaatggtaaacgttgggctgaataaaaattgatttcatttaagcgtaggtaaacgaaatgtttacctacgcttttttgttaatgcctttagacctggttgagtgcgcgagcagagcgagtgcacgaaacaaaaaaacacctgctatgcgggtgggcgataaaaattatataaaaaaggcctcttttgccttaagatgtaggtgttcaagccaaagccaataagggaaaagaggttatataaatatggctaataaattaaatagcttagcccatacgaagtggttatgtaagtatcacatcgtattcataccaaagtatagacgtaaagcgatcttcaatcaataccgaacccgagagattatattcgtttattgtgcaaatataagagagtagaaataattgaaggtcatatgatgccagatcatgtgcacttgttagtaagtattccgccgaagctaagtgtctcgtagtttatgggatacttaaaagggaaaagtgcattaatgatgtttgatcgacatgcaaacttaaaatacaaatatgggaaccgacattttttggctgaaggctactatgtgattacagttggattaaatgaatccacgataaagaagtatatccgagatcaagagaaacgtgatatatcaatggataagctaacaagtgtggaatattcggacccttttaagggtaagtgaggtagtacaaacaccgcttaaagcggtggcaaagtagtcagagcattttggcttgagcaaagcgaaagccagcgccttgagacgccggcttttattatcggcttatagccgatgtgcaaaccacccgtttgacgggtggttatgatttgtgtgcgcctggcatggatattagctaggcggtgaaagtccgctatgggccgtagtagtcggaaccatgagctgatgacaagggtgttcattgtgaagtagaatctgaaggaagtctaaggcaaagtactgcaccgatgaataagaagtagctataaggctgaaggtaactggataaggttgcacaacaagctgaagtccaatactactcgaagttactctcagtaaagctaacggtgacatggtacgaaagttaatgttcttacccggggaggcctgacttacacgcttccgacaagaggaataagataaatttccacagaagcaagcggtagcccaagtattaacgcccatctttgagcagattttctcggatagtagctttggatttcgcccacatcgtggcgcccaagacgcaatagcgaaggtagttgatctttataatcatggttacaaacgtgttgttgacctagacttaaaagcctactttgacaacgtaaaccacgatttactgatgaaatacctccagcaatacattagtgaccgatggatattgagactaattcgtaagtttcttccgagcggagttctagatcatgggctttttgcgtgaagtgaaaaaggagcaccgcaaggtggaccgctctctccactattggcaaatatttatctaaatgagttggataaggaattgaccagacgtggtcaccaatttgtacgctatgcggacgactgtaaaagccaacgagcaggggaacgagtgatgcaaagcattacgcagttcctagaaagacgattaaaggtcaaagtaaatccagataaaagtaaagttggtagccctttaggcttctcattaggtgtaaaccagaatggtgcttacgcgcgaccagctaaagaatcacaaaggcgagttaaacacgcgttaaagcaattaaccaaacgtaatcgaggagtctcaattactagaatatttggggaaattcagcgaaaaatgtgtggatggctccaatactattcaattggtaaaataacagcgtttattcaacgattagactaatggttaaggacacgcatccgacaatacatctggaaacagtggaagaaatttaaaacaaaagtcactaacttaaagaagttaggcatgtcataccacgacgcgtataaattcgctagtacccgcaagggatactgacaaaccgcgcatagtaagacactaacttactctcttgaaaatgaaaaactggaacaactcggactaatgaatatgtccaagatgctctagtcaattcaatgtgattaagttgtcgaaccgccgtatacggaaccgtacgtacggtggtgtgagaggtcgataattgaactagtcaattatctcctactcgatttgacagattgataatgatcgaacgataaagaaaggcagaggagattggtacatatgatcattatttcatttataaaaagtgaataaaaaagagggtatgctgctttaatcttcctcaacggttgatataatagcattgaatgttaaattttctgatgataaatcagttgaaaaaaactgttaagagtgtagaatgacaattgaaagttattactaaaatgttgatattaaaagatggcgattaatcatcatttaattatcagctttttaataaaatgaagttttttaaattgctagtttagccacttgtttaataaaagattggttgtaacttgccagcaggtatcaccattcatctgatcgacagctacagatgaaatgccacctggtagtgatctttatggttgctatttatctcaaggagtactttaccttttatttataaaatggtttattgaatgacttaacttactccaaaagatagtggtaagtagtgccaggtggcttgggataatttcccttaaaactggcggatataggctattatgataacctaaaagaggcgacccccgatgcctatttaggctaattataatagtagctgtcgcttgactggatagtggtaaagccaagttattaagtgttaagcaacaatttttgtgcattgtttgttgcgactactactccctaatagatataaggtttatagccttatatagtaggtatcataaatggttgaacgctgtttagataaatttgtcaaacggtagaatgataatgcttataagaacccccgaatacttaactttaagcatgagtagcaatatctcccccagataacttaaaagtcttattgtctacgccaacagcaataagcagataacagtttagttttatcatataagtgtatttgctactaaaagttttttactgttcatgacaattgtgctaaacaacgattcaacagtacacctagtactagtgatacctgaaaagtcggcacagaaattacaacagtatggtaaatgtgctagcctactgtagtaagccgcttggtggtaggttttaaatgttgaatggtggatttatcaccaaagttagttgtgcgtaaactaaccaaaaattcaattgataaattaggaaaagtgtaataagataattgcaaaatagaaaacacgaatgcattttaagtaggttgttcagagaagcagcggatggtgagagctgtcgaccgaaactccggtgcaaaaatatgtgggcaggtaattctgcacggatagtagccgttatctacttcgaagggtgactaaagatagtcaaacttgggtggtaccgcggaactagagccatttcgtcccaaaatataaaggatggaatggctcttttttatataattaggaggaaatacgatgttagatattaaaaagattcgtcaagaacctgatttttataaggaaaagttagctacgcgtggtgtaaaaccagaagaaattgatgaagttattgcgttagataaaaagcgacgggaattgctccaacaaactgaaacaatgaaggcgcaacgtaatgaagcatcaaagaagattggagaagctaagcgtaatggtgaatctgccgatgctgccattaaggaaactcgtgaacttggtgataagatcaaggaattggacgctgaacttgaagtaaataatgctgaactccatgataagatggctcatcttccgaatgttcctcacgatggtgttccagttagtttaacggaagacggtgccgttgaattacggagagtgggtaaggttcgcgactttgattttgagcctaagcatcactgggatattggtgaaaatcttggtattttagactttgatcgcgctggtaaggtttctggtgcgcgttttgtctactacttagggcttggtgctcagcttgaacgagcagtttacaacttcatgcttgatgaacacatgaaggaaggatataccgaagtcttaccaccatatatcgtcaatgctgattcaatgtacggtactggtcaattccctaagttcaaagaaggagtttaccaagttaacggtgaggatatgactttgattccaactgctgaagttccattgactaattactaccgtggcgaagttatcccaactgaagaattaccagtttacgttactgctttaacaccatcattccgttctgaagcgggagcagcgggtcgtgatacccgaggattgatccggatgcaccaattcaataaggtagaaatggttaaatacactaagccagagaactcatgggatgaacttgaaaagatgacggctaacgctgaaaatatcttgaagaagttaaacttgccataccatgttattaccttaactactggtgacatgagctttactgcatctgaaacccatgatcttgaattgtggatgccagcacaaaataagtatcgtgaagtttcaagttgttcaaactgcttggacttccaggcacggcggatgcacacacaataccgggatgaaaatggtaagttacaatatgttcacacacttaacggttctggtttagccgttggtcggacagttgcagctatcttggaaaactatcaaaacgctgatggttccgtaacgattccagaagtattggtaccatacatgcatggtgttactaagattactaaggaaaatgcggttcctttccgtaataaagttaataaataagatatatagaagacagtttttaaaaagaagttcggattgctaaatctgagcttctttttttgattaaaaaaatctaagaaaaagtgaaaaataaataaattatacttaataaaattaacttatcgctggtcgctctctttaaaaattattgtttaaaacgctaacatcttggataaacacaaactttgatgaagaatatttattttgttttctagcgatgataaagtagtatcaacgttaaaatttgattaaaaaggagtcggtgcagatgcatagcagcaagataaaaaatatgatcatcaccattgttgcagttcttggaattgtagtggggtggcaaatggtcgagcctcagcaggtatctgctgccgaaccgacttatacgtttgcaactaataacacctttgaaccctttgaaattcaagatagtaaaggtgggtactcaggaaagaatcctgggattgaaattgaaatgcttaagaaaattgctaagcatgagcattttaagtatgaactgaagtcaatgagctttaatggtgacttacaagctcttgaagcaggacaagttgatgcagtaattgccggaatgagcgttactgatgaacgaaaagaaaagtatgatttttcaacaccttactatactagtggggttgttatggctgttgcaaaagatagcaatattaagtcgatgagccaattaaaaggcaaaacagtttcagctaagtcaggaacgagtgcggcattatttttgaagaacaaccaaaagaaatatggttacaaaattcgctactttgattcctcaaatacgatgtggaacgatgtgaagactgggaatacagcagctacttttgatgatggccctgttcttgaatacggaattaaagaaggtgtcccacttaaggttgtgacaaagaagccaattgatgcgcaaccagttgccgttggatatcaaaagggcaagaacttagaattacagaaaaaaatgaatgatgggatcaaatggctaaaagatactggtcaaatggatcaaatcattgataaatatactaagagtgacaaaacaacgaaggacagtgcgactgatcggacaatcctgggattaatccgcgccaattatcctgccttgcttcgtggattatggatgacaattgaattaaccgttgtcggcattatttttgcgatgatttttggggtaattttaggtgtattaggtattgcacaaaacaaatttgccaatgctgtttctagtaccctgatttatatcttccgtggtattccaatgattgttttagccttctttatttacatggggattccaaatgttattggccataaagttccattattcttggcaggaatcttaaccttgacttttaacgaaggggcctatattggagccattgttaaaggtggatttgaatccgttaatattggacagtgggaagcagcgcggagcttagggttgccatatagcaaagccttgattaaggttattgctccccaaggatttaagttaatgattccttcgttagttaaccagtttattattaccttgaaagatacttcaattctttccgcaatcggtgtaatggaacttacacaaacggggactgttatcatttcccagaacatggaaggatttaagatgtggttaattattgggacgatgtatatcattatcattaccctgttgacttggttatcaaactacgtacaaaagaggatggcttaatatggataaaaactataaagtacaagtaaaaaatctgcacaaaagttatggaagtaatgaagtgctgaagggtattagcttggacgtaaaacccaatgaggtggtttgcatgattgggccatcaggatcgggtaaaagtacctttcttcgttgcattaataagcttgaagaaccaaatagcggccatatttatattgatggctacgatattgctgatccgcaagtaaatattaataaggttcgggaaaatatcgggatggtttttcagcactttaatctctttccaaatatgaatgttttggagaatatcactttggcacctattcaacttggcaagatgaccaaggaagaggcagaaaaggacgcgatgcactatcttgacttagttgggctggctgataaagcgggggcagatccaaccaagctgtctggaggtcaaaagcaacgggtagccatcgcccgtgcccttgcaatgaaaccggatgtaatgctctttgatgaaccaacgagtgcccttgaccctgaaatggtagggatgttttggaagtaatgaaacggttagcgcaagaaggaatgaccatgatcgtggtaactcacgaaatgggatttgctaagcaagttgctgatcgggtggttttcttccataatggtgatattcgggaacaaggcaccccagaagagatttttgataatccacaacatccagatacgaagaatttcttggataaagtgctaaatatttaattatcgactgacttttagtaatttaaatttgacaaagctagaataatcattataataatgagtaacttctaataattggttgacagagaatctagcatttgctgaaagctggatccaattaaatggcatgagcgtttgaaatggagtagtttccttatcaaccgagaggtagtttgcaaatgtgagctataaagatgggtggaaccgcgttaaaaaacgtccctggtagatgattaccagggacgtttttatttgtttaagaaaacgtttttgttattaactaaatttttaaggaggcatattatggacgaaaaacaacaacagaagttagaacgatcgcttaaaagtcgtcatgtgacgatgattgctattggtggagctattgggaccggtctttttcttggatcaggaacagccattcaccaagcaggtccatcaatcattctttcatacctgatcgtcggtatcttttgcttctttatgatgcgggcgttaggggaacttattttagctgatacttcaaaacattcatttattgattcggttaaggaatatcttggtgaccgaatggaatttgttgctggatggatgtactgggcatgctggctaacattagcaatggcagatcttactgctactggtatttacttgaaatattggttccctaatttaccacaatgggttggtccattaattattgttattttattgatgttagtaaacatggtaaacgttgggctgtttggtgaactagaaagttggttctctatgattaaggtgattgcaattttagccttaatagcagttggcgcggtcttacttgtgatgcatggtcatgttgaaggacggccggtaactctttcaaacctagttaaccaggggggctttttctctactggtccgatgggcttcttaatgtctttccaaatggtagtttttgcctttgtgggaattgaaatggtcggtttgacagctggagaaactaagaatccagataaagatattccgaaggcgattaataccttaccagtccggattggtttattctatatcggatcaatgattgcgatgatgtcaatttacccatggttccatattaagactacttctagcccgtttgttcaagtgtttgcagcaatcggtgttccaggagcagctgcgattttaaactttgtggttttgacagctgcaatgtctgcaactaacagtgcgatctttagtactagtcgttccctctactcattagctcgaagcgggaacgcaccaaaacgttttggtgaattaagcgcgaaggcagttcctaatcatgcattaactttctcttcattgattctttttatcacagttatcttgaattatattatgccagcgggaatattcgatgtgattgctggaatttcaacaattacctttatttttacgtggatcattattttggttgcacatattaagttccgacaacaaaatcctaagggagttgcaaacttcagaatgccaggatatccgattactagttggttaacaattattttcttcttggcagttctagtgattttactctttattgattcaacacgaattccattaatcctttcaatcgtaatttttgcattgcttgcttatggttatggatttttgaagaagaaaaattaaaaacttggcagagactcgaaaattttgagtctcttttcttttgcatttgataatgaatagtttaagagagagctaaaaagtaatagaaaagaaggttttgtttaatagttggaggagatctaaatcccggtgtgacgcggtttaattgtatttttgttggggagggattatactgaaagtgtggaaagatagaaggccgaatttaacaaacatcttcttataataaaactactttgaagtacgttaattagactttttgcataaaaataccaacaccccactccacatgaaacgctttagtttccgtaaaaagtatgttagctaaaagtaattagtggctatatctacaacgaacctataatgataagcttaagttcctcgtattaagcagatagataagttaccaaaaattaaaaataataatactcggcctttcttcccacttcttcatggttgagaagcccggaatgttattttgataaacgtcccgggcttctgccagtttaacccctaaatattttatgttatttcctgggaaatactaaagttagtgaaactgtaaattacttctctaaatatttgaacatttgctcaattgattttaattgagtataatagagaaacttggcagaggcgacggaaagacacatagcaaagacgattcgccacgtgtaactttccgtttctttttactaacatatgataacgttttcatgagttctgaaaaaactttgtgaaattttaaaaagctgaaaagttaataaaataaatgaattgtaaaattataatttaaaaaatgataaaaattcacaaatcgtctacaaaacagcgctttacaggaaggaaatttaaagatattcttaagtagttaactcgccacaactgcaattatattatcttaatttggaacggctgttaacgaatattctatttaaggagggtacacagccatgtctatgtatcttattatcaacattattgggttgattgtctttcttggaattggatggcttttctccaagaatcgaaaggaaatcaactggaagactgtaggaatcatggtagtattgaacttacttttagcatggttcctagtaagttcagcagctggtcgtgctggggttaaagcggccgctgatggttttgcttggattgttaacgtctctgcaaaaggaactgtgtttgcattaggtgattggtatacaccaaagaaccttaacttcatttgttctgcattgatgccaatccttatgattgttccattgttcgatatcttaaactatattggtgtattaccatggattattaagtggatcggacgtggactttcattcattactggtgaacctaagtttgaatcattctttgccgtagaaatgatgttcttaggtaacaccgaagttttggctatttctggtatgcaattacgtgccatgaacaaggaacgtaatttgacgattgccatgatgtcaatgtcttgtgttactgcttcaattcttggtgcatatattgaaatgatgccaggacaatatattctgactgctgttccaattaacattattaactcattgattgctgtaagtatgttaaaccctgttaaggttccagctgaagatgacaccatcgaaaaggttggtgctgaagttgactctgataagcgtgaaccattcttcagtttcttgggagactcaattttaggtgctggtaagttaatccttatcatcattgctaacgttgttgcctttgttgctttggcagccttgatcgatgctatcttagcattattctggaaggacctttcacttgaaagtatcttaggtgttatcatgttcccattctcatggttacttggtttacctgttcaccaagcatggatgctttcccaagatatgggtatgaaattgattactaacgaattcgttgttatgggtaaagttactggtgaaatcaacagttacgcacctcacttgcgggctgtcttgactgtcttcgtaacttcatttgccaacttcggtactttaggtatgattattggtgccttcaagggattagttgacaaagaaaacaacgattacatcgcttcaaacattggttacttaatgctttctggtattttggtttcattattatcagctgcatttgttggtctctttgtttggtagaaatgaaaaagcagctgggaaggctgcttttttcaacattaaattcgaaaacgcttgcacgataaaaaggagataaaattatgactacaaagattattatggatactgatccaggtattgatgacgcagctgctttaacaatggctattaatgacccatcattagacttgaaattagttactacagttgccggtaacgttactgctgataagacgactgctaacgccttgaagattattcacttctttggtaaggatattccagttgccgcgggtgccaagcaaccattgattaagccttttgaagatgctgctcgaattcatggtgaatcgggaatgcctggttatgatttcggtgacgactatggtaagccacttgataagactgctgttgaagcgcttcatgacgcaatcatggctgaagatgaagtcattctggtgccaactggttcatacactaacattgcattactctttagcgaatacccagaagtaaagagtcatattaagcaaatcgttgcgatgggtggttcgttctccggtggtaacatgaccagtgctgccgaatttaacgtcttcaccgacccagacgctgctaaaattatgtacaatgcaggtgttccaattgtaactgttggattggatgttaccttaaaggcgctcttgactgctgatacaattgaaaaactcggtagccttaataagactggtgaaatgttgcatggattaattacgcactataatgatggtaatgatcaaggtcgtccaatgcacgatgttaatactatcttctaccttcttcatccagaagcatttactacaaaggatatgtgggttgatattcaaacggatggtccggccatcggtgctactgttggtgacattcgtgctgcttatcatgatggtaagaccaacgcaaaagtttgcttagacattgatgctgaatacttcaataagtggttcttagaagaagtaagcaaaatgaaataagatactgggagctgagagcttgctttcggctctttttattactttcttgtgtaaacgcttcacagtataataacagtagttaaagtaaggaggaaatgcaaaatgaagaatattatgattgctggcgctggtgtattaggtagtcagattgcatatcaaacggctttatctggctttaatgttagtgtatataaccaccatattgataccgctgaacgacggattaaggcgttgaaaagtgattatgaacgtgacttgcatttgactgataaggaatttcaacagggccttgataatattaaagttattaccgatgatattgcgactgcagttaaagatgctgatttaatgattgaagctttaccagaatcgttagagttaaaggaacagttttacgaagaggtttcaggattagcccctgaaaaaacaatctttgctagcaactcctctacatttatccctagccaactagctccttatactgatcggccagaaaaatttcttaatatgcactttgctaaccaaatttggaaatttaatgtggtcgaaattatgggcacctcccaaacaagtccagaggtgattgaagaagctacaaagtttgcccgggaaataaagatggttcctgttattcttaataaagaacaacacgggtatattctgaattcccttttgattccgttacttgcatctggtcttagcttatgggctaaaggagttgctgatccagcgatgattgataaggattggatgatttcgacaggtgcaccaatgggaccatttggcattttagatatggttggtttacggacggcagcgcaaattgaacggaatgcctatgcccagactaaggatgaaagtcataaggaaattgccgataagatggaacagatgattcaagaagggcacgaaggaaaagaatcgggacaaggattttacaattatcccaatccagctttcatggatccagattttctgaagcattaagattataagtattgaaaacttagaaaagggagcaagataaaagtcactcgtgactgctatcttactcccttattttgcgctccaattttcacgtaatccggttgcaacaatggcaaaattacggtacagtagtagaagacgtgaaacaaaaaatgtttcacgaaaggagacctaataaatgaatcctgaacaatttcaacaagcattagctgatcatggtatcaccttatcagcagaacaaatgcaacaatttgctgactattatcaattattagttgaaactaatgaacatgtaaatttgacacgaattactgaaaaggatgaagtgtatttaaagcatttttatgactcaattacaggagcgtttgctgaaccacgcttagagagtgaagaactgacattatgtgatatcggtgctggtgccggctttccttccttaccgttgaagatcgcttttccgcaattaaaggtaacaattgttgattcgttaaataagcggattgcttttcttgaagccttagttgccaaactcggtttaaccgatgttactttgattcatgatcgagcagagacttttagtgccaagaacagtccatatcgggagaaattcgatattgttactgcccgtgcagttgcccgcctatcagttttaagcgaattatgcttgcctgccgctaaaattagcggggaattcattgcttataaggcaagtgcagctccggaagaacttcaacaaggtggggcagcaattaaacagcttggtggaaaagttcaaaaaacggtgacattgactttactggaaactgatgaagaacgtaatattattgtgattgataagataaaggcgacccctaataaatacccacgtcgtccaggattaccaagcaaaaaaccaattcaataagataaggagttgaaagtatggctttttcattatttggcattggaaaaaataattccgataatacaaaaaataaggtcgtagaagtaaaaattgatcaaattattcctaatcgttaccagccacggaaagtatttgatcaagacggtatccgtgaattagcacaaacaattgacgaacatgggttgttacaaccaattgttttacgtgaatacgaaccagcaaaatatgagattattgctggggaacgtcgataccgggcgatgaagctcttgaagtgggaaaaagcgccagcaataattgaaaagatgagtgatcaagagacggcttcacttgccctcattgaaaatctgcaacggtcgcaattgagtccagtcgaagaagcgcaggcctaccgacaattaatggatctgaaccatcttacccaatcgcaattagcaaagggaatggggaagagtcagtcctttgttgctaacaaattacggttgctgcgtctgatcaccccagtccaaacagctattttagatcaccggattacggaacgtcatggtcgagcattattagatttagatgaaaaacaacaacgtgatatgttaatgcggattgttaatgaacggttaacagttcggcagacagaagatgaagttgctcgcttattagggcgtccgttaccttcagaaattgcagaattaaaagcagccgctaagcgcaaagaattagcttctattgaggatcatgctgaagaaacagcagacgttgaagaggtaccagtagaaaagcctgcagaaaagaggcgctctcctaaacgaaagacagctaagaaggcccgaagcaaaaaaactcagcaggctaatgatgcgcgtttagctttaaatacgattaaaaagtcaattaagctggcgacaaatgaaggctttgaaattaaaatgcatgagaaggaaaacggcgatacttatcaattaacaattgagattccgaagaaacagtagggaggccaaaaaatgggttctgtaattgcccttgcaaatcaaaaaggcggtgttggtaaaacaacaacgagtgttaatttgggtgcatgcttagctgagactggccagcgcgtcttattaattgatcttgatcctcaaggaaatgcaacgagtggtttgggcgttgaaaaacagaatattaagcaaagtatttatgatgttttaattaatgaagtgccattagaggatgttattcaaaagacaagtcacgagggagttgacattgctccaacgacgattgccttatctggagctgaagtagaattaactaatttaatggcccgagaaacacggcttaaggattcttttggggaaattcgtcaaaaatatgattttattttaatcgattgtccaccatccctggggctcctgacgattaatgcatttactgcttgtgactcaattctgattcctgtccaaagtgaatactatgcattggaaggtttaagtcagcttttaaataccatcaagcttgttcgtaaacacttcaatccgcaacttaagattgaaggggttcttttgacaatgtttgaccggcgcacaaatcttggacaacaggtaaattctgaggtcaaaaagttttttggtgaccaggtttatgatacgattatccctcgtaatgtccgtttatcagaggcaccaagtcacggcttagcaattattgattatgataaaaattcaacgggggcacacgtctaccaacaattagcaaaggaagtgttggctaaccatggcaaagaataaaaaaggtgggcttggtcgaggtattgaggccctctttgcggaaaatgaagtaactgagcttacggatgaaacggttcaagatatcaagttatcgttaattcatcctaatccctatcaaccacggcgaacgtttgataaagaggcgttggcagagttagcttcatcgattgaaaaatcaggggtgtttcaaccaattattctgcggcaaacggatccaaaaattaaccgttatgagctaatcgctggggagcgacggtttagagcttctaagatcgccaaacagaaaactatcccagcaattgtgcgtaagatgagcgatgaccagatgatggaaatcgcggttctcgaaaatcttcaacgtgaagaccttacaccacttgaagaagcgcaagcctatcagatgttaatggataaattatcattaacgcaggcacaggtggcaagcagattaggaaagagtcggccttatattgccaattacttgcgattactagggttaccaaaaatgatcaaagagtttcttaatactggcaaactatcgatgggtcaagcacggacaattctcggtttaaaagataagacaaaacttgttccgcttgcccaacgagctgtcgaacaaaatcttacagtgcgacaattggaagagattgtaacgcagactaatggaacggccaaaaagaaagaagaacggcggacacaacgaaaaccaatctatattcgagaagctgaatcacagttgcagagtaaatttggtacaaaagttgctgtcgcgcaaagtcggaaaaaaggcgcaggaaagatcgaaataccttatacgtcaaatgaagactttactcgaattcttgaattattaaatataaccttagattaaggaggaataactcatgacagcatatgataaaggtgacattgtaatgatgaaaaaggctcacccgtgtggaactaaccgctggaagattacacgagtgggtgcagatattaaaattgaatgccaaggatgtggtcatattgtcatgatgacccgtcaaaaatttgataagggattaaaaaaggttatcgaaaaagcggatcaagatgattaatatttttaatgattgatgatcacaaataactaattgtagattaaaataataaatgattaattgaaaaggaaagtgaacaatttatgtcattaactgcaggaatcgttggcttgccaaacgttggtaagtcaacactttttaacgcaattactaaagctggtgccgaaatggctaactacccattcgcaacaatcgatcccaatgtggggatggttgaagttccagatagtcgccttgaccggatccaggaattaattccagcgaagaagatcgtcccaactacctttgaatttaccgatattgccggaattgttaagggtgctagtaaaggtgaaggactaggaaacaagttcttggaaaatattcggcaaactgatgcaattgttcatgttgtgcgggcatttgatgataatgatattactagtgtttctggtaaagtggatccaattgaagatatcgatactatcaacttggaattagtaatggctgacttagatgctgttaataagcgcttggcaaaagtacagcgggctgctaagggtcgtgataaggatgctttagcggaattagaagtactcaataagattaagccagttcttgaagatggcaagggtgttcgctcaattgactttagcgatgatgaacaaaagattgtcaaagggcttttcttgttaacaagtaagccagtcttatacgttgctaacattgctgaagaagatatggcagatccagatagcaacaaatacatggatgcaattaaagaacacgtaaaagatgacggagaagttattggcgttgcagcagctgctgaagaacaaattgccgaaatggatgaagcagataaagcggatttccttgaaatggaaggcgttactgaaccagggttgaaccggttgattcgggcagcctacaagctcttgggtcttgaaacattctttactgctggtggtcctgaaacgcgggcctggacttataagaagggcacaaaggctccacaagcagcaggaattattcactctgatttcgaacgaggatttattcgagcagaagtaatgagctttgaagatcttgatgaattaggttctgaatcagcagtaaaggaagcggggaagctccgtcttgaaggaaaagattatgtaatgcaagatggtgatattgttgaattccggttcaacgtttaaacctctgaagctaagagaggagtagttttatagtgagtgaagaacaaccacggaatgcacaagctggtcaacgtcaaaaacaattagaaaaagaacggcggcaagcgaatgggaatgcctttagcaactatgatctaacacgaaaaaatgaagattttatgtatcaattaaataaacagttggatcgtctcggtgttccttcagataagaaagactcgatgctaaaggaaaccattgataaattgctagcaggacaaaagaaggggcaaactgcgcgggcattatttggtacgccaactgaatatgctaaagaattgaagaacccaaagccaactcctgctgaagcaagtaagcaatcaattaagttgttagcaattgataatatgctgattttcttgagtatctttacttttatgtttggcttaatgttctggttatcaccagctgcaatgcaaacaaagaatgctggaagcagtggtattactgcaatcttaatcgtggcgatcactggaggattgatttttggttatgtggctacccaagttcaaccgcaaattgataagaacggtaagcgggtaagtaagaagccattatggcaacgaatccttttgatagttgctggattagcagcttggttgattatttacatgcttgtaagtatgttgccaaatgtaatcaacccacggcttaatccatggatctacattggcgttggggttattacgttcattggggatatgtacttcaggtccaaatttcatgttacaggttccctttacggtaatcgtgcgccacgacgttaaccagcaaataattttagtaacggaactatttgccaggttatcttattaaaataaataagggtgagaaaaaggtgaaaattttttctcgcccttttattttgctcttttttgaaataaatttctgaaaatctatggacaaatgttcaacggattgttaagatatatacgtaaacttatgaaaacgcattcaaaattgagaggagatcatattattatgaagttaacgcaagcgcaattagcaaaatacatggatcacacaatgcttaaaccagaagctacccccgaaatgattgataagacagttgaagaagctcgtaaatacaatacagcttcagtttgtatcaatccttactgggttaagcgagttcatgaaggattagaaggtactgatattaacacttgtacagttatcggcttccctctcggtgcaacttcaacagaaagcaaagtttttgaaactaagcaggcaattgaagatggcgccgatgaaattgatatggttatcaatatcggtgaattaaaagcaggaaatgatgatgcggttgttgctgatatcaaagcggttgctgatgctactcacgaaaagggtaaacttcttaaagttattattgagaatgctcttcttactgacgaagaaaaagcacgtgcaagtaaacttactgtaaaaggtgatgctgactttgttaagacttcaactggtttttcaacttcaggagcgaaggtagacgacgttaagattatgcgtgaagcagttggaccagactttaagattaaggcagctggcggaattcacagccttcaagaagcttacgatatgattgaagctggtgctaaccgtttaggtgtttccgcttctgttcaaatcttagaagaagccgcaaaacaataagaataaagtttaattactaatcttaatttacagaaataggaggagtcagaaaatgtcatataaacgtgtttttgttattgtaatggactcagttggtacaggtgccgctcatgacgccgcaaagtttgatgatgttggatcagatactcttggccacgttggtgagtattacaaaggtgccttgaagttaccaaaccttggtaaattagggattagtaatttacgtgatactccgattgaaggtgttctagttgctgatccagctattggtgattacggtaagatggaagaaatttctgccggaaaagatagtatggatggtcactgggaaatgatgggtttaccagtaatgaagccattgtcaacgttccctaatggttttccacaagaaattgttgataagcttgaaaaattctcaggacgaaaggttattgttaacaagccatactcagggacagaagtaattcatgactatggtgaacgtcaaatggagaccggagaattaattctctacacgtctggtgattcagtaatgcagattgctgctcatgaagatgttattcctgttgaggaactctacaagatttgtgaatatgcccggacacttgttaatggtccagaatatactgttggtcggattattgcccgtccatatgttggtcccgataaagatcactttacccggactgctaatcgacatgactttagtttgaagccaattggtgagactgatatggatcgtcttcgtgcagcagggtacgatgtaattagtgttggtaagattaatgatatcttctctggtgaagggatcgataaaggataccataacgaaagtaacatggacggaatggatcatgttgatgaagtaatgaagcaagactttaccggtttctgctttacaaacttggttgattttgatgcaatgtacggtcaccgtcgtaatccaaagggctttggtcaagcattaatggactttgataagcgtctgggcaaagttcttgatgaaatgaagccagatgatcttttaatggtaactgctgatcacggtaatgaccctggctttaagggaactgatcatactcgtgaaaatgttccattgctggtttactctccttcaatgaacaagccaaatcaatcccttgggttgcggaagacattctcagaccttggtgcaactatcttagagaactttaacgttgaaccagtaaaaggtaccagcttctacaaggaaattagtaacgattaagattaattaaggaaaggggcgaaacacgatgcgaatggttgatatcattgacaccaaaagaaatggcggagtcctaagcgatgagcaattacaattctttgttgatggcgtcgttaatggaacgattcctgactatcaaatcagtgctctccttatggcaatctatttccaggatatgaccaaagaagaacagacgagcctaacaatgaagatgatggagtctggtgaacgattagacttgagccgaatccctggaattaaggttgataaacattcaacaggtggtgttggtgataaagtgagtttgccacttgcagcaatggtcgccgctacaggaattccggttccgatgatttcaggtcgtggtcttggtcatacaggaggcacgcttgacaagttagaagcaattccgggatttcgagtagaactttctgaagatgaattcattaatcaagttgctaaagaaaaattagcaattgtaggtgcgactggtgaggttgcgccagcagataagaaaatttatggattgcgggacgttactgatactgttgactcgattcctttaattgctagttcaattatgagtaagaagattgcttctggaacagatgcgcttgtaattgatgttaaaactggtactggtgcctttatgaagacgcttgatcaatcaagactactagccaaagcgttagttgagattggtaaacaagcaggattaaagtgtatggcagtaatctcagatatgaatcagccgcttgggaataaaattggtaatgcccttgaaattgaagaatcaattgatgtcttaaaaggaaagggaccaaaagatcttactgaattagtcttggcgcttggtagttatatggttgtaatgggtgaaaaagtacaaaatactactgaggcacgaaagatgttagagcaaactattcaggagggatcagccctggaaaggtttgcggcaatgatagaagcacaaggtggagatcctgctgttgttgataactaccaattaatgccgcaagctaaatacaagattcctttcaaggctgatcgggatggcgtattgacaaaactttcagcagatgaagttggaactgctagcatgttattaggtggaggtcgtcaaaaggcagatgacacccttgactatagtgtaggaatcgaattgcaccataaactaggtgaccatgttaaagatggcgaaccaattttaactatctatagtaaccgccaagaaattccagacgtagaacagttattaaaagaaagtattaaaattagcgatgatggcaaagtaccgacgctaattcatgaaattattgaataaaaagacaggaggatatttcaatgagtacacatattaatgcaaaaatgggtgattacgcagacactgtattacttccaggggatccgctacgtgcaaaatatattgcagaaaacttcctggaaaatgttaaacaagtaaattcagtccggaatgcctttggttatactggtgaatataagggtcaccgtatttcagtacaaggatctgggatgggaattccttcgatgtcaatttatattaatgagttagtacgcgaatttggtgttaaaaccattatccgggttggttcttgtggcggaattgctccagatgttcatgttcgcgatgttcttcttgcccaagggtcttcaactgattcagcggtaacggtaaatacatttggatcaggattccattacgcaccattagctgatttcaagttgttagatactgcctatcatgtagctggtaaattaggtattgaaacaaaagttggggatatctttgctgccgatcgtttctacaatgatgagcttgatatggaaaagcttcgtgactatggaattttaggaacagaaatggaatctgccggactttacttgttagcggctaagcttcatttccgggcactttcagttttgactgttagtgacttaatctttggtgacgaaaaagcaaccgctgaagaacgtgaacgaacattcaatgatatgattaatatttcgcttgaaacggcaattgctggaaagtaacttcttgcataagctagagagtgcattttataataaaatgtggtttagataatgaaagtgagtgggaattaaccttctcgacaaggcggtgggctaaggatagaatggtgattagcacggcacgggttgattatcgttcgaacttagcctctagccttgtggttaatttccacgatatcgtaacaatattagtataaaaaacgaggctgttgaaaaaacaaaagttttttctcagcctctttaatatggggaaaggagggaaattagatgaatgataaagataagattgaattagcgctaaaagtagcaaccttatattatcgtgatggatggaaccaaagcgatattgcaactgaactaaatatttcccgggcaacagtgtcacgattattacaatttggtcgggatcgaggattagtaaccattaaaattcataatccggttgctccgcttcaccagttggaagtagacttactcgctaaatatccatcattgcataaaattattattgttccaggcacggatgatccacttgaagaagttggcgcagcgggtgctaaatatatcgaacaagtcgtagaagataaagacattattggcttaggctggggaaaaaccgtctatcaagtaggattgcatttaaaacctaaagacgttactgatattactgttgttcaaatgaaaggcagtatggcaaatactaatacgcgaaattatgcgtttgaaacggttaatatctttgccaatgcttttaataccgttccacagtatttgccgttaccagttatctttgatcatgcaaagacacgtgaattagttgctaatgatacccacatcaaacatattttgaaattaggggagcagtctaatatcgctgttttcacagtggggacagtacgtgactcagcattgttatttaaattaggttatttcaccaagcaggagcaattaacgttgcaacatgaggcggtaggggatgttttctctcgtttcattgatagcaagggccagatagtaaatgaagatattaatcaacgaacaattgggattgcgctcccagagttgcgaaagaaaaaacacagtattttagtagcagcaaatgttgctaaggtaccagcagtgcatggtgttttaactgctggttatgcaaatacattggttattgatcaggagagtgcgaatagcctagttaattttttaaattaatttaaatatttagattgacctcagtgcgaaatcctagtagagtatacctaattaaaaatcaaaggagttgcactacagatgtcaaattgggacacgaaatttgccaagaagggcttaaccttcgatgatgtattacttattccagctgaaagtcatgtattaccaaatgaagttgacttgagtacacagttagctgataatttgaagcttcatattccgttgattagtgccggaatggatactgttactgaaggaccaatggcgattgcaatggccttacaaggtggcttaggggttgttcacaaaaacatgtcaatccaagcccaagcaggagaagtagctaatgtaaagagcgtagtcgtacctgcaggagcaactaaggctgcagttgatgagaataatcgtttattagttgctgcagcagttggggttactagtgatacttttgaacgtgctgaagcccttttgaaggcgggtgcagatgctatcgttattgatacagctcatggacattcagcaggtgttcttcgtaagatcgcagaaattcgcgaacacttcccagacgcaactttaattgccggtaatgttgctactggtgaagctactcgcgctttgtttgatgctggtgttgatgttgtaaaagttggtatcggtcctggttcaatttgtactactcgggtggtcgctggagttggtgttccgcaaattactgctatttatgacgctgctagtgttgctcgtgaatataacaagccaattattgctgatggaggtattaagtactctggtgacgttgtaaaagctcttgctgctggtggtaatgcagtaatgcttggtagtatgctttctggtactacggaagcacctggcgaagtttttgaagacaatggcaagaagtacaaggcttatcgtggaatgggttctgttggtgcaatggctcaagcacatggttcctccgaccgttacttccaaggtggggtaaatgaagctaataagcttgttccggaaggtattgaagctcgggtagaatacaagggcgatgtttctgatattgttttccaaattgatggtggccttcgttcaggaatgggttatgttggtgctggtgatattccaacattgatcgaaaaagcccaatttgtccaaattactaatgcaggacttattgagtcacatcctcatgatgtccaaattactcgtagtgcacctaactataaataattaatttaataaggaactgctatggctttattcatgaagatatagtcacagcagtttttatttcccgagaaataatggagggtaaactttttgttaaggctatcctagaatgatcgcttttttcgcatagttagttataatattcaataggatattatgctgcaaaaaggagtacctcttatgaaaattctagttgttgatgatgataaagaaattgttcaattacttgaaatttacatccgaaatgaaggatatgagccaatttctgcttacgacggaaaagaagcgttgacaaagctaaatactaatcctgatatcggtctgattattcttgacttaatgatgccagaaatcgatggaatggatgtaattaagcgggtgcggaaagattctgatattccaattttagtgctttcagctaagacggcagatatggataagatacaaggtttaatcactggtgcggacgattatgttactaagccatttaatccgcttgaagtaatggcacgagttaaatcattacttcgtcggagccaaggagaagtgacaaatgatcaaccagatattcttaatgttggtccattattaatcaataaagattctcacgaggttaagacgattaaaggggatgtaattcaattaacagcccttgaatttggtatcttatacttactcgccagtcaccctaatcgtgttttctcagcagatgacatttttgagcgggtatggcaacaagaaagtgtcgtatcagccaaaacagtcatggttcacgtgagtcatttgcgggataaaattgaagaagcaactaacggtgaaaaggttattcaaactgtttggggtgttggttataaggtggaagaccactaaagcctagccttaaggatgtggaggaaaaattgtgaagttaacggggcgtgaaaagagttcgcttattttagaaggggtagtaacggttatcttattgttattgctgaatatggcgattatcgtaattattcaagatgccattcagtcaaatccgggagtaaccaatggaatctttatgattaagcaatcattgaagattggtcctcttcaagcacaaatatggagctatcagcggatcttaattgcctttttagtaattattgatgtgtgggtggtatggtggcgattgcgtcgccggtaccacctttatcagatggatcatattatcgcggaattacactatattgcgcagggacatttggatcatcggattccgtttcggctaaaagggaatcaacagcatgttattactagtgtaaatgcattagttgatagtgcggtgcgttcaatggatgatgaacggaagattgaaaagtcaaaagatgaactgattactaatgtgagccatgatttacggacgccattgactagtattattggctacttgggattgattgaagataagcagtatcgtagtgaggaagatattctaaaatacacccatactgcttatgagaaagctaagcaaatgaagaccttggtggatgatttgtttgaatatacaaaagttcagcaacatggggcaccggtaaatattatgaaaatcgatcttaaccagttaattgaacagttaacggcaagttttgaattagaagcccagcaccgcggaatcgaaattacttcctcagttatccctaatcctttaatgattgaggcggatccggagaagcttggtcgagtttttaataatttagtttcaaatgcctttaaatatggcaatggtgcaagttacattcggatcgatgcccggcaagaaaatgatatggtggtcgtcaaagttgctaatgatggtacaccaattcctgaaaaagcacttgaccacctatttgagcgtttctaccgcgcagaagcttcccgttcacgagctactggtggaacgggattaggtttagcgattgtcaaaagcattgttgatcttcatcatgggagcgtcaaggttacttcaaatgaagacgaaacagcatttattgttacattacctttaaaacaagaagttaaagaaaccaaccaaaaatgagaaaaaagtctaaaatcaaatgattttagacttttttctttttcaattatattcaactaattttatatgtggtagactaaaagagcattgtgtcacttgatattataaaagatacaaattattggaggaaattctgtggctaaagcacaaataaatccagaaaggacacgctggcttgaggtgcttggtgtctcaatgccattatgtcttagttatattccgattggattggcctgtggaatcttactacacgcagcaggtttaaactttataatgattttattggtgtcggtattagtgttctctggtggggcacaatttattctggcatcgttattagcaagtaacgctccattagggactatctttatctcacttttcttcttagagttacgatatgcattgttaggatcgagtttatctaaatatattaaggataaatcagcacgtttcatcctcatcttttctgcatcaatgaacgatgaaaattatgctgttaactatatgaagtttgcaactgataagaaatgggatcccgatgacgcgttgttagtggagtattattcacttgcagcatggtcgacttcaaacatggttggtggtttgatcggtggtgcaatttcgattgaccttgaagtggttgattttgcattaacggccttatttttatatatgatcgtaatgcaggttcaaaaccacttgaccctagttattggcatcttggcagctgttcttggtgcatacttccaggcattgactaaaagtacacttgggattattattgcaaccttaattgcttcctttgttggattcttgattgaaaatacagttcgtcaccatagtaagcatccaaactcgaactggttcttgacaaaaatgtttaggccgaagatcacaaagactacgatcgaggataaacaagctcaacaaaaagaagttaaggaagttgaaaaactggaaactaagattgaagatgttgttgaacaccatgatgagaaacatgaagagaaaaaacatgatgatcaacatcctgatgagggctagacatggaacaactattaagtaataaaatcgtttaccatattatagtgattatcttggcagctttagcggcatttattccccgttatctaccagtattattcttctcaacgcgaaaaatcccagaatggtttaatgaatggatgaaatatgtcccagttagtttatttgcgaccctggttgtaaaagggatcttcttaactggttcttatcattttactctattcggttatccagaacggattattgcagcattgatcgtgattgtgattgcgtactttactcgatcaatgtcgatttcagtaattgctggattggttgctgtttggcttctgagtttagcgttataagagtagttttgttataattataaacagtggattggtttctagcttgcgaagaagccaatcccttttattttaggaagtgagtacgttggattttaagcaaacaattgcatttgttaatcttgctaatactttggattatcaatatgcagcaaaaaaatcagggataacggttgatgaattggttcacacaattaaggcgcttgaagaagagcttaacatcaagcttattagacctgaaggcggcgtagttgaattaactgaaatcggggcgttttaccgttgatcactgagattgctcaaaaacatgctaaattattatcggtagttacggattatcgaaaaaaggaagcggaagaagcgatcaaagttactgtcgtcccaggctttgccaattatcaagcagccccggttgttaaaaaattagcccagcaacataaaatgaatcttgttgaagatgttgatccaatggcacagctacaacaaggggaaagcgagctggcatttattagttatgccggcaaacttcccgatgattttgaggtgctttcagtgggaactgatgacttagtagcttatatcccagcgcggaacccactttctaaacaaaaggaattaacgcttactgatctaaaagcagaaaaatttttaacactaaaccatcaaaatccatttgcagtctttgttcaacaggtttgtgctgcggctgggtttgaactatattctgtttttgaaggagaaaaaggaagaacattagtaaatatggttgctttagggatggggataaccttgttgatggaacaatcaataagtgaaaacttagatagtaaagtggttaaagtgccgattgttcccaaagttactcaaaaccttgcatttgttcgtcgtaaaaatgtagaatacacggcagagcaagaagagttatggcaagctctaaaagaatcctttgaaaaatagaaaaaaggtttgacaatttcgcaaactacgcttattatcataaataacaaaaatacctttaacttagtcccgtgaggctaggaaggatttaattgagcgtttaagtacaccttcttagctattgctgagaaggtttttcttttaagcagtagcaccaagaatacgccagtaaaatcaataggtattttgaaacaaccgaccatttaattgtttccagagagagcagaacggtatgttgtttttagcctacttatatcctaaaagcaaacagtgatgcctctcgaaatttaaatgggaagttatcactgttttgttgtaattagactggaaaaggagcgctattgatgattagtacagaaagaattcaaccaaatttagtaacagttgccgacatggatgcagcagatgcaattgatttaattcatgaagcccaagcatataaagctggaaagcaagcggttctcactgcaccggcatacgcggttaacctcttctttgaaaactcaacccgaacaaagactagtttccaaatggcacaaatgaagttggggatgaatgtactagaattcgaagcgggcacgagttcagtgaaaaaaggggaaagcctctatgacactgttaagacaatggaatcaatcggtgtaaatgttgcggtaatccgtcatcctgaaaatgaatattacaaccaattgattaatcattcagaccttaagatcggaattgtaaatggtggtgatggtagcggccaacatccatcgcaatgtttacttgatatgatgacaattaatgaagaatttggcgatttcaaggggttaaaagtactaattattggtgaccttagtcactctcgagtagcgcactcaaatgcaatgatgcttaatcgtctaggagcagaggtttattttgctggcccagaaaaatggtatgatcctacgctggaacaatatggaacttttggtgactttgacgaattgcttcctcaaatggatgtagttaatttactacgagttcaaaatgaacggctaacgactgctgacggtcaagcttttgacgctaatcaatatcaccaagcttatggtttaactttagagcgagccgcaaagatgaaacagggggcaatcattatgcatccggcacctgttaaccggggtgttgaaatcgatagctctcttgtagaagcgcctaattcccgcattttccaacaaatgacaaacggcgtatatacccggatggcaattcttagtcgagttcttcgttaccaaggattgatgtaaaaaggtgattacgatgagtaaggcagttttactaacgaatggccgacgagtttataatgatgaattggttaagactgaagttttgattgtagatagcaagattaaggcaattggcgagcatatccaggcaccaagtgatgcagaaaaagtcgacctggataatggcttgattacaccaggactaattgatgttcatgtccatcttcgcgaaccaggctataccaataaagaaacgattgctacaggaagtaaagccgctgcacatggtggctttacgacaattgctgcaatggccaaccttaatccgacatgtgacacaccagaaaaatttaaagaacaggttgatcggaacgagaaagctggactggtaaaaatcctccaatattcaccagttacagttggtcgggctggaaaacaagcagttaatgttgctgagcagtatgctgcaggtgcccgtctttttagcgatgatggtgcgggaattcaagatgctggagttgtataccaagcaatgcaacaactagcgaaagttaacgctccgttatgtgatcatgcgcaagataatcaacttgcacaaaatggggtaattaatgatggggcaactattgctaaaaaactagcactaccaggaatgccagcgattagtgaaacagcgcaaattgctcggaatttggtgattgctcaggcaactggggtccattatcatgtttgccatgtttcaactaaagaaagtattgacctgattcgtcatgccaaacaacaaggaattaacgttacatgtgaagtgactccccatcatttacttttagccgatgctgatattaaagaggatgatgctgaatttaagatgaatccacctcttcggcagcgtcttgaccaacaggcttgcttaattgggctattggatggcacgattgattgtattgctactgatcatgcgccacataccgatgcggagaagcagcaaggatttcttaaatcaccaaatggtattgttggctcagaaacagcttttgccttactctatacacactttgttaaaacgggtatctttacgcttgcccaattgattgactggatggccgttaagccgcaagcgatttttaaccttgataacgctggattattaaaggtaggggacccagcagatattgctgtatttgatatcgatcatcaagatgtaattcaaccagaccagtttttctctaagggtcacaatactccatttgttggtaaacaagtatacggaatgactaagcgaacttatgtcgatggaaaactcgtatatctggagggagaaggataatgcaagaaacacaacgattagcagttgaattgccgggattatcactaaaaaatccgattattgcggcaagtgggacttgtggatatgggcaagaagcagctaaaaagtataatcttaatcatttaggctcccttgtgttaaagtccactaccctccatccccgccaaggtaatccacgtccgcgagtttgtgaaaccagtgccggttggcttaatgctaatggtcttcagaatgtgggcattaccgcagcaactaatgaaaaaattccgtggttacgaaaaaattatccgcaactaccgattattgcaagtgctgctggtttttctgaagacgaatacgttaaagttgttagtgaatttgctaatacggctggggtgaaagcaattgaattaaacgtatcatgtccgaatgtaaaacacggcgggatggcaatgggaactgatccagaagtgcttcaacgattagtaaaacaagtagttaaagttgccctaggaattcccatctatgtaaagctaacaccaaatgtaactaatattgttcccctcgcgcaagcagctgagcaagggggcgctaatggcctgacgatgattaatacgttaacgggattaagcatcgacttaaaaactcggcgcccggctttagctaatgtaacgggcggtttatcaggtcctgccattaaacctttagcattaagaatgattcaccaggtccgccaggtttcttctttaccgatcatcggcgtgggtggaattgaatcagctgaagatgttcttgaatttatgatggcgggtgctaatgctgttcaaatcggggcagctagttttcatgatccattggtttgcccgaaaattgcagctgatttaccaatcgtaatggatagatacgggattaagaaacttacggatttatgggaggtaagattttgaaacgcttcgtaccgatggtggctatcgatgttgcaactaagcaggaagcaattgacctatttgataaattaatggtaaaaccgcagccgatcgtaaaaattggaatggaattatattatggcctgggacaagtaattgttaaagaggcgaaaaagcggggatttaaggtattccttgatttgaaattatacgatattccgaatactgttcatcgcgcaatggcagctattggccgattgggaattgattttacgacaattcacgcagctggaggtagtgaaatgctgattgccggattagccggtctagaagaaggagctaaggaagcaggcgttgaaccagcaaagttattagcaattacccaacttacttcgattgatgaaaaaattctccatgaacaacagcatgttgatttgtcgttgattgagtcagtccaaagttacgcgcgcttagcagaaaaagtaggattggccggcgtagtatgctcagcccatgaaatcaaggcaattcgtgaagtgacgggggatgatttcctatgtgtaacgccaggaatccgcccaactcatgcaataaaagatgatcaaaagcgagtggttacaccagcacaagcaagaatagatgggagcaatgcgatcgtagtgggacgaccaatcacccagagctttgacccagttgctgcttatcaagaagtccaaaaagcattcttaaatgaggaggaagaaaaatgacatattcacaacgcgttgcaaaagcattattagatattcatgctgttacccttagcccagaccaaccatttacctgggcaagcggtctaaaatctccaatctataccgataatcgattgacgatttcttatccagaagttcggcaagcaatttttaatgggatggttgaacaaattaaacttcattttagtgaggccgatgttattgccggaacagcaactgctggaattcctcatgcggcatgggttgcccagaatatggaattaccgatgatttatgttcggactaagccgaaagatcatggtcaaggcaagcaaattgaaggggtgcttaaagaaggacaaaaagtcgtcgtgattgatgaccttatttcaactggtggtagtgtattaaacgctgtgcgggcggttaacaatgcaggcggaaaagtaattggcgttgtttctgtctttacttatgatttgccagctgctgaacaaaactttatggcaaatggactaaaatactattcagtaacggattatatgactttgattaaggtcgcaaaggaaaatgaccaaattagtgcggaccacctcaagtctcttcaagaatggcggaaagacccgttaagctggagtaaagagcaagcatcataataattaattatcaaaaaagcctaagattgattcagaaaaaagttaatctgaattaatcttaggctttatcttattgtttatcttcccaaatcttttggagcattgggtagcgtaagtcaccaacttgtactacttgataatctgcatttgctaatgttgtagcatcaccaacgccaattgcaattgcatttatatggtgaatattttcaatatcatgagctgtcgttccaactccaatgcaattagctccgataagatttaattgattaacagcagttagatatgggctttctttatcattagtcctaacgatactatcgacataattatcaaggccaatttgtttaaggacattttgtacatctccattagcatctaacacggcaattttaacgtaatgatcatagagatttagtaaaagacgcttaatccctggaagttgatccttttcacttaggctatccgcttcttcgttaaggaatttttgccattctgcaatcattgaagccttttcgcttggggcaggattagcattaaaatgtgctaagactagggagagcccttgcgaaggagtaaggttatcgaattgggaagctaattttccaggtaatcccatcccaaattcatacattacaaaacgttgccatgcagtaaaggataacttatttgtattaacaaagatattattaaacgaaaaaatcgcaccatccatgattaaacatcccttcatagataattatgtctatattttaacgtaatcgaaaatgaaagggaatacattaattaagcatttactttagcgaggttagcggcataatcgattccctttacatctaaatactcaataatttgattgattgtaataaatggtacatgaactcggttagcaaggactgacagactatcacgacgagccatcgtgccgtcacgctttaacacttcgataataacagcaactggtgcctttcctgctaaataggcaagatcaatagctgcttcggtgtgaccgattcgatctcttaatccatgaggttgggcgtaaagaggttgaatgtggccgggatgattaaagtcagatgcttgggcagttggcttggcaatttgccgaatcgttgctgcgcggtcaaaagcggaaacaccagtagtaacaccggttgcttctaaggtaccatcagtagtaaccataaatggtgtttggtgtgggtcagtgctatgctctaccatgggcttaaacgctaaatgcttagcaatatcttcgcttactggcacacacatcaaaccatttgcctcgttcaacatttcatagatagtatcagcgttgacattttcacctaaagctactaaatcaccttcgttttcacgatcttcattatcggctaagataatataaccaccatttactaattggtttaatgcttcttcaacagttgaaaattgactttgcataatttatatactcctttgaaattctgaaagtgatagaacagttacattcgaatgtgttattataataacgaacgttttaatttaaatcaacctatttttaaactaaaacacgaataatattaaaagatttcaaagggtaagtttgctaaagagctggagaaaataaagatttctcaccagctctacgctctatctttagagtaacaaaaaagtccagaacgagatatttttcgtcctgaactaatcttaggttgttctattttgtcatgtaatcacgagtcattggtaagtttttacctgaaggacccttagttatcaagtattgaataacatcaatatttccagattcaaatgatgcagcacatgtttgaagatataaatcccacatccgtgtaaaacgttcacccatcatatcaaggatttgagcacgatgttcattaaagttcatgtcccaaatttcgagggtgcgttgatagtgacggcgaagcatttcgatatcagcgatttgcatatgattttcttcaatgtgaccgatcatttcttcgagaccaggtacataaccgccagggaagatatacttgttaatccacccattatatgcaccgccttgttgacgagtgataccatgaatcaaggcaacaccatcatcagcaaggcaaccttggatatctttaaagtaaaaacctagattttcttttccaacgtgttcaaacataccaacggatgtaatataatcccacttttggtcaccaagttcacggtaatcaacaagtttaacttcggcaacgtcttgcaaaccttctttttcaatccgttccttaacaaagcgatattgttcttcgcttaaagtaaccccagtaacttttaagccatattcttttgcagcagttaacattaatgttccccaaccacatccaatatcaagcaatgttttgccaggctttggatcaagcttctttaagatgtgatgaaccttatcaacttgtgcttttgtaagctcatcatggttgccatcagtaaaataagcacatgagtaagttagcgtatcatcaagccataacttgtagaagtcgttcccaacatcataatgactttggacatcattttcgctctctttttctgagtggccttgtttaggcaaaaatttgcggaacttagaactccgcataaaactatcggcactttcatatgctgattcgatcaatttttgaatgctaccctggatctcgattttcttatccatgtaggcttccccaagtgcaattgaggcgttcttggtaatatcacgcattggaattttctcattaaaggtgatagttacctcaggagttccgtcaccatagataacacttgatccatcccaaaatacgatctttacgggaatgttaaatgagtgctttagtagtgacttgtagaacgtcttttctaacatgaaacgcatccttctttctgcaataataatattcattataacacccttaaaataaaagtgtttcaagacaattaatgaaaacatttcataagaaagcgataaactaattgctgaaaaaatgaaagcttgctactatgctaattagtaggaaaaatagggagatgattgaatgacgaatgcctggaagcattttattgagaatgtaaaactacggcgtttcactgtcttattattaatcattgtcgtactctggctaatgaaatcaatgatgaatttaattttatttacatttattcttacttatcttgttgttagttgggtaagactcgtccagcgatggttaccacgaatgtcgacaagtttaattgtaatcgttacctatgtattgttaattgttctcttatacttaggggtgacccgctatttaccggttttatctcggcaagttgttaaaatggtcaattcagtagttcatttctatagtactcatcaagcgacgatgatatatcgttatgtcagccattacataagtaccgccactattatgagtcaggttcggcatgggataacaatcgcggttagtactttgacaagtattggtgcaattaccgtttcatttgtaatgtctttaatcttgagctttttctatacgcttgaattaaaacaaatgaatgaattttctcatagctttttagatagtgattttggctggtttttccaggatattgattattttggtaaaaaatttgtcaatacttttggggtagtattagaggcccaattttttattgctatttgcaatacagtgattaccacgattggcctattatttatgcggatgccgcagatttttgccctatcgttaattgtgtttatctttagtttggttccggttgctggagtaattatttcaacaatcccattggcgatggttggttactcagtcggtggaattcgcgatgtggtttacattatcatcatgattatcatcatccatactttggaggcctacgtcttaaatcctaagtttatgtctagccggacagatctaccaatcttttatacttttatcgtattactgattggtgaacatctttttggtacatggggattgattgtgggggtaccaatctttaccttcttacttgatgtattaggcgtaaagcccattcgcggtgcaaaaagaataaaaaaagaagtgtgagtgagaattagccttgtgacgacgcgaagctatttccataatgtcttgctactattcatggaaacagttaaggctgggagaaaaagttttctcctagttttttgttatccgaacaatttatgttaattcattggataaagttaattaaaatcgaacttattttgcaaaattgctgaaaaagtcttgagttagtgtataataaaattaagataggtctaaagaaaggaagctgatattcatgacagacatcgagattgcagaccaagcgacactggaaccaattacagaaattgccgagaaactcggactttcagaagacgaaatcgaacaatatggtaagtataaagccaaaattgatttaaatgtaaagcctttacctgataaaaaacataagctaattttagttacgtccatcaaccctactcctgctggtgaagggaagtcgactgtcctcattggcttaggggatgcattaaatcagttaaattatcagacaacgattgcaatgcgtgaaccatcgatggggcctgtttttggaatcaaaggtggtgcaactggtggtggatatagtcaggttgttccaatggaagatattaacctgaactttaccggtgacttgcatgctcttacaagtgctaataatactttggccgctttaattgataactatattatgcgtgataatgcaatgaaccttgatccgcggcgaattatctggaaacgggtagaagacgttaatgatcgtgctctccgaaatgtagttaccggtcttggcggtccaatggctggtgttccacgtgaaacaggctttgacatcacagctgcttccgagttgatggcaattttatgtctatcaactagtcttcatgacttgaaagaacggattagtcgaattgtagtaggatatacatacgataaagaaccggtcacagttggccagcttaattttcaggatgcaattacaattatcttgaaagatgcattaaagcctaaccttgtccaaactttagaccatacgccaacaatcgtacatgggggaccatttgccaacattgcccatgggtgtaatagcgttttggcgacgcaaactgcccttaacctttctgactatactgtgacggaagctggctttggggctgaccttggtggggaaaaattccttgatattaaacaacgtgttcttggtaagcatccagatgcaattgtcatcgtagcgactgttcgagcgctagaatacaatggcggtgccaaacttgcagacttaaatgatgaaaatcttgatgcgctgaaaaaaggaatggcaaaccttaatcgtcacattaagaatatgcaattatatgggttaccaatcgtagttgcaatcaaccattttgtcagtgataccgataaagaaattcaaatgattaaggatgactgtgctaagcaaaatgttgaagcaattttgactgatgcttgggctaagggcggtaaaggtacccatgatttggctaataaagtagtcgaacttgctgatagtccaagtgaatttactcatatctatgacgttcaagttgatgaccttcaaactaagttagagaagattgctaagcagatttatggtgctaaagaagtatcatttagccgtaaagcacaaaatcaattgaagcgatttgctaagtatggatggaatgacttgccagtatgtattgctaagacccagtactcatttacagatgaccaaaaacaactcggtgccccaactgactttactttccatattcgggaattggtaccaaagatcggtgccggctttgtcgtggcattagctggtaatatgatgacaatgccaggcctccctaaagaaccagcggctgtaaacatgacgattgacgataatggtaaaattaccggattattctaaataaccaacacaaaacatcgattgtgcaataacgtacatcgatgtttttttcacaaacttttcaaggctagcgggttgaagttattgatatactgctatgtgaacttaatcgttttcttgtgaaattataaaataaggactacagtagaggtatatcgttttataagtttaattaggtagaggtgaatgactaatggaagagaaactacatggcgcagatattgttattgatagtttgagaaaacacggggttaatctcgtctttggtattcccggagcgaagattgatcgtttgtttgaaggactagatggtcaagacagtgaagatgcacctaaattaattgttacccggcatgagcaaaatgcggcgtttatggcccaagcttatggtcgcttaaccggaaaaacaggggtcgcgatcactacatctggcccaggagttggtaatttagcaactgggatcatgacagccaacgcagaaggagatccaatgttagcgattgggggacaagtacaacggaaagaccttcaccgctcaacccaccaaagcacgccttcaactgaaattatggcaccgattacgcaatatagcgctgaaattcaagaccctaataatatttcagaaattatggccaatgcatttgaagcgagtcaggatgcacgtaagggagcagctttcgttagtcttccacaagacgttgatgatgctgaggtaactgaaaagccattgccaatttatgaaacacctaagacgggtcctgctgatccaaatgacttacaaaaactagtcgaactaattaaaaatagtaaaatgccggttatcttagtcggtcaacggggcgcggatgaagaaattacgactgctatccgcaaattattaagtgattattcattgcctgttgttgaaacatatcaagcggctggagtagtatcacgtgacttagaacaacagtcatactttggacggattggccttttccgtaatcaagtaggagatcagcttcttcaacaaagcgaccttgttattgctgttggttatgatccgattgaatatgaaccacggaactggaacaaggaggggaatctgcgaattgtaaaccttgataccttgccagcgcaaattgataaccactatacgccaatcatgcaactagttggtaatattgctataagcttaacggagcttgataagttactaaaagggtatgaatatcctgttgcagccactgagcaactcgctaagtataagcaagaacttgaccaagataaaaagattcaagtaccaacaagcaatgatgccagccatccgttagcagttgtgcatgcaattcaagaaaatgttactgatgatatgcacgttgcgctcgatgtgggttcccactatatctggatggcacgacatttccgctgctaccagccacgacacttgttaatcagtaacgggatgcaaacactaggcgttggcttgccatgggcgatggttgcagcgatgctttatcccgaatataaatcagtggcagtttgcggggatggaggcttcctcttctctggggcggaattagcgacagccgttcaacaccatcttaatgttgtaacgattgtatggaatgatggcggtcattacgacatggttaagttccaggaagagatgaagtattcgcaagcagctggtgttaaatttggaaatgttgatatcgttaagtatgctgagagttttggtgcaactggactgcgagtaaataagccggctgaccttactaaggtactcagtcaagcgtttaatattgacggcccagttgtggtagatgtgccagttgattacagtaataataaagaattagctgccaacttgattgattcacaacttggctaagaggagaacaaagattatgacaacattatatgaacacggaacgttagctgcgttgatggcaggaaattttgatggcacaattactgtcggtaatttgctaaaacatggttcgatgggaatcggtacttttactggcttagacggtgaggttgttatcctgaataatgaagtgtaccaggccgtttcaagtggtcaagttaaccacattacagatatggatgctacaatgccatttgcttcagtccattttcctgctgaacaacaggatataacattaaggaatataaactttgctaaactgaataatgattttgttaaagaacatcagcttactaatgtttttgcattcttacaattgagtggtgagtttaagcacgtcaaaattcggattgctccgaagcaagaaaagccatacccgactttactcgatgttgcgcaacaccagcctgaatttgcggctgataatatcgcagggacaatcatcggctactatgcgccagaaatctttggaacaataacggcagcgggatggcaccttcactttatcagtgatgatcgacaatttgctggtcaccttctggcgtttgatgccccagaattaacaggtagctttgaaatttttgataacctggaacaacatctgccgattcataatcaagaatttcgggagagtacagttgatatggcaactttacgtgatggaattgctaaatcagaaggaaatgcagactaaagaacaaatgaagcagcggtataaataacgccgaaaaagggctccagtgctcggtaacgaactctggaaccctttttgtgatttctaaaatatcattttaagttgtcgtttttaatgagttgattaattagtagtcgcttggaaaaataatatttgcagatttacggagacggtatagagtcatattaacaattttagctagttcaatccatcgttgataattatcctgctgctgtggcgattcggggttagtaaagagttgtgcaaaatcgtttaactcgtcaaacatggtgttatctaagtagtggttattgataacttgaatactcccctgattattaagataagtcactttcttagtatcgaaaatactgtcaattattagcgtgtcgcgaagcctatatttattgccaaatgcttctgcggtgctaagcttacgggaatacacaacagtaagttaatatttccaagtatcttgtgctgcatgaatcatctagtcaaaaatagtatgggttccaataattcctaatcgtaacataagctagatttcctggttagccattttgtagatttataccatgtcatcataataaagaactttctgatcccttgtgcccaccggtagcattaggacatgattgtgacatttccatttctgcttggcaggtatttcaatagtgctttttacactaaatacctaaaccctgttttaaaaaatcgttcagttgaagttttggtgattcaagaatctaacccgaccggcaaaaattcattaccttactccaccagctaacagatgtggcggaccagcctgataagtaattttaaatccgcaatctcctttcacaagcttggttgacactaattgctgaaattaagtttcaagaacaacaccagcaattgacggttatcccacgtgaacgcagcaaaaatattttagcgtatttgcacaaacactatgcggaaaaggtaacaattaatgatagtgcaactgcggtcaatattagtcccaaagaatgtattcggtcatttaagaaaaacattcaccaaacgccaattgaatacttattaaattaccgggttgagcaggcaaagaaaatattgcggcattcggagctttcgatcacggatattgctttgcgggcgggatttagtacgagtgcctattttagtaaaatatttaaggaacgggtaggaatgacactacgggaataccggcagcgtcaagggtagcttactttaagtttaaaattttacttatcaatgtttccatgtctgctgggttaatgactttttcttggcgcggcgtttggtctactaacgcttggacaccatcgctaagctgatctcccagaagatcatgtaactgttgaagagcaggaagcccgatttgactaactttttggttggttagtgcgtggtagacggtttcagggaatttatatggactggcagttgacacgataactgtgggagttgtgtcatggctttgttgctgatattgatgtgttacatgtgatgccactgcagtatgcgggtcaataacatatccatcatttaaatatactcgtttaatttcggcttcaacttcatctggggtcgcaaaaccagccacaaattgctcctgaagcttatttaatacggtggaatctacctggtagtgaccgtcagtagctaattgcttcattaatttagcaactgttacgcagctttcatcataaagatcaaagaggagccgctcaagattacttgatactaaaatatccattgctggtgagttagttaggtaaaagttgcgtcgccgctcatattttccgctcttgaaaaagtcggtcaatacattgtttttattagaagcacacaagagcttgttaattggtaagcctaattttttagcgtagtaaccagcgaggatatcgccaaaattaccagtcggcacggtgaaattaactttctcccctagttggatcccgcctgtatgaacaagctgtccgtatgcagcaaaatagtacacaatttgggggataagccgcccgatattcattgaattagctgaggaaaagcagttattattttgcgcaaggcggtcattaaatgcttgatcgttgaaaatatgtttaacgcttgtttgggcatcatcaaaattacccttaattgcgattacgtggaggtttgatccaggctgccccagcatttggcgtaattgaaccggactaaccccgccagcagggtagaagacgattacctgtgtgtctttttgattgctaaaccctcgcattgcggctgttccagtatcaccagaagttgcggtgaggataacgatttgtttttctagttgggtgttttgtgcagcacgtgacactaattggggtaacatttgtaaggcgatatccttaaatgccagtgtcggcccgtgaaaaagttcaagataataattgctggcgtgtttgggcgttaatggggcaattaaacggttatcccactgactaccataagcggtatttgcatttttcagtagttggtcgctcgtaaattcatcaaaaaaccagttaagaatagttgcagcaagttgttggtacggcaacgaaattaaggttgcaaggttataagttggttgaggaaaatgaagcggtacataaagaccgccgtctggagaaagtccttgtaagatagcagttggtgattttaaaatcgttgataagtctccctgagtgctacggtagtccatgataattcctccaatttcaaaggtgattttattttaattgtatgtttcttatatgctatggtacaatgctgaaaatgaaaaaacaatgagaaactgaggcgggaaaatgaaaaacattaaactgggactgctcggtctgggtacggtcgggtcaggagtcttacagatggttcaacaaaatgcagataaaattctcgatgttactgggtgcaagttaacagttaaaacagctttagttcgaaaccttggtaactataataagtatgctgatgaaacttctttaacaactgattttgatgaaatcttgaatgatgatgaaataaaaattgtcgttgaacttatgggtggtattcatccggctaaagaatatattacaaccttattaaaaagtcataagaacgtggtcacagcgaacaaggatttgattgcgtcttatggcccagaattgatgactgtcgcgcatgaaaatcactgtgacttaatgtttgaagcgagtgtggctggtgggattcctattttgcggacgattgctaatagctttacggcagataaggttactgaagtaaagggaattgtaaatggaacaacgaattacatcttaacgcaaatgagccagcggggatggtcataccaccaagcacttgcccaagcacaacagctgggatttgcagagagtgatccaaccaatgacgtgacgggtaaggatgcggcttacaagatgattatattaagtcaatttgcatttggaactcaactagatattaaggacattgcggtagaagggattgaccgattgaatgacgctgatgttcaacaagcagcgtcatttggatacgtaattaaattactagggattaccaagctggttaataatggagtatttgtcgaagttggcccagtgttaatcccccgtgatcatcctttagcaacaatcaataatgaatttaatgcagtaatggttacagcccaagcagtcggtgatacgctcttctatggccgcggtgcagggggcttgccaactgctaacagtgtgttaagtgatattacaacggtaacgaaaaacattatcctgggaactaatgggaatctctttaataattaccaacaaccttatattccggcaaaacttgctgatataaaatatccatattatttatcgttaaccttgccggatgttcctgggcaaatgttgaagctaacccagatgatgacggatattaatgctagttttcgtgaaataacccaaacaaaagatggcaaaattgcgcacattgcaatcattactcaccggatgagcaaagaacaattacagacattactaactaaagtagctaatgatcagtcaattaacttgtcggcggcttataaagtgatgggataggaggaagtataatgattattcaagcacctgcttccagtgctaatcttggcccgggatttgactcgattgggattgcagtctctttgtatttaaaattagaagtccttggtccaagcgataactggcaagttgatcaccagcttgggaagctccctcatgatgagacgaatatgattgtaacaacggcattaagtgttgcaccggatttgctgccacagcacctgcaggtagtcagtgaaattccgatagcacatggattaggaagtagttcaagcgcaattgttgctggaatcgaattagcaaatcagcttaagaacctgaaccttagcaaggaagaaaaagttgagattgccagccagattgaaggccatcctgataatgtcgcaccgactattctagggggattagtagtggggacacatattaatgggcatttttctgcgattgaagcgcccttattcccctatgcttttgctgcatatatcccgccttataatctaaaaacagctgatgcgcgagctgccttgccatatcaactagaatattcccaagctgttcatgcgagcgcggttgctaatacctttgttgctagtttgtttgctaaaaactatgatgtagcgtttaaattaatggaggcagatcgctttcatgaaccatatcgcaaagagctagttccagaattagatcaaattcgtgaattaggaaaaaaacatggagcactagcaacatatttaagcggcgccggaccaacagtaatgacagttatcgataatgacaattacggattatttgaacaggcagtgcatgctgcggggctaaagggaaaagtagtccgtttacacccagatgttgaaggagttaaactaatataatttaggaaagaggctggaaatggattcggccttttttcttttttatgaattttaacgaactattttatgttttaactttattaagttcgatttttacattgaattataaaaaaatctttgctatccttaaagcagatttgaggaggcattgttatgagtgatattagtgtagtaatgggcagtaaatcagactggccaactgttaaagaaacttgtgatattttagatgaatttggcgtttcatatgaaaagaacgtgatttctgctcatcggatgccaaatgaaatgttcgcgtttgcgcaaaatgcggttgataatggggtcaaagtaataattgcatgtgccgggggagcagcccatcttcccggaatgattgcggcaaatacccccctgccagtaattgggatcccaggacagacaaaagctcttggtggcatggactcgcttttatcaattgttcaaatgccagcgggaattccggtggcaaccactgcgattggaaaagcaggcgctaaaaatgcagcgttattagcattgcaaattcttgggatcacagataagcatatccaacaacaaattatcgaatatcgacaggcgatgcatgatcaagcaaaagaaagtgggcagtatcttgaataaatttattccacaaggctcaactattggcattattggtggtggccaattgggacagatgatggcattggatgccaaacagacggggatgaaggttattattttagatccgacaccaaattgtccagcggggcaggttgctgatgaacaaattgttgctccttatgccgatactaaagcgattgaaaagttagctgataaagcggatgtattaacctacgaatttgaaaatgttgatttaaacgctttggaagatgtacaggatcgcgtttatcttccccagggaactaatttgctttacacgaccaaaaatcgtttacgggaaaagaatttcttacgtcaggcaggggtaaaaacagcacctttcatggaagtgcatacttctgctgaattaaaagatgcagtaaagaaaatcggttacccagcagttttgaaaactagtgaagggggatatgacggacacggtcaagaagtattacgtaataaggatgacctcgataagtgtgcgtctattttagccactggcgactgtatcttagaaggctgggttccttttaaccgcgaatgttcagtaatggttggacgtaatgaagatggagaaataacggcttttcctgtttcagaaaatattcaccatgatgaaattctacatttaagtattgtcccagcaagaatctcttctgaattacaacaaaaggcgcaaaaaatagcggtgcagattgcccaagcgattaatttgcgagggattttaggggttgaaatgtttgtaacagatgatggagagatctatattaatgagcttgctcctcgtcctcacaattctggtcattattcaattgaagcttgtaacttttcacagttcgccatccataatcgagcaatttgtaactggccactcccacaagtagagttattaaagccggtggtaatggtaaatgttttaggtcagcatgttaatggagtccgacaacagattcagaaaaaggcaaattggcattttcatgattatgggaaagcagaagttcgtcataaccggaaaatgggccacgttacaatcttgactgatgatattgaagctactttagcagaaattgacaatacaggtatctggggtgcataaagttcggctttacgtaaccgcttttcctgtgcgataatacatttagaaaaaatagagaggatttttaactgatgattgatcgttataccagtccagagatgaaaaagatttggagcttagaaacacaataccaatgttggttagatgttgagattgctgctgatgaagcgtggagtaagcttgggcatattccagcagaagatgtggaaaagattaaaaagaatgccaagttttctgtggagggaattgcagagattgaagcagtgactcatcatgatgtgattgcttttacccgtgatgtttctaaatcattggggcctgaacgaaagtgggttcactacggaatgacgagtacagatgtagttgatactgcacaaggcttgcgattaaaaaaggcgaacgatatccttcgtcaagatattgataactttatggatgtccttaaagaattagctgaaaaatataagtacacagtttgtatgggacgaacacatggtatccatgctgaaccaacaacttttggcttgaaagctgctcggtggtattcagaaatgaagcgtaataaagaacgttttgaacatgctgctaagggtgtcgaagcgggtaaaatttctggtgcagtaggaacttttgctgaaattgacccatttgttgaggaatatgtctgcaaaaaacttggcttacgtcctcaagaaatctccacacaagttcttccgcgagatttacatgctgaatatattgctaccattgcgcttattggaacaagtatggaagaaatggcaaccgagattcgctctcttcaacgaacggaaatccatgaagtcgaagaacactttgccaagggacaaaaaggatcttctgctatgccacataagcgtaatccaattggctcagaaaacattactggttgtgcgcggatgctccgtggctttatggtgcctgcttatgaagatgtttcgctttggcatgaacgggatatttctcattccagtgcagagagaatgattttaccagatgcaacttcattacttgattacatgttgcggcgttttggtcgaatcttaaagaatctcgatgtattccctgaaacaatgaagaagaatatggacaagacattgggcttaatttacagtggtcgggttcttttgaagttggttaacagtggaatgactcgggaagcagcttatgatttgattcaaccatataccgctaagtgctgggcagaacagattccgttccgtccattattggaagatgacccaacaattcaaaagcaattaactaaagaagatcttgatgatgcctttgattaccactggcacctccgccatgttgatgacatttataaaaggttgggattagactaatttaagttagtttaagaggctagacgaacaaaaaagtttgcctagcctttttattatgctttgtttagtaaaacacgaacaatttgaactgaaaatcatataaatatcgtaattcgtattgacaatcgggagggggaaagagtatattgttgtcatgaaatatcgaattaattttcggatattaaaataaatgttcgttttttactgaaaggaagttccgtaaatggagaagttattgtataccggcaaggcaaagcagatgtggcaaactgaggatccagcggttttacgagtagtttatctggaccaagctaccgccctcaacggaaaaaagaaggatcactttactggtaagggtaaggctgccaatgctatttcttccctcgtttttggttacttaatgaagcaaggaattgagacccactttattaagaaactatcaactaacgaagaccttgtaaaaaaatgtgagatgttcccgcttgaatttgtaacgcggaatgtaattgctggccattttgcaagtcggtatggactttcagaaggggaagagcttccttcaccagttgaggaaacgttctataaaagcgatgagcttaatgatccctttatcaatgaatccgcaacgattgctcttgagattgccagcaaagaggagcttgcgcaaatgtgggggatctgtcggaaggtcaataacttacttaaaccattatttgccaaagctaatttacggttggttgacttcaaactcgaatttggccgtttaagtgatggcaagattattcttgcagatgaattttcgccagataactgtcggttatgggatctgacaactatgcagcatatggataaagacgtatatcgacgcaaacttgctgatttaacccaaacatatgatgaggtattggaacggttagaagcagtgatgaaggaggaagcataaatggttaacgttcggattttcgtaacatataagcaatcagtctttgatccgcagggagaaacaattaaggatgcgatccattctctaggtcatgatgaagtaactgccgttaaagttggaaaattttttgacgttaccttggatacaaatgaggatgaggtagcaacggcagtaaaagaaattgccgatcagctccttgttaatttcaatatggaaacttatacataccaagttatggaggaagcctagatgaaaattgcggtggttgtttttccaggatccaattgcgatgtggatttatatgaagcccttcattccgtttgtcatgcagatgtggagtatgtttctcaccggcaaaaaagtttagctggttttgatgctgtgatgttaccaggaggattttcctatggtgattatctacgagctggcgcaattgctcggtttaccaatatcatgcctgcaataatcaaaatggcaaatgagggtaaaccagtctttggaacgtgtaacggatttcaaattttgacagaagcaggtcttttgccaggtggactcaaacgcaatgatagccaacgctttgtttgtaaaactgttcctttagaagtagtgaactcgcaaactctttttactagtcattaccaggatcacgaacgaatcgcattaccaattgcgcatgccgatggtagttactatgcagatgaaaaaacattagatgaactggaagcaaataatcaaattgtttttcgttacgcgactgaaaatccaaatggtagtttacgcaacattgctggaattactaataagcacggaaatgtcttaggcatgatgccccatcctgaacgggcagtagaaactattcttggcagtacggatggcttacggttatttgaatccttgttagaaaacggcagaattaaagtggaggcatagttaatgaagcaagcaatgaccccagaagagattaaagaaaagaaaccatacttagattggagcttgacagaagcagaatatgattacattcgtacccagctcttggggcgattaccaaattatactgaaactggcttattttctgcgatgtggagtgagcactgttcatataaaaagtcaaagccggttctgcgtctcttccctaataaaaatgagcgagtattgcaaggtcccggagaaggagcaggggttgttgatattgatgatggacaagcggtggtattcaaagctgaaagtcacaatcatccgacaactgttgaaccttatcaaggagcagcaaccggtgtcggtggaatcctgcgagatattttcagcatgggggcacgaccaatcgcttcccttgattccctccatttcggtgaattagataattcgacaacgcggatgaaagtaactaataccgttcggggaattggtgattacggtaattgtatgggaattcctacaattgcgggtgaaacaacatttgatccatgctaccagggcaatattctgtgtaatgcaatgagtgtcggcttaatggaccagaaagatatccagcagggtcgcgctgccggaattggaaatgcagtgatgtatgtcggcgctaaaaccggccgtgatggaattcatggcgccacctttgcttccgcagactttaatgatgaaaatacgacgcaacgttcggcggttcaagttggtaatccttttatggaaaaactcttattagaagcctgtcttgaccttattagaaatcatccagactggttagtaggaatccaagatatgggggcagcagggattgtttcttcaagtgcggaaatggcttccgaaggtaaaagtggaatggagctaaatttggatcttgttccgcaacgtgaacccgggatgtcggcttatgaaattatgcttagtgaatcccaagaacggatgctactttgcgtaaaaaaaggtcatgaagaagatgtcaaaaagatttttgatttttacgatcttgaagcggtcacaattggccggattactgcgggtcatgattatgttctctttcatgatggtgaagaagtatgtcatatcccagtgtcgagtttaacggatgacgtactagaagaagaaagcctcgaaaaaaagcctgcgcggattgaattagccgagcagcagccagcgtggattccagatgttgataacgttgctgaagttttaactgccttgcttgctcagtcaacgattgcggataaaagtagtctttatcagcaatatgattctcaagtacggacaaacacagtggctgggcccgggagtgatgctggagttctgcggattcgtggaacacataaagggttagcgatgacaactgatgggaacggtcggtttgtttaccttagtccagaagttggtggacaaattgccttagttgaagcagctgccaacataattgccagtggagctgagccgttagcaattactgactgcttaaattatggtgacccaactgatccagaaattttctgggaacttcatcaatctgttcaagggatggctgatgcttgccgtgaatttaatactccggttatttctgggaatgtttctttatataacgaaaacaatgggcaagcaattcatccgacgccgatggttggaatggttggtctaattaaaaatattgatcgcgtaattccttcgtttgtccaatacccgggagataaggtttatctagtgggccaaactcgtgatgattatgcggggtctgagttgcaaaaaatgatgaccggcgatattagcggaattgttaagtcatttgaccttcaccatgttcatcaatatatgcaacgtttactgacgacgatggagaacggccttgtttccagtgcccatgatttgagtgaaggtggtctcggagtagccttagcagaaacggtcttcaaaactgatttagggttgaaagttgactttgctgatcagccagcagttcgcctgtttagtgagactcctggaagatttatcgtgacggttgctcctgaaaaggcaaccgaattcgaacaggcattaggaaaagatgcacacctaattggagaagttacaaatagccactggttaatggttaaactggcaaatggtgaactcaatgaaagtgttgcaaaattacaaaaaacatgggaggaggcaattccgtgccaactgaaatcaaaggattaaatgaagaatgtggggtctttggggtttttgatgcggctaacgctagtcaattaacctattacggcctgcatactcttcaacatcgcggccaagaaggagccggtattgtctcaactgatggaacggaactttatcagcaccgtgaccgaggattgttggcgaaagtgtttgctgatccggctgagcttaaacgattaaaaggaaacgctgcgattggccatgtgcgttatgggacaagtggacataactcgatttccaatgttcaacccttcctttttcactttcatgatggcgccgttgcccttgcccataatggtaatttaactaatgctgttacccttcgtcgtgaattggaaaatgaaggggcagttttccagtcagattctgatacggaaattttaattcaccttatccggaaatatattaatgaaggttttattcctgctttgaagaaaagcctcaaccttgtccatggtggatttgcctacctattactgcaaaaagatcggttgattgcggctttggatcctaatgggattcgtcctttatgtattggaaggttagaaaatggtgcttatgttgttgctagtgagacttgtgctttagatattattagtgctcaatttgtgcgtgatgttttgccaggagaattaatagttattgataaaaatgggttacatattgaccattacactacccaaactcagctggcaatttgctcaatggagtatatctattttgcccgtcctgattctattattcatggggtaacggtacataatgcgcggaaacgaatgggaaagttattagcaaaggaacatccggttgatgctgatatggtgattggagtacctaactcatcgttgtctgctgctagtggatatgctgaagaaagtggccttccatatgaaatggggttaataaagagccaatatgttgcgcgaacgtttattcaaccaactcaagagttacgggagttaggcgttcatatgaaactgtcagctgtccgcggagttgtaaaaggaaaaagagtggtagtagtcgacgattcgattgtgcgcggaacaacttctaagcagattgtccaaatgctaaaaagagctggggctaaagaaattcatatgcttatttcctcaccaccatttaagtttccgtgtttctatgggattgacgtatcaacgcgttcagaactgatggctgctcattactccattgaagaaatgcggcagttaattggtgcagattctcttaactttttgagtattgatagtttaatcaaagcaattaacgtaccagatgcaggagatgctcctaatggtggacttaccgtggcttattttgatgggaagtacccaacgccactttatgattatgaagaagggtacttaaagtcgttaagcgaacaagagcgattagcaagaaaggggtaagaggatgagtcgttatcaagatgcaggggtggatgtaaatgccgggtacgaacttgttcaccgtattaaagatgcagtcaaatcaactgatcgcccaggggtgattgggggaattggcagctttggggggatgtttgacttagaaaaattacaggtacggcatccggtccttgtctctggcactgatggtgtgggaacgaaactcttaattgcccaacaaatgaataagcacgatacaatcgggatcgatgttgtcgcaatgtgcgttaatgatgtcttggcgcagggagcggaaccaataacatttctcgactacattgcgaccggccataatgatccggctaagatggcagcgattgttagcggagtagcgactggttgccgagaagctggagccgctttaattggtggagaaacagcagaaatgccagatatgtatgcagccaatgagtatgacctggcaggaacagtaacagggatagcagaaaaagaagaacttcttaccgctgctggaccgcaaaaaggtgatattttacttggcctcccatcaagtggcttgcattccaatggcttttcccttgtccggcagatcttatttaaggataatcacgtcaaattaactgatcgcccagaagccttgagaggaaagacggtaggagaaacgatcctgactcctactaggatttatgttcaagcggtcttgccattagtccatcgcaaattggttcatgggattagccatattactggtggaggattgattgaaaatgttccccggatgttagaagataacttgcaagcggtgattgatcctggtcggtggccacagcttccggtctttgactatttgcgggtgctaggaggccttactaaggaagattgtttcgaagcatttaacatgggaataggaatggtcttagcagtagcaccagatcaagtagcacaagttcaagagatactatcaaataaaaacatgacaagttatcaaattggttatcttcgtcattgtttaccagatacaaaaaagattgttatcaagtgagggttgtaaatgagagtcgcaattttagcatcaggaaacggaacgaattttgaagtcttagcacagcacttcaaaaataatgatcttcctggtgaattagcattattattctgtaatcatccagatgctccggtaatgaaaagagctgcccgactggggattccggcagaaagctttacggtcaaatcttgtgggggaaaacaggaatacgaggaaaaattattgggagtgttgaaaaagtatcaaattgactttattgcccttgctggttatttacgagtaattgggcccactattttggatcattatgctcaccaaattattaaccttcatccagcatggttgccagaatatccgggactacattcgattgaacgggcatttgctgatcaacaagcccagacaggcgtcaccgtacactatattgatgcgggactcgattccggcccaattatcgcccaggaacacgtcccaattttaccaactgatactattgaaaccttagaagcacgggttcatgaaactgagcaccggttatatcctgaagcactaaagcaggcattagaaaaggagcaacattaaattatgaaaagagcattagtaagcgtttctgataagcaaaacctggtcccattcgttaaaggattagttgaaaatggttttgaaattatctcgactggtgggacgaagcgggttttagatgaagcgggaattgaaacaattgggattgaggatgttactcattttccggaaattcttgatggccgcgtaaagactcttaacccatacgtccatgggggactattggctcgccgggacttaccggaacacatggcgaccctcgaaaaacttaatattacgccaatcgatttagtctgtgttaatctttatccatttaaagagacgatcgaaaagccgggagtggaattagccgatgcaattgaaaatattgatattggtggtcctagcatggtccgctcagctgctaaaaactatcatgatgtaacaatcgtggtggaccaagccgattacgatgaagtcttagcccaaatcaaagaagatggtgaaacatcattagcaactcgagcacgcttagcagcgaaagcctttcgtcatacggcagcctatgattccctcatctctcaatacctcacaaaacagacagggcttgaagatccagaaaaattaactttaagctgggatttaaaagaaacaatgcgttatggtgaaaatagtcaccaaaaggcttggttatatgaagacgcgcttcctaaggctttttcagttttacaggctaaacaattacatggtaagaagctttcctacaataatattaaagatgctgatgaagcattacggtgcattcgcgaatttgatgaaccaacagttgtagcgatgaaacatatgaacccatgtggcattggccgaggggatagtttggttcaagcttgggatcgtgcctatgaagctgaccctgtttctatttttgggggagtgattgctcttaatcggcaagttgatttagctaccgccgagaaaatgcacaaaatctttttagaaattgtcattgcacccggctttgacgatgatgcatttgagttattggcaaagaagaaaaatattcgtttgttgagtctggactttagtaagaaggatgaaccaactaaacatgaagttgtttcagtgatgggtggaatgttgttgcaggaacaagacacgcttaaggaagattaccacgactggcaatgtgttactgaaaagcaaccaacagaggaacagcttaagacattaatgtttgcctggaaagcagttaagcatgccaaatcaaatgcgattgtcttagcaaatgatgagcggacattaggggtcggagaaggtcaacctaaccgaattgattcattgaaaattgccgtaaaacatgctggcgaggcgattgatgaccggacagtgatggcatcggatgctttcttcccatttggtgattgtgttgaatatgcgggtcaaaatggcattaaggcgattgttcagccaggaggatcaattcgcgatcaagaatcaattgagatggcaaataagtacggaattgcaatggtcacaacaggcattcgtcatttccgccattaaagctaggagggtatcatggaaaagcaggtcaacgtattagttgtaggtgaaggcggtcgtgaatttgccgtggcgaaaaaattacaagaaagtccccgtgttaagcaagtttattgtgcgccaggcaacgtggggatgtcgactgtaggagtagttcccattgcaattgcggaaactgactttgctaagctgattcaatttgctaaagaacataatgtcgcgtggacattcgtgggccctgaggattgcttggttgatgggattgttgatgaatttaaggccgctggattaaaggtttttggtcctgatgcgcgggctgcccaattagaaggctcgaaagactatgcccttaattttatgaataattatcacgttcccactgcccgccatgcgacatatagggatcaaacagcagcgattaataacgttgggcaatttggctttccagtagtaattaaagaaaatggtttagctggaggaaaaggggttgtcattgcaaaagatcgtgcagaagcaattaagacaatcaaagaaatgtttgtcaatggtcaggcgcgccttgtgattgaagaatgtctatcaggtcctgaatattcaatgtttgttttgattagtaatggccactaccgaattttgcccatggctcaagaccacaagcgagcatttgatgacgataaaggtcctaatactggggggatgggggcttatagtcccttgccacaactttcctcagccgttcgtcaacagatgattgatgaagtacttaagccaacaattgatggtttggtggctggcgagtatcactaccatgggattttatatattggccttattttgactgataatggtccaaaagtgattgaatataatgttcgtctaggtgatccagagacccaggtgattttgccccgcatgaaaaccgacttgttcgaacttgtagacgcagcaattaatgatcgaccattaccagaagttgaagaaaatgaagatgcttgttttggtgttgttttggcatcgaaagggtatccaactaagccaatccacggccaaaagctgggaacatttccagttgatcctaatgttactattgattacgcaaatgttgctggaacaattaatgacttaaaaggtgcaggtgggcgtttgctaatggtgatcgggaaagatgattctcttcaaaaagcccgcgatcacgtttatggctacttgcgccagcttgatgaacctgaatgtttttatcgtcatgatattggtgcaaaagctggactgcaataatttcttcatcactattggcatttgcaggggaatggattaaaataatatggtaatgctgtttatagcgattttaagaagaaagaggtcaattgaacatggctaaattagtattaattcgtcacggtcaaagtgaatggaacttatctaaccaatttactggttgggttgatgttgatttaagtgaaaagggtgttgaacaagcaaagaatgctggtaaagcccttaaggaacacggcattgaatttgactacgcatacacttctgttttgaagcgtgctatcaagactttgcactatgctcttgaagaatgtgaccaattatggatccctgaatacaagacttggcgtttaaacgaacgtcactatggtgcacttcaaggccacaacaagcaaaaggccgctgaaaagtatggtgacgaacaagttcacatttggcgtcgttcatacgatgtattacctccattgctaagcgctgacgatgaaggttctgctgcaaaggatcgtcgttacgctaacttagacccacgtgctattcctggtggtgaaaacttaaaggttactttggaacgtgttattccattatggcaagatgaaattgcgccaaagcttttggacaacaagaacgttatcatcgctgcccacggtaactctcttcgtgcattgagcaagtacatcgaaaacatttctgatgaagacatcatgaaccttgaaatggctactggtcaaccggttgtttacgacttcgatgacaagcttaacgtattaagcaaggaaaagtactaaaataaacttacgatattaaatttgaagaggcgggaaagttagattcctaacgccttttttttgtagcttttttgaagaaatgttgaagatattgatgaataaattgagcttatagtgagttgtggtatgattaacatcagaatctaataaggtggagagaatttaaatgaaaatggaaaaacaacgaacactcccaatgaaggaattttacctttcattgaaacaactggtaaagcctaactatttaaaggcaatgtggccagttgcaggggtatcaattatttttattgctttagcagcgatcttagcactccttaattcaaacattgctgcctcattgagtatgacgatgatgatggtaatgtacgggatggcttccccggttgcaatcttgttctcattattagaaattgtagggattgtcgcaattattgctgcgttagccttcttctatactttctttgcagttgctacccaatatacatatcaggataagatggctcatccagaacaaccagttagtgctggatcaatatggatgcactataagcacttgcgaaaaaaccaagtatggcggattattctttacattggattgtttactttcttatggagtttgcccctcaacattgttaacgcattactcttgccacatttatccggagtagccgctgtttatacggggtgggcaattcgcatccttaatgatattgtcgtattatggaagagtattgaatattctcaatcatacttcctttatcgtgaaaagcagccacaattccttagccaatcaatgcgttatgctttaactgctagtcggcggttcatgactggtcgaaagtggaactactttgcaattctgtttattttagaattccttccaatgtttatctggactttaatttttggtggattggcattttacggcgtttatacggcaacttatgtccttacttatatcggaatcgttttagtggttgttggtatttcctgctaccttccagtggtatatgcaattcttgctttgtactacaacaaggctcgagcaggaatggaaatggatgtgctttttaaggatacttttaagccagtagccgaattaaccggtgaagcttatgttcatgaagtatatgtagaaaaacaaccaaaagaacaaccatcaccaactgttaagcgtgatgatgaaaagaaacacgaagcaaaaaaagatgaatagtgaagcgaaaagctgaagggtaacgaaaactcttcagcttttttgtattttaaatacttcttgacagtaatcattaattccatgtacaatgacggcaataaccaaagatgaagaagtaatcttagtagtaagcggttggacatttaggaagcaagtggtaactgtaaactttgccaatgccgttatacgaattacacttacggagtctttcagtatttgaacggatcgtctcgttatcgactagagtggtagctatttagctgcaaatcaaggtggtaacgcggtaaatcgtccctgacttcattatttgaagttggggattttttgtatccgagaaatttatggaggtaaacatggatattcttaatgaactagaatggcgtggggctattaaccaagttacagacgaagaaggcctacgcaaattaacatcagaagataaaattgctctttactgtggaactgatccaaccggggatagtcttcatattggacacttaattccatttatgattttgaaacgatttcaattagctggccaccatccagtaattattattgggggaggaactggtgcaattggtgatccatccggtcgaaagtcagaacggcaacttcaaaccatggatcaagttcaccacaacgaagaagcattaactgctcaaatgaagaagttgttcggcactgaaaacttcacgattgtaaataactatgaatggttatcaaagatcagcttgttagactttcttcgtgactacggtaaactatttaatatcaacaccatgttaaataaggaagtagtagcaagccggttagatgctggtatttcatttactgagttcacttatcaaattcttcaatcagtcgatttccttcatctttaccgtcacaatgatgtgcaattacagattggcggctccgatcaatggggaaatatcactgccggaattgatttgattcataaggttgaaggaccagatactaaggtttacggacttactattccattaatgctcaaagctgatggaactaaatttggaaagaccgcgggtggtgcaatttggcttgatccagaaaagacctctccatacgaattttatcaattctggattaaccaagatgaccgtgacgttattaaatacttgaagtacttcactttcttatcaaaggaagaaattgatgacttggcagaaaaagttgagaaggaaccatggaagcgagaggctcaacgtcgcttagcccaagaagtaactaaatttgttcatggccaagaagcagttgaagaagcagaacggattagtaaagcattgttctctggggatgttactgacctttctgttgcagaaattgaacaaggctttaagaatatgccttcagtagatgtagaaaataagaaagaaaatattgttttatggttaaccgataatggcattgaatcttcacgtcgccaagctcggcaagatgtatcgagtggagctatcaggattaatggggaaaaagttgatgatgttgacgccgagattgatccccaagcacattttgatggtaagtttgtgattgttcgaaagggtaagaagcactattacttagctcgcgtaaaataaattagaccaattgttagcaaatacgttcttaaaagatgatttaagggcgtattttttatttttagatataaaaaaacaaattttttctatttcgaataataaaaaggttcaggtttaaaaaataaattaaaaaagttgaaaaaaggtgttgacgaaagaatgaaatccatgtatagtagttatcgttgtcaaaacagctaagtgctgttgagatggtttaacaaaaaagttaaaataattgttgacatcgacttggcaacatgatatattaataaagttgctgattgagttatcgatcaaaagaaattaaaaaataatttaaaatttcttcttgacaagttaatctgatacatgatataatgaaattgttgattggctgcttaattaaccgacaggtagacctttgaaaactgaacaaagtttcgacgaatcaaatgtgtagggtcttcaatcacgatgtgatttgaagcaaaacatttgcgaagtcaattcgcttaataacaaagataattgagagctattcaagttcttatatattttatatgagagtttgatcctggctcaggatgaacgccggcggtgtgcctaatacatgcaagtcgtacgcactggcccaactgattgatggtgcttgcacctgattgacgatggattaccagtgagtggcggacgggtgagtaacacgtaggtaacctgccccggagcgggggataacatttggaaacagatgctaataccgcataacaacaaaagccacatggcttttgtttgaaagatggctttggctatcactctgggatggacctgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacggggcccgcacaagcggtggagcatgtggtttaattcgaagctacgcgaagaaccttaccaggtcttgacatcttgcgctaaccttagagataaggcgttcccttcggggacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcaagctcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgggagtttgtaacgcccaaagtcggtggcctaacctttatggagggagccgcctaaggcgggacagatgactggggtgaagtcgtaacaaggtagccgtaggagaacctgcggctggatcacctcctttctaaggaataaaacggaacctacacatcgaagaaactttgtttagttttgaggggtttaccctcagagcttgtactttgaaaactaaatactatctaatttctttattaacaaaacaataaaccgagaacaccgcgttatttgagttttaattaacgaattataatcgctaactcaattaatcagacaatctttgattgtttaggttaagttatgaagggcgcatggtgaatgccttggtactaggagccgatgaaggacgggactaacaccgatatgcttcggggagcggtaagtacgctttgatccggagatttccgaatggggcaacccaatcagcttagtcgctgattacttgactagtgaatacatagctagcaagaggtagacgcagtgaactgaaacatcttagtagctgcaggaagagaaagaaacatcgattccctgagtagcggcgagcgaaaagggaagagcccaaaccaacaagcttgcttgttggggttgtaggactgaatattagagttaccaaagtgcgacgtagtcgcaacagttgggaagctgtgccatagagggtgagagccccgtagacgaaacgtcacactctctgttcaggatcctgagtacggcgggacacgtgaaaccccgtcggaacccgcgaggaccatctcgcaaggctaaatactccctagtgaccgatagtgaaccagtaccgtgagggaaaggtgaaaagcaccccggaaggggagtgaaatagttcctgaaaccatgtgcctacaagctgtcggagcccgttaatgggtgacggcgtgcctcttgcagaatgaaccggcgagttacgattacatgcaaggttaaggtggaaaaaccggagccgtagcgaaagcgagtcttaaatgggcgtaaaaagtatgtagttgtagacccgaaaccaggtgacctacccatgtccaggttgaaggtgcggtaaagcgcactggaggaccgaacccgtgtcagttgaaaatggctgggatgaggtgtgggtagcggtgaaattccaaacgaacttggagatagctggttctctccgaaatctctttagggggagccttgaggtaaagaatcgtggaggtagagctactgtttggacaaggggcccgtcatgggttaccaacttcagataaactccgaatgccatcgatttatactcaggagtcagacgatgagtgataagatccaccgtcgaaaggggaacagcccagatcaccagttaaggtccctaaatatatgctaagtggaaaaggatgtggagttgcatagacaactaggatgttggcttagaagcagccaccatttaaagagtgcgtaatagctcactagtcgagtgatcctgcgccgaaaatgtaccggggctaagcatattaccgaaactgtggatgtgcactatgtgcacgtgataggagagcgttctaagggcggcgaagtcagaccgtgaggactggtggagcgcttagaagtgagaatgccggtatgagtagcgaaagacaggtgagaatcctgtccaccgaatgactaaggtttcctggggaaggctcgtcctcccagggtaagtcgggacctaagccgaggccgagaggcgtaggcgatggataacaggttgagattcctgtaccagttaactgcgtttgacgatggagggacgcaggaggctaagcaaaccgtacgactggaagagtacggccaagcagtaagtcaggatgtgagtcaaatgtttacatccgcgttgacaagctgtgatggggagcgaaattaaagtagcgaagttgccgatgtcacactgccgagaaaagcttctaaggagtagttaactgcccgtaccgcaaaccgacacaggtagtcgaggagagaatcctaaggtgagcgagagaactctcgttaaggaactcggcaaaatgaccccgtaacttcgggagaaggggtgctggccgcaaggccagccgcagtgaataggcccaggcgactgtttatcaaaaacacaggtttctgcaaaatcgtaagatgaagtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcgctgtctcaacgagagactcggtgaaattgaaatccctgtgaagatgcagggtacccgcgacaggacggaaagaccccatggagctttactgtagcttgatattgagtgtttgtactgcttgtacaggataggtaggagccgtagaagtcgggacgctagtttcgacagaggcgctggtgggatactacccttgcaatatgaccactctaacccgcagcactgaacgtgctgggagacagtgtcaggtgggcagtttgactggggcggtcgcctcctaaaaggtaacggaggcgcccaaaggttcgctcagtatggttggaaatcatgcgcagagtgtaaaggcacaagcgagcttgactgcgagacagacaggtcgagcagggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacataccgctggtgtaccagttgttccgccaggagcaccgctgggtagctatgtatggacgagataaacgctgaaagcatctaagtgtgaaactcgcctcgagatgagatttcccatttccttcgggaaagtaagacccctcagagatgatgaggtagataggatggaagtggaagtgccgtgaggcatggagcggaccattactaatcggtcgaggacttaaccaaggagcggtaaggtttattggaagagaatagataggatttagttttgagagcacaagctctcgtccgaagggacaaagagtgtggtgatgatggcttgaaggatacacctgttcccatgccgaacacagaagttaagcttcaacacgccgaaagtagttgggggatcgctccctgcgaggataggacgttgccatgcgatcaaaacgtgaaccggttaaacgattcgcgtcttttctttaataatagtttctggtataattaattaggaattgttattatgctgacttagctcagttggcagagcacgtcactagtaatgatgaggtcggaggttcgaatcctctagtcagcataattaaaacttacaaagtttattaatccttgatatatcaacgttttacgaagatgtattagggattatttttgtttatttaagaatgttatgcacacggctgtgcacacaaaataatcgtgtgcatgagcttgcatcggagaagtgcgtaaaccattgatatattaggctttatagattattttttgtgtgcatttaactgcttttgctatgatatagtgatgaggtcggatattcgaatcttctagtcagcactagatagtgtaggatagcctattataacgctgtttatggacgttataataggctattttatatacaaatatgttatcagtttctcacttttttctcacgtgaacactaaatggttgttttgaatttttgagaagtagcgctaatgcagttatatcaaccatttaagctgttagagtgtgtgaaaaagtgtgaaatgaagattaaaagtatatcgttaaaataatataaataattttagatattaagtatattgttttcttcagaaaatatagagaaaaattcaataagatgaagggctttgattttctaattaaagccttttaattataggttgaagaagaaagtttttaggatcaaatttggatagtatataaccatttttgaatattattcttatttaagcagatcacaatatgttataaaattaaaataagggtatgttatgagtgcaaataggagtaaaaaatggttaataaaaaagagttgtctgaagaagatgtaaaaacaagatatattactcctgctattgaggacaaaggatggactcctcaagactggcgtatggagtatgagtacacggatggaagaattactgttgttaacaatacaaccaaacgtggagaacgtaagaaaatagattatctattaaattatcatgaaaatgttcctttggctattattgaagctaaagacttgaaacatacatacgatcatggtatgcagcaaggaattgactatgctgaagggttaaaacatgctgaatccttacaagtaccttttgtgtatgctagtaatggagaggcatttcttgaacatgatatgctaacgggtaaagaacgtaagttagcaatgaatgaatttccaactaaagaagaattatgggaacggtttaagcaagaaaagggattaacccctaaacagatcaaagtaattaatgaaccatattattcaacacgtgaatcaagaaagccaaggtattaccaaagaattgcaattaaccggtcagtgaacgcaattgctaatggtcaacgtcgggtaatgttagttatggctactggaactggaaagacttttactgcctttcagatagtttatcggttattacaatctgggattaagaagcgtgtattataccttgctgatcgtaatattctggttgatcaagcaatgacagatgattttagcccgttgctaagtaaagcaactaaagtacgaaatggaaaaatggatagttcttaccaaattcattttgctttatatcaacaattagcaggtcgtgaagaagatgctgggcatgaacctttccgtcaattcaaacgtgatttctttgatttagtagtgattgacgaagcccatcgtggctccgctaaaaaggacagtcagtggagaaaaatattagattactttgatggccctaatgtgacccattttggtatgactgctacacctaaaaatgagaagggtgcatctaatattgattattttggtgaacctatctatacatattccttgaaacagggaattgatgatgggttcttagcaccatatcgagttattcgggtcaactttgatgttgatattaatggcttccggcctactaaaggtgaaaaagacgccaatggccaagtaatagaggatcgtcagtatacatcaaaggactttgatcgtacaatgataattgctgatcggactaagaaagtggctaaatatattagcgattatttgaagaaaaatcatgaacgatttaataaaacaattattttctgcgaagatattgatcacgctgaacgaatgcgaacagctttagtaaatgaaaatgctgacttagtacagcagaatcctaagtatgtcatgaagataactggtgatgataaggttggtaagggtcaattaagtaattttgaagatgttactagtaaataccctgtcctagttactacatctaagttattaactactggggttaatgtaaaaacttgtaagttaatcgttttagaccaaaatattaattcaatgactgaatttaaacagattattggtcgtggtactcggttagatgaagcacatggtaaaacattttttacgattatggactttaagggtgcttcacgtctgtttgctgacccaaagtttgatggtgaacctgaagataccgttatagatgatgatggtcaaggcggagtggactttaacaatgacgataagaagacagataaaaaagaggagtctgatatcggtgataaagttagtgaaggtaggacaaaatacttagtaaataacaaacaggttcaaatcgtcaactctcaggcagaatatttggacgccgatggtaaattaattactacatcattgcgtgactacactaaaaagaacgtgcttggacagtatgctactttggataaatttattgaagagtggcgtaaatctgataacaagcaagagcttttaaatgatatggaaaatcatggtattttctacaaagaaattattagtgatgagaatctaaaagatttagatccgttcgatttactagttcacttggcttataaccaaaagccattaagtaagtcagagcgtgttgctaatgtaaaaaagtctggattattagacaagtatcagggtgaagcaagaaccattcttgaagcgttacttgataagtacaaaaacgatggaattgaagaacttgaaagtcgcaagacgttaagcttaccagagtttgaacagtatggtgggccagttaagattattctgaaagtatttggtggtaaaaaaaactatcaaaatgcagtttcagaaatgaaagagaaaatttacagttaggattaggtggcaatggcgaatacacaatttgtaaaacgaattcaggatattatgcggaacgatccggggatcaatggtgatgcccagcggattgaacagctatcatggatcttgtttctaaaggtctatgatgatcgagaaatgatatgggaattagacgatgatgaatatacatcaattattcctgatgggctacattggcgcgagtgggcacaagataataaggatggacaaagccttacgggtgatgagttactagactttgttaataatcggttattaccttccttaaagaaaattacagttacttctgatactccaattagtaagtcgattgtaaaagatgcttttattgatgctaataattatatgaaaaatgggattcttttacgccaagttatcaacgtggttaatgatgttgactttactgatcctaaggatcgtcatttatttaatgatatttatgaaggtattctaaaagaactccaaagtgctggtaattctggggaattctacacgccacgagctttaactgattttattgctaagacattgcagcctaagttaggtgaacgagttgccgatttggcatgtggtactggcgggttcctagttagcaccttaaatatcctgaataagcaagtaaagacggttgaagatcgtgagaattataaccgcgcagttttcggtatagaaaaaaagggacaaccatatatattagcggttactaaccttttgcttcatgacgttgataatcctgacattatccatggaaattcattagaaaaacgggtcgcagattatactgacaaagataaatttgatgttatcatgatgaatccgccatttggtgggtctgaacttcctgttattaagcagaattttccaactgatttacaaagtagtgaaacggctgatctatttttagccttaatcatgtatcgcttgaaggataatggtcgagttggtgtaatcttgcctgacggattcttattcggtaatgacgatgccaagattaaccttaagaaacggatgttaaatgactttaatttgcataccattattcgcttacctggtagtatctttagtccttatacatcaattgatactaatattctcttctttgacaagactggtccaactaagcaaacctggttctatcgtcttgatatgccagaaggatacaaacatttctcaaaaactcgaccgatgaaattagagcatttcaagccagttgaagaatggtggaataatcgtcatgaaattcaagatgatgccggtaattacaagtccaaggcttatactccacaagaattagctgacaataactataattttgatctgtgtggattcccaacagaaactgaagaagtcttaccaccagaagagttaatgggtaagtataaagaagagcgggcagaactaaatactaagattgatcagacactcagtaagattaaagcattgttagaggaggatgattaaatgactcctgaacaattgcgggcttctattctccaacaggcaatggaaggcaaattggttaaacaagaccccaatgacgaacctgctagtgaattactagaaaaaattaaagcagaaaaagaacaactggttaaagcaaaaaaaattaagaagactaaagccttacctaaaattacggaagacgagaaaccgtttgatattcctgaaaattgggaatgggttagattaggtactgtttttaatttacaagcaggaaagaatagaaaagcttctacaattaatgaaattaaaactgtagattatgattatccttgttttggtggaaatggcataagaggttatgtatcagactttaatagagaaggaaaatatgcattaataggtagacaaggagctttatgtggaaacataaattttgctaagggaaaattttatgctacagaacatgctgtcgttgtagaaatatttgctggtacaaattataaatggagtggatattttttaaaggctctcaatttgaatcaatattcaacagcaacagctcaaccaggcctatctgttactaaaattaaccgtgtattaattccattaccgccattaaaagagcaattgagaatagtagcaaagattgaaaagttaatgccattaattgatgagtacgcaaaagcatataatcgactaaaagcaattgatgatgattttaacgataagatgaagcaatccatcttacaatatgcgatggagggcaagctagttaagcaagatcccgatgatgaaccggctagtgaattgctgaagaaaataaaggatgagaaaaaacaattagttaaagaaaagaagattaagcggagcaaatcattgcctagaatttctgaagatgaaaaattattcgacattcctgaaaattgggaatgggtaagattaactgaagttggatcctggggagcaggtgcaacaccatctcgatcgcatcccgaatattataatggtggaattccttggctaaaaacaggtgatttaaatgatggggttattagctctacttctgagacaatatctcaagcaggtgcagacaattcttctgtaagatttaaccaaccagggaatattcttatagcaatgtatggcgctactattggaaaattaggaatagcaggaatttcgttaactactaatcaagcatgctgtggatgtaagacttttgatggaatatataattggtatctcttttattatttattagcaatgcgacctcttctaattgatcaaggatcagggggagctcagccaaatatttctaaaactaaaattgaaaagtttccttttgcactaccaccatttgaggagcaaaagcgtattgtaactaaaattgaaaaactaatgcctttattggttgagtaataaatctataaggaaaaattaacaggtactgcataaagtctgacgtgtacccttaaagttggaacctgtatgttcttgctttaaaattgaataaatatttttctaggcaactagattctgctcatattgaagtggagtttggttgcctagttttgtctgaatacggcgttcgttgtaaaagtgaatccattcattaattgcttggcttaattcttcttgattgcgataactggtatcaggaccgatttctgctttcagtttactaaagactgtttcacaggcagcgttatccagacaggttgctcgatgcgacatgctttgcctaatgtttccctgacgaagtagtttgcgccaagcacgatgttgatagtgccagccttgatcagtatgtaaagttaattggtatcctgtatgaggtaactgcttaagtaattgctggagtggatctaatgcgaattgaagatttggatgttgactgattgaccaagtgagaagctggttagttgccaagtccttaataatttctaagtacacttttcgcccatcatgagcctttaattctgtaatgtcacaaaccattttctgatatttacggttactcataaaacgccgatttagcttattcttagctttcttgccatttggtcccttagaggaatcatacttacggactcgccgattatatttgatacatttaagtcccatttcatgcattaagcgctgaatgcgcttatgattaggtgtctttttaccaattaagcgatagtagtctcgaatttgagtgcttaaacggcgtacgccgtattcagcttggtagtagttaaagagacctttaataacggctttaagttcttcttcatcctcatccggatgttcaaaccgattttgccaatactgataggttgacatggaaatgggaagtgcatcgatcaaatcctttaataagtatttagccttgaggtcataaattacttgtgcgagttcttttttggatgctttctcaaggctgtcaatttttttgaggcatcgagttgtatctttaacaataagttttctctttgtaaagcttggttctgtttttggagctgaagaagcttgtcttgattcttgtcgtgtcgtttgaccatttttaggtttccttccccgacgcaatctcagtaaagcctgtggcccttgcttgttatagagacattcccactgatacactgaacctggggaacgatatccaaagtgaatacaagtttctgaaattgacgtcaaattttcttgtttccactttacctaaccgaaaatccccagttactttgggtggattgagtaatggtcctttaccaaatcttgcataaattcccacccaaattttgaaatcatgttcagcaatcccgtatttatgcctaactgatgctaaagtaacattaccgttggcatattcttcaacagctttaagtttagttttaacgctaattttggtcatataaaatacccccagagttgatttccaactctgggggtacacgtcagaggattatcctcaaggcctgtttttatattgagagaattctaagacagtagtatattgatattaaaatttaatgagaaagaagatgggagagtagtggctaaggagagaaaagaaacgatctttacgaaggatattgttttagtaatggcggcttcattcttcttcatttttagtaatatgtattgtaatccgctgattaatggctatgctcaggaattaggagcctccagtgctttcgccggaattattgtggggatgatgagtattgttgcgatgtttcttcgtccagttgcgggaaacatgacggatcatttttcaaagtatacgctggcgtttctcggtggtgttttaagctttattggggttatgggttacgttattacccccaatagcggcctgctcctgttctttcgactaattaacgggttagggtatgttctttgtacagtttgcatgacaacctggttatcatatttagtcccgtttaatcatgtcggtgaggcaatgagtttttatggattaatgaatgctttggcgatggcttttgcaccagcggtatcgatcaacctttaccgcgtgatcggttaccgatatgcaatcattatttctgcattagcatcattaatgatgattattactgtgcagtttattgataataaagctaaaccagatcctcaaccgaaaaaagaaaagactaagggcttccatctgaaaattattcagaaggattcgttgccaattgccttcttgactgcattgtttgctattccatactttgcaactcaggcagatattgttacctatacggaacaacgtcatttgccaattgcagttggctcttacttcttaatttatgcggttgttttgttaggaattcggcttttcttgcggaaccaatttgatacggttaagttcggaccatggctgattattagtacaatcgcaacggtcttttatttaattatgttggcagtaatgcatactaactttgaaatggctcttgccgcagcagggatggcctttggatacggattgatttattcagtttgtcagtcaactgcgatgatgttggcaccttctaatgaacggggcctggcaagttcaacattcttcttagggttggatgttgggatgaccctcggacctgttcttggtggggtcattgattcaacaatgccagtaaaatggttctatccagtaatgctagtaattattccatttattttgctaatttatgtattcaatcggcgcaagttaaatagtgcagtacaaaatcattaaataatgtcaaaactgggaaccaactcgagccttgttcttaataagggttcaggttgattcccagcttttttattatcagaattttagtttgttctacatgaaacacatttgatattctagtcaggtttaacgatttcttgtttccagtggtggaggtgttgttttgtgatcacacaaaggccatcttcacctaatgccttcattttatcggtacacataatcttaatatcaggattatcggcaacctgttgttcaccccagtaatttaagtaacggagggcagcataaagtttttccccttcagcggttaaacgatattcaacgtgtggaggaatggtattgaaactcttccggtcaacaattcctgcatcgacaagttctcgtagctgatcgctaagaactttgtgggaagttcctaattgcttcactaattctccggttcggcggggatgaccggcaagaaggtaaagaatgaccggcttccatttaccaccaatgattgatagggcatagtctgcaccggtattaaacattttagccataaaaatcctcccttcagtactttcattatatatgaaaagagtgaagagaggagtagagttattatttaattaacttaaagacttgatcttctggaaggtaatctttatcaccagctggagattcgattgagccaaatggcatttctgcgcgtaacttccatgattcaggaagatcgaatgcttcatgaatagcatcatcaattagcggattgtagtgttgcagactagcgccaaggttgttttctgccaaggcagtccagacagcttgttgagcaccaccaattgcttgctcagaccaatccgcgaagttagcggcatagctagggaattgttcttctaagttatgaacaatatcagtatcggttaagtaaaggattgtcccgaaacctgcacggaatgttgcgatctttgctttagttttggcaaaagcagcaggatcctttacaatcttctggagagtttcttcaacaatatcccaaactttgtcagagttcttgccaaaaagaacaactgcacggacagtttggctgttaaaggcacttggagagttacggactgtttcctttaccaggttaaaaatttcttctgggcttgttgttatgttatcgccaagagcataaatggaacgacgcttggcactgagttcattaaattttgattgcattgtgagttcctccttaatcaattctttgttatttcacttactaatagtaactaaaatatgagacatggacaagatgagaaataaaattcacctagttacaaattcttccctataataagatttgataatggcagattgcaagaaataacttgaacgaatttaatgacgtagattaagcaggaagatctcgattggtgtatgccaattaagacatttaagtggccgtgaattcagataccaattgatttgaaccagttggtaatcacttagttcttcaatggcttgtcccttgggaataaaccgtcgcaaaactcggttacggttctcattactaccgcgttcgtgcggtgaataggcatgggcaaagtaaacctgagtacccgttagctgttcaattgcctgataattagcgaactctttaccatgatctacggtcagcatcttgagtttgtcttgaagttgactagctagttcaagtacggcttgagtcatggactgactgtcgcgaccatggagccgtttaacaattgtcaggcgactcttacgctccacaaaagtagccacagcttgacctttacgcttgccagaaagcacggtgtcagcttcaaagtggccaaattcctggcgagtttcgactttatgaggacgctcctcaatggagcggccgtgactgaacgtaccacgcttttctttagcacgatgacgacgaattccatgatcaggcaaatcgggtaactgtacatcaagccagccttgatcaatccagttatagaccgtcttgtaggcaatcccaactacatgggcaacttgttcaggggaccacttctggacttgaatcttttcctcaatcaagtgcttaaggcttttagtgagcgaagacttccgcccccgttgactaaccttttgttcaaagtcagtttgcgctagctcagcctggtactcactatttagccggtgaagttcgttaatgatggtggtcttactaaagcctaagtagttagcgatgtatcgcaaggaacgtccttcattatgaagcgtttcaatgacaacacggtgctggaatgataaaatagtggtgcccatcaaggtccttctttctaatggaatgttgaggtaacaccattaaagaccttgatgggtttttctgtccacttaaatgttcaacttaaattttacaatctgccatatgcaaaagctactaacacgaaaagggaaataattaaatatggcttaattaaaattgaattaaataaaaatgttgactttctaattttagggtgttaatcttttgataatcaatttaacaaaaagatgttgatcaagaaagattagtaatacttacttaagagagccaatgtttggtgtaaattggtggacagtattataaaaatctatcacttgtgagtcgtatatcgaaacttaagtagaatatactggtaggcgcccattattgtgtcagctaattgttgctttgcaactgttggtgaaggtagttatttcactacgaaaaaaggtggtaccacgtgaaaacgtccttttcaatctcagctttggggttggtaaggctttttttatttaaaatttaaaggtggtggtgtaaatgtcagatagcgacattattaatattaaagaaagtatactaagaaactctattaatcatagaaaggtgtttccttttttgattaatatttaattcattgtttaatttatgacgttatataacgtcttatttaataaaaattggaggacttacctatgaaaaagcttaaagcacaccgtctattttatgtattaactcttctaggaacacttttgcttcttttaaccggatgtggaaagtcaaataaatcatcacttcaacaaattaaagagcggggtactcttagagtgggaatgatctctgctaatccaccatacgaatcacagattcaaaaaaatggcaaaacgcaaatgcagggcgctgatgttctactagtaaagaaaattgccaaaaacttaggtgttaaatatgaattaaagacaatggatttagatggacttttgcctgctttacaagctaagaaagttgatatgttagttacatcaatggctccaacgccagaaagacaaaaagcggctaagtttactgacacgtattacaagagtaccaatgtcttggttgttccaaaagctaatctagctcaatacaaaaatgccaataatttcaagcatgctaccattgctgtagttaacaattcatctcaacaaccaatgattcataaggtattccctaaagctaccactaaggatctatcaaaggttaccgatttagctttagcagtaaataatggaaaagctgatgccttctgtattgacaaaccgactgcaattatccttctgaagaagaatccagaattaactatgacttcatggcgacacaacgatggatcaaaaggtggtgctattgctcttcctaaggggacttcggatgaccttgtaaatcgcttgaatgaagtaattcaccaaaacaaggcacaatatagcaagtgggttgatcaatatgcacagaaaggaaccaactaacaaagattagaaggagtgattttatgttttcaaattactcatttattacagaatattggccattatttatacatggtcttgtaacgacaattgaacttgcagttatctcaattgtcttgggtctactattaggtattaccttggctgtgatgaaaatgtcaaaggcaaacttactaagcttaatagcaaaaacgtacattggcttcattcgtaatactcctttattggttcaaatatatatcgtttatattggccttccacaattactgggattctccgtaaatgactttgtaacaggtatagtggcgctaaccttgtattcaggtgcttatattgcggaaattattcgatctggtatccaatctttaccggtagggcaaacagaggcagcagaaagccttggtattccatcatatcgtattttattggatatcatcttaccacaagcattcaaaaatattcttccagcactgggaaatcaacttatcggtaatgttaaagattcatcattggtatcagtattaggtatcaccgatgttatgtttgccgcccaaacagttcgtggttcaacagccttaggattggaacccatgattattgcttctgctctttacctggtaatttgtctgattctgaatcagattcttgctttgtttgaaaggaggatgcgtcacgatgcttgaattacgtcacgtcacaaaaaagtttggaaataacactgtcttacatgacattaatcttaaagtccataatggagaggttgtagtgatcattggtccttctggatcagggaaaagtacgttgattagacatatgaatctcttggaacagccaactagcggtaaagtacttttccaggataaaattatttcagggagtatttctaaaaaagcccaacaaagggtccacgaaaatattggaatggtctttcaacattttgacttatttcctcattttactgttagacaaaatatttcgtatgctccaagagtggtaaagcatttatcaaaatctcagactgatcgacaatcgacggaattactaaaggaaatggatttagaaaataaggctgatgcctatcctgatcaacttagtggtggacaacagcaaagaattgcaattattcgatctttagcaatgaaccctaaggtaatgctttttgatgaaccgacatctgctttagatcctgaaatggtagaagaagttctgaaatcgatgaaaaagctagctaagagtggcatgaccatggttgttgttacacacgaaatgggatttgcacaggaagttggcagtcgcgtagtttttgtagatagaggtcacattttggaacaaggcacaccagatgagatttttcatcatgcaaagcacgaacgaacaaagaactttatttctaaaattctatatacctagaatagagagtgtatctaattatgttagaaaaaaatattaagacaccattatatgagcaaattgagattgaattaaagcgcttaatcaatgatgataaatataaacaaggtgctttaattgcttctgaatcagaacttggcagagagtttggagctagtcgaatcactattagacgggctattagtgatttggttgatcagggttatctggttaaaaagcagggaaaaggaacttttgtccaagcaaatatggttgaacgtaatttattacatctaggaagctattcaaattttatgaaaaacagtagtaagcatccttctgtacaaatagttaagctacaagaaatagcaagtacagataaaatagcagaattactaaatattttccctggagaaccagttataaatttgaagcgactagttaagtttaataaggaagtaagtggcttagaaagtgcttactattcttcaaataaattcccaaaattaagagaaaaaatcaccccagatatttcaatggctaacctattatctactcaatatggatataaggaacagggtagtaatcagctattgagctatgtaccagctactagtgagttagctcaatatatgaataaggttccgggagaacctctattcaaattacgtcgtcaagtaatggataaggaagttatttatgtgacttttaactattacgacgcatctactaccaactttgccattacatctggaaatcaaagaaaggaatgattctatgagggtcttggccattggcgataatgtaatggacatttatctcgatagtaagagaatgtttcctggtggcaatgcggttaacttcagtgttatggctactcgaataccagaaattactagtgggtatcttggcaattttggcagtgataatttggctggattaatgaaaagtacattaaaaacatttaatgtcaacattgatcattgtagaaatttgaaaggtgaatccggatattcgctggttaaagttgttaatggcgatagaagatttctagctagcaatagaggcggcgttctgaatcaaggaattaagatttcagatgacaaggactatattaatgcaatggatttaattcatttaagtgttaatggtaatggaaaagaaataattaattacattagtaaacctaaaattgtctatgactattccgatttctctaatgagaatgaaataactttgactattgataatgtagatcttgcttgtttctcagtggggaatgtaagtaaagatagagtagttgaacgagcaaggcagcttcaaagaatgggaaattatcatactattctactatttactatgggaaaacaaggggcaatggtttttgcaagaaaccgttgctattaccagccggctcaactgactaatcatatcaaagacaccatgggtgctggagattcttttattacttactttagtacaggcttgctaagagaaaattgggatataagctctattcctaatattttgaaatcagctagtttatttagtgctaagcaattaaaaatagatggatcactaggagtaagttttaatatccctggtttgcaactaaaagaattatgtaaggagaggtaattatggaaaaagaaacaactcgtcaagaagtacaagaattagtaaaaaaaattgttgatactaaagatgttaagtctttagtgtttatgggatgtggagcatcttattcagaattatttggcgcatattattatgcattacaaaactcaaaggaacttggtagttatttgcttgaagcaaacgaatttaattatgatgttcctaattattttggagaaaatacagtagctgtcatagcgtccctaagtggtacaactaaagaaactttaaaagcagtacataatgctaaggaaaaaggcgcaacagttctagcattgacctttgctcctgattcaccactaactaaagagtccgactatgttttacagcataagttttttgaaagttatgccacaaagtcttctaaacagaaggtagctctaacctttgcggttgaattattgcatgcattaggtgaaagtaataattataatgaaatggtacaaggattatcagtagttgatgaggttgccaatgatgcagctgctagtgtggataatgatgcacaaaaatttgcagaaagatataaggacgaagacaaggtatttacattatcatcaggttctaatagaggagtagggtattcaactgctaactttatctttatggaaatgcaatggattacaggagttaatcttgatagtgcagaactatttcatgggccttttgaattagcagtggaagaagcaccattcctactatttatgtcagatggaagaacacgtcatctagactctcgagcactagaattcttgcaacgttttggcactaagtatacggttattgatgctaaagactattggctcgatagtaaaatggatgcttcagttgttgattactttgatccactggtgcttacctcagtaatgagaaagtttgcagagtatctgggaaaagctcgaaaacatccattatcaaagcgtcgctatatgtggaaactagaaaattattaaagtaaaagaagtaccacataatagttagaaaataatctaactattatgtggtactttgctaagttacaaaagaggagatgaattaatctacttagtcaaaaagagaaatgggaaaattgaataaatattttttctaagtggcagattgcaagaaataacttgaacgaatttaatgacgtaaattaagcaggaagatctcgattggtgtatgccaattaagacatttaagtggccgtgaattcagataccaattgatttgaaccagttggtaatcacttagttcttcaatggcttgtcccttgggaataaaccgtcacaaaactcggttacggttctcattactaccgcgttcgtgcggtgaataggcatgggcaacttgttcaggggaccacttctggacttgaatcttttcctcaatcaagtgcttaaggcttttagtgagcgaagacttccgcccccgttgactaaccttttgttcaaagtcagtttgcgctagctcagcctggtactcactatttagccggtgaagttcgttaatgatggtggtcttactaaagcctaagtagttagcgatgtatcgcaaggaacgtccttcactatgaagcgtttcaatgacaacacggttctggaatgataaaatagtggtgcccatcaaggtccttctttctaatggaatgttgaggtaacaccattaaagaccttgatggttttttctgtccacttaaatgttcaacttaaattttacaatctgctattatttgaaaagttaagcaaatcgattctgtaaaagcaatgataatggacttaaaatgcatttttgaaagcttttaaaataattgttgacaaatccactagctagcgataaattaaaatacaattaaataatgattataaaaacacgttgaaaagaagagtagctattagcagatggcaagagagtccccgtttggtgtgagaggatgatttacttatagtgaaaatcactttgagtgccaggatgaaagatagtaatttctggtgggagtagcccattatagctaccgtgtttaatacaaagagtattgaacatttgaggctagtagtgtgaactactggcgaataaaggtggtaacacgcagaagcgtccttagattaagcaattaatctgagggcgcttttttataatcattaaatttagaaaacaaggagttgcgttattatgaaatttacaatcgttggtgctggagcaatgggactccgctttggtgtattattacaagaagctggaaatgaagttgattttgttgaaggctggcaaccacattacgataagatgaaagaacagggtggtgtttacgttactcgggaacaccagaacaaacatttagttcctgtaaatgtatatacccccgaagaatacacagcgacagacgcagactttgtattctttgaattgaaacaaatgcaacttgatgatatgttgcaacgttgtaagcatttctttaaggatcaatatgtcttaacagcaatgaatgggatggggcatgttgaaaagttgttgaaatacttccctaaagaaaaattagttgcggggaccgcattagttgccactattttaactggtcctggtgaagttgaattcgttggtaagccagggatgggaactaccaactgggctaactatactgaaaagcctgatgcaaagactgaagagctgatggctgaattgaagaaagccaacttcaatccttcattaaaagataatttcatgggtactttgatggctaaagtagtctttaactcagttgttaataccttatgtacaatgtttgaaatcacaatgggtgaatatgctaactttgataaggcagatgaactttctcgccaattaattgatgaagcatacgatgtctgtgaacgggctggtgttcaattggttaatacccgagcagaagaattggaaagtgttaactacgtatcaaaagttggcaaccctcaccactacccatcaatgtaccaagacatgagtcataatcgtcctgtcgaagttgactacatcaatggttactttgctaaattaggtcgtaaatataactacgaagctaaaacacatgcttttgttactaaccttgttcacttggctgaagcaacaagagaaaagaactaagactaaaccgttaataatggtagccaagctactgatagcaacgctactaacaagccaaccattgttttgcctactaacggtaaggaaagtggagcagctactcaaggacaatacatcaacgttgttcctaaggatagcgttgcagcacaagcaggcattcaagcacctgcagctccagaaactaccagtgtaacatttggtactaaggaaggtaccatgatgactcgtgaagaatacaaggcacaacaagctaacttgccacaaactggtaacgaaaacagtaaagcggttgttgctttgggcgtcttggctggtatgtttggattaggcttagcaagtaagggtaaaaaagaattttaattagtatatatttgttctgacataatatatccgttattaaagcaatgggacttctgcttgatgttctttcacaggaatcccattgtttttttatttagaaaaaggattacgtttatgttgcaacgtaatccttttgaattattacttattctttttcttgtccttattttccttttcttgctcttcaatgcgtcgcaggaaagtgcgataatcttcatattcgcccgcactaagatgtttcacttgctcgtcaataaggtctctcatataaccacggataaacttgtgccctgataccattactaatgccttaatctcgttctgaacgtcgatgtcgacgccaatgttaccgtgttttttggttattgttttatacattgttattacctctccttattttttaaaattatccttaatctcaattgcgttaagaatattcataaaattgtttttatcagtaggatttaaatgtgctacttctttatcaacaattttgcttaacagctgtttttgagttaccttttggatactagataacgcaattaatttgtttcgtgtgacgttgctaacactaactgaagttgtgtaattttgattcttcttagtcatatttgttttcctcctttactatgttctaataaaaaaattttttgaaataatttttttattctatgaagcttagctaaagtaggagatactaaaaaagctattagcagagactaaacgaaaataagctatgaacgttatttgatatgttcatagcttattttttatgattttattttattgttactatttattttcttgagccttacggttactttccattacatgccaacaataattaattgccttagtatattcaacccctgtacgattgtagatattagtaggtaaatcatatccataataggtgcataggttatctatagtgtcagaagcatccccagcaactctaaagggatcggctaaatcatcgattcttttctttgataagtcaatgccttgtttttctaagaaaaaagtggatgaattgaaggtaattagtttactggccttattaaatattgactgtatctcgttcttgtaattgctaaatggttgctcattataggtttcctcaggcttgatgccatttaagtcagaataccaccaatctacaagcttggtattaaatgtatgattgaataatacattatcgttagtgtccatgatagtaagcctgactatttcatctagagctgcaggtccagtaagatctacccaatatactagttctctattcttcattgcaaatcacctcgactggcatcataactctgtggcgtattaataggctgctttctgttattgatttgccttttaatcctgtaaagagtagattttgaaaggtgaaattttaattgagttgcagcatatgtgtgtgattgcaggtattcgtaagcttgacgataaatgggcgtgataacgcgtttatggcgtcctcctgtattcagcattgattgatacttagccttcttaattgccttagaagcacgtttctggcgcaaataatgtagatagtcaaggtgggctaactgtgatgcaatgatccaatcactgctatcactatcactgcttaaatccatatcgctagattggatgataatacctgtattttccactatgtacatcaaacaacatagttctctaatgttgctatatagacaagttagggtagggactactagtacatctccttcttgtgcgactgttgttagaaatttaaatagctggtatcgctctttattgttttgcctaaagacatcagcaaaacagtgatcgtatggtatacccatacttaataagatttttgcttgatattcaaagccgtcttgtttgatgacgctatcttttagccagcctgaaacatagccatattttgtcatatcatttcactccttatctatttgataagagtaatctaactaaaaaaggctattcaatttcattttgagattgaatagccttttttagttataaataccaataatatggactgatgatgtagtatgttttcatttccttgtttgtgctaaggcagtcttaatatgagaaagtgtcattgaggtgtcaaataatgagtgaaagtaccatacttttaattgaaaaaaattggagaaaagcaagggtgttagtaggtggtatgaggttgtgacagaaatgggtcagatttgggttggatattgacccctatttatggcaccaaggtaatccttactgggagtaagaataaagtggtttattaattgtatttctaaaagaaggtgtcaagtagggaaattgccgtaaaaggttgatttagagggatctataaaggtattgtgtcagaagtgccaattttattctatttttttaagttctaactaagtatcttaataaaataacaattaatttattcattttgatttaaacgatagatattatttaaagatcctaaatgaaaattggcacagatgacacacaaagcacataatccctacttactattgactttacaaccacaaccataaactaacaccaggggtcagcttttacatcaactattttcaatttgtttctttattctttgcaatgttgaaactgaaatgttaaaagccctggccgtatccttataagtatggtttgaaaggtagtcatatgccgcttgatagtgaggtgtaatcaacctttttggacgaccttcatggtagtctctcttatggagtctagcataacgttttccttcttgagttctatccactatcatgtcacgttccatttctgcaacagctaaaagaatagtcttaaccagcttaccaattgtagagttttcaagtatgcctatgttgagtacattaaatttaatgcctttgctcattagtggatcaagtacatttaacgcctctctagtatttctagctaatctatcaagcttggttactgtaatagtatcaccatttcttactttattagttagttcgtcaaacttaggcctgtttgttgttgttccagtaaatttctcagaataaatattacttttgtctatacctatttccattaattgacttacttgatcgttaaggctttgccctttagtcgatactctggcatatccatattcagtcatttctattaatcccttttctgaataaactttatgaccacaggataactccgttgtttagggattggaagtcttgttcaaatactcaaaagttgatgaacaattaacgtcacgtacctactttataaaaaaacgaaaaaaatcaaaaaaaatatatacggtaaaatgtataaaaatccattctatattaataaaaaaacgtgttcaaacaccgttagatgaacacgtttttgaatttatttaaatttcagcaaaagtgcatacttattgcatatataagtaattatataacatattatattcgttgtcaatagtaaaagcaaaaattaatttgatttcaataaaattatgtgttttaataaaaaatgaagcgaaggaaacaaaccatcaaaaaaacgtttccttcacttctgtcaaaatgtaataagtaatcatgacgaaaacttatcttaatttgcaataagaatgtaacgcttcatttaaataccctttatataaaaaacgttctacattcatactattagtatactctaattttcgagaaatagcaaataattaaagataggtcccgtcattgaattacttattaatcaatggagggacatttttatgttatttaataatcatggatatgtaggtcaatcgcgaagtgtaaggtctcaagaagctattgaagagcatgaagtacctttaaatcaaatcacccgtgacttgattaatgaagttattgaagaacttgttgacgaggagacaattgataaggaacaagaaaattggctaaaagccattcccgtatatgtttggaaaaaccaaagcccaaccagctggcatcatacaggtaaatattatcacgaaacctatcattatgatcttccactctatgctgaagaatttatcgatgatcctgaaattgttgatgaaagcgtcaaagagcataaacgagaactatctgaacgtaggcaagcattgcttaacgaatctactgaacctgaatatgaagtatattattattctaaggatatttggggaggaacacgccggcatcctaagattgttgatatcgaacatggatacggtgttgcaaagaaagagagcagtcgtttatatcccgtttcggtaagtgatgaagattggccaaataactcctattattcgataggtggaaattatattactgttaagcaatatagtggatatttagaattagtcgctaagcatcctgaattcaaaggaactaaaaggaaactaaataaagttctcaaagcattaggagtaaccctttaactttaaaacaagaattgtcgaaagttggaggtaataactaatgcctaggcgaaagcatcatcataaaaaagataaagtatttttctttaaaagtacccctcaatttttgaaaatggcagaacttgctcacttgaacaaggaatttaatcacaaaactaatagtaaagagtcaattaagctactgccaccccagatttctgatacagttattaccaatgggggatcccataagagtcagcaggatcgcttaaattttactaataatgggatttatgcatacagtaagtgcttagcccaagacgttgtacaaatagatgttcattcattgctcccaacatgggcctttaacttacggctattggatcataaacataaacaacttttcttgagaaaaaaagaaatcgaagcaacacctaattatatagataataaacgcctggtaaatgaacgaaaaagagataaagacaacctcaaccgcttttgctcagagaatggaaaaacaaagaatgaacagtatgttaatcgactgagatgtacgtatagcggaatgaacatgatatacgatatgcttcaattctggggtttagaaaacgtgattaattgtgttaatgatggatttattatcagaataaatacacgaaactttgataagaagtatcaacaatttcaacagcgttatcaaagaaaggttagtcaattaactttttcaatgaaaaagtggaactatgctttaataaaaaacgatcaagaatacttgttatttaattctttaacagattataaatgtcgaaatcattgttttgatgttggagctaattattatgaaattactggtgaaagtctaagagaagcaaagaaaaataaccatgttaattctttaattttagctaaagcagaaaaacaagaaaaggaggcagtgtatatagtggaaaagcaagtatttgaccaagatccttttaataaagcaacaaaagaaaacatggaacgacttgatgaagtaaaaaagataatgaatgaagctggaattcaggacatcaatcatggtatcttgcaacctcattattataggtttgaacttgataaaaatgatagtcagcagagtaaagaatacataaataaaattacaaagagtatgttgagcaaccaaatttttatgctcgaaaatcccctgctagtactgttaatttattcggtcaagtaataaaggcaactgaaattaatgatatggagcagtatctcagagatcataaagatgtaactgttaatgattttgtgcctccaattattagaccagcaatagtttcaattgatgactggattaagcagttattgaatgacaaagagattaaacataatctctacctatataatagtgtagcaattgtgttgcaagtatgggcaaatgaaaatagccgtgatcctaataccattatcaagaagttaaatgatgcgttagttaaagatagatttagcaatctaagtattgcagataaagtgtataacgatcctgcaactatccttgttgataatcaattaatggcattaaacgagcatcatgtgtacactgcagattctaaagcggtaaatagcattattgacaaatatattgatgcaagcggaaaaaggtttattcgaaactctcgtaataacgtgtacgaactccttaataataataagtataaaaatggcaaattagatatcggatttaaatctgagaatcagacaatctggattgacaataaaggcgtccacacagaaaatccactgcttaagaaggttggcaattacgtaaatgttgattatatcaattatgaagcagataaggatttatttaactcagaagaatatagtcaagttgaagcattcctaactcatataagtgatggctactataggcaaattacatgtatgcttgctctaattgttttacaagaccctaatattgttccaacacttcgcagggctttcatattgtatggagtgcctgggtccgggaaaactgttttagctaaactattatgcaagatttttgatgaaccaaataagccgtcaagaatactatgctctgaaccaaatattaataaagtgtttacggatcctaatcttattgatgctaatgataccaaaaaagggaaattagtattgtggtttgatgattttcagtctgatggtaggtcgaatgaaattaaaaggaatgttggaacggtaataaatgcagtgactagcaatgaggcgaaaacgggagctgcaaaattccaacaatatcacgatattaaactgccttcattgattgtactttcaacaaatgatgtcccacaaataaaacatattgggactgttgataggatttttgtcataaaatcatcaaaaaggttaacagacgaccctaatattagttttagttccaatatagatgcgtggataaataataagaaagttcaagaagcgttcttctgcataatattaaataccgctgttgatatcttaaatatgagcaaagatgaagcaaagtctatttttgacaaaagtaattccgctcaatcagcactatcaaaccttaattcgtctattgaagctttttttgaggaacaaaatattacaagtctttatgatcttgttggaatgcaagcaaagaaactttttgacgtttatttagaaggagaaaaaaattttgcttatgcaaccacttatcgtgctttctgcgatcaaattgagggattaggtttgaatttaagacgaaagcattttaatcataaaaactatcaaaaagttatctgctcgaaaaatgataatttaacgcaagaaaagttgaatttaatgttaaaagaaaatgaactatctcccgatcaagttgaatattgggataatgagattcatcgtcaacgaggaaaggttagttcgtggcattgtggttatgatgaattaaaagagaagtataaaaatgatcagaaattatttatgccatttgaattttgaattaacgattgaaggggatttacgtgaataataaaaagaactttaattggcaacaggctattaatatgaacaaggatatttttttggaatattttgctcaagcaagtggattaagtaaggctaaacgtcaaccaattaacctaatggaagaagaacataggattggtgtttacttttcatccgcagcatatcttgaatggttgaataagattaatgatatgaaacatgaaattatgattttaaagactaaaaagtaggaggaacttattatggaagcaaaagacttaatcggcaacactctaatcaaaaagattacaaattctaagggcaacacttggaaaccagtattgcgtcagcgatgggttggtaaatttaaaggattaaaagaatatagtcgctcatcgctgaaagataattatctaattttagaagtaggcggttactttgatggccttatttttaacccggacccatttattgtagtggatggaaaacgaatttatctgagttacgaaaattctattccaggcttatgtcgaatcgtactagtggatattcgagctttggaactctcaaaaaagtatgattttaatgacaaatatcaaggattcgactctgaacgtgataaatatcatattgctaaattcaagtcctttgacgaaatgaaaaagattgcgaagaaacaatactcaattaataatgagttgccgacgtatgatattaagatggtctgggaacaggataaaactagtgagacatatggtacacggcattattccgtcacgacaaatgtaggactttctgaagaactagatgaagaacttttgaaagcataatattcattcagaattgcaatgtgcagagttataatccaatccataaggaggccattattcatgtttggcaaagaaattttaaacggaaagcagctgtgtgaaaaactaggcgtaagtaccacaatcttgtatgaattattagataatggactaccatttcatcaattaacaacggcaagtcgaaaatactataacctatcagaagtcgaaaattggctgctaaatgcaggatatcgtcagaaaacgatttggacaaagtaactatagataataatgatgggggtcatgctttgtgctgaccccattttttgaaggtgaaaaaatgattaagaaaatgacaactggtaagcacaaaggagagtaccaagtgcgcatccagccgattaataagattactggtaaaagggaaagctggccagtagattacgcttctaatcgtaaaactgctaagtcattagaaagacagatgtgggcagattatgaggaagggttgcaattagctgacggcagtgcgatctttgcagatgaatttcaaaaatatattgatgaacgaaagaatacgatatcacctgttacttaccgtgactggcaaaattcagcaacggaatttaagaaatattttaaaaagactaagataaaaaatattactgaacgattggttgagcagttcgctcacgactttattaaacaacataaggctactgtaggacgtgctactgtaattgatcatcgcctgacccatatgcgaagtttttttaaggaattggaaggtaaggtagtaaagaaaaatccagtacccgagcaatatttggacaagttttttcgcaaaaacgaattcagtgttggtaagcaacgatacttattcacaagcactgaacttaaggctattaaggctcaaatacaaacggagttaaacaatactacaattgctaattggggcacccgtttagcgatttggattgatttggaaaccgggatgcgtccaggtgaaattcaagccttaaaatttaaaaatattaccacggaagatggatattctacctttaaaattaatgatagttggtcagactatgcgcgtaaattcaatgggacacttaaagcacgcccaaagggatactcacgatattgtttacctatctctcaagaattagtggatttccttgtcacataccagcaaagacaaaaagaatttctaaagtatcatgatttaacgaatcctgaggggttgctctttctcaacctacacgattataggaagtgtgtaaataatattcccatcactcagaagagcatgaacgaaatgttaaagaaaatttgtaataaattaggtattcatagtgatggatcacaattatctatgtattcttttcgacatacattatgtacaaagttagcgaataaaccaggaatttcatatccatgggcatctgagcgaatgggtaatagtctttcaatttttatgcgtgtgtacgttaaaacagatcgtgacatcgatcgaaagatgatggataattggatgaaataaaaagcaattagtaattgaacgtgaaaaaaatatctattttttcggtgcaacaaatgaattatcggtgcaaaaacagtcaattttgcaccgataatttttaaattgcactgataaattggagagattgggttaaaataataaagaataattttgataagaaaggagatgaaggaattgaaagtttttaactaccagactttaaatgatttaagattaactactaagatggttgaaaaactcaatcaaatctatgagttaaaagggaaaacagcccatgtatccttaaaatcaaaagatattatggataaattattagcggtagcaaaaattgaaagtacagacgcatcaaaccgaattgaaggtattgccacaagtgatgcacgactaaaaaaacttgtaagccaaaaaactactcctgaaaatagaagcgaggaagaaatttcaggttatcgcgatgttttagcaaccattcatgagaattttcaatacattaaaattacacctaacaacattctagcgctccataaggaactgtttaattttactgaaagtacgtggggcggtgaatttaaaaatattgataattctattgtgactacatttgcggatggtcatcaggagacgagattcactccaccaccggcttacttaactcctgaactagtccaagacttatgcacggcttacaataatgcaattaccaataattcttttcctcctttaatattagcagctgcctttatgcttgattttgtttctattcacccatttagagatggaaatggacggatgtcacggctattaatgttgttagaattacatcaattgggttttgaagtcggaaaatatattagtttagagcgcttgattgaaaaaacaaaagctgaatattatcgaactttattagaaagttcaggaactgcttggagtaataatgataatcattatggcccctatgttgattactttttgagcatcgttcttcaagcatatcgtgaactaaatacacgtattgatttcactaatgatactgaaaaagatccagaatcattagtgcttactaagttacgtaatagtttaaaacctttatcaaggcgtgaactgatgaacttaattccacagtatggtgagagtactattaagcacgtattagcagaattacgaaagaagaacataataaaactggttggtagagggagagcaagtcgatatacagttaatgactaatcggtgcaatttaaaagttatcggtgcaaaattggctggctttgcaccgataaaatgattattgcactgaaaaatgcacacaactagacacataaagtcaaaaataattggcttaatcgttgatatctcaatggttggagcaatttaacctccaagcttctagtcagcactagaaacatactaaaagcctataacaatacgtttttaccgtatttgttataggctttttatgttagtttaaggctatgatttctcacttttttcacatgttttgaactaaatgatatcctataatttttatgatcacgaaaatggttgatatgatagtatttgtagtcatttaaacgtgtgaaaaaatgtgaaatgccagaagaaggtattgtaagcaattatacttcttcttcccaacaatgcgtccagaaaaggaaactaaagatagcaagaagggcaagaagaaaaataagaagtagcctaaaaacttgctatgacggcttttaagcgacttcgtggatttaggctaaatcagttattagcttctaaaaagttagtaactgtggtgtgtgtacaccaaaaatacaccaaatttaaataaattaagttggtaaaaagctggcataaaaaatgaagggctacgattctctatttgggaatcgtagtcttttgtttaaagctataattgaagccttaaagtaatcagtaatatttgatgagaggtcaaataacccttgttttagcttactttattggttgaacgataaaatctgttactccattaaaaaagacctgttagggcacgacaaggcgaattacaagggctgcgctaatagatgcgaaaatgaaagcataagataatggcattttggcaatcttaagcctaagccaactcagcaaaagtaacacgtttgtttgccacggtgaaagcattcaatgtaaaaactgggtgtttttttattgagcagttaacgtttataggatatgaacaatgtcaatagtattattaaattcctattattttgtataattagtatagtaattatacaaaggaaaggaacggatttgtaatatatggctcggcttgatcagaaatctatagaacaattaggaattaataaagtagaggatgcactctggaacgttagagactgggctgatttcttttttagtgaaaatgataagactccgctgttagatggcaatatattaatttatagtaggcagattgcaagaaataaattgaacgatttattgacgtagattaagtaaaaagatctcaataggtgaatgccagttgagccacttaagtggccgagaatttaaataccagttaatttgtgttagttcgctgttactcaactcttcaattggctttcccttgggtataaagcgtcgtaggacccgattacggttttcgttactaccacgttgatgtggtgagtaggcgtgggcaaaatataccggtgtaccggttaatttctcgattgtgtgaaagtccgcaaattcttttccatgatcaacggtcagcgttttgagcttgccattaagttgatgagctagctcgacaattgcctgcttcattgattgactatcacgaccattaaggcgtttaacgatggtcagacgactctttcgttctacgaaggtggcgactgcttggcctttgcgcttgccagagagaaccgtatcagcctcaaaatgaccaaactcctggcgggtatcaacactagcgggccgttcttctatggagcgcccgtggctaaaggtaccacgcttttctttggctcgatgtctacggataccatgatctggtaagtccttgagctggaggtcaagtaatccttggtcaatccaattgtagattgacttataggcaattccaaccacatgcgcgacctgttcagctgaccatttctggaccttaattttctcttcaatcagttgtttgagattagtagttagagaagatttgcgtcctcgttgagtaaccttcttttcgaagtcagcttgggctaatcgagcttgataagcaacatctaaacgatggagctcattgaagatagtggtcttactaaagcctaagtagttagcgatatactgcaaggaacgtttctcgttatgaagtgtttcgatgacaacgcggtctgaaaatgataagatagtggtgcccataaaggtccttctttcaatggaatgttgtggtaacaccattaaagacctttatgggtttttctgtccacttaaatgttcaacttaaattttacaatctgccactactaaatgtgtactatataaacacgtatttctgatgtaaaaatgttactccagtaagttaaaaacagctattaagttatctaacctttaaataaaagggttgataaccatggactaagacgacagcagggtatcacgcaggaacagcttgctgagatgagtgacttatcacttaattttgtttcaaaaatcgaaagaaaacagaaacagaacattatcattaaaacattgatggctcttgcatcagccttaaatgttaaaccttcagatttgcttaagggtagcaagggcccagccagtaatcgtcgtaagcatgtggatctgcttagtaggcagctatataagttacctgaaggtgaataaaaagcttcctatcgggacttactgttcaacccagcattaaacttaatgcactcttttaacttcattaccccgctccttttaatattctcgttcaaatatttaatcgcaccattaagatactcccgtttaattaccgttttaagatattccaagcgaaatatttaaaaatattttcgcgtaaatatcatttaatcattgcgtttaaatttcatttaccaactgcgcttttcccgtttcaacttcaaaattaagttcaaaactttcccaattccgatctttgacacacgacatatttacagatatgcgcaaaagtttgtcaaaaacaaataaataactttaattaagcttgatatttcgccattatcgcgcagctaaacgcttatcatttttagcgcttcgtgattgcacatatttttagatatgtcgtatctcaattgccagattagaaaaaaacgcttgttaattttgttggcgggtcgctcggttacaaaggtaatcacacccacccataaaacgagtgctttgttctacggctataagccggtatgtacagctaacgcctcaaggcactgacttgtcttgttgttgacttgaccgctttacgaaattaggcagcctcgcgcccgctgaatctcgagccttagctgcctaatcgttgacatcattcaattttttcttgtttaatcaatgtggataaaaaggccgatcaatatgaaaagataatcaacggtctaaaaagtcgtcgtgcaattaaagaaaagcatcttcgggctgatagtaagcaactcgagcaattgagcaaacagattcgttattactcagcccgtcgggccaacttgctgacggaacggtatcgccaaattgctcggcagttgtttgctgagtatgagctaattgccattgaaaaactcgatgccaaagaaatgcgcaagaagaatcagaaagggtcaggggccactaatcggggtaagaaccgtaagctggcgaaaatcaagccttacgaaattgcgttgcttttagagcaaatggccgatcgtgaaggcaaaaccctgctgaaagttgatagttataagaccagtcaagttgaatttggcacacaataccaaaaagtggtgagcgtcaatgggtgtctaagcacactggaaaattgattgatcgtgatttgaacgctagtcgtaatattttaacttgggcccttgatcctaagaagcatattaagtatctcgaacgtcaagcagcaatcaaagctgctaaaaaagctggaatcactaaagacaagttgccaaaagcgattccagccagagtattagttacaacgaattaattaacgggcgggacagaacctcgccgtccgtccccaaaggttttgagagttactgttggcgtatcaccctgagcgtgcaaaacgggtgcgaaacagtaattaagatcaacttgatctcaacggcgcaagccgttgcattgcctaaacgttttctgagattgagcggctcttagcagccttttgatccagaagcgcggtcatttatgactgagtagttcacgccagcgaagttagcacggtgatcatgctatggattaaagggggaatggcagaatccagtgccgaattagcccaaatgttagcagtcattcgtgatcatcccctcaaagaaattgtcggcccggcccatgaataaatcccagaaaaccaaaaattaccgccaacaaggacggtgatcggcataagagagaaagagaattgattagaaggtaaatacttaataccttgtgactatatgttagcgtttacacatggatttgtcaataacttccccgattttatttaaaacggtttcattccttggcttcttgacttgcgcgcctggttatgacctagcgtaggcgaaagggcttgatcagggtccgcagtggggtgtggtccagcccccagactactacgtagcccagcaccaggccggcccagttggtaatcacatcgtcaatatcgaccacccgcaacgtgtgaaccaaccagtccgaagcaaactgggcgctttcaatcaccagccccggcacgagcccggccaaagcaacctgccaccacgaccagtgcggccgccaaaggtagcagtacacccccagtggcccggtcagcaaaatattggccaaaaattccgggtcgacgtggacgaacgggtggaggttatacggcaccatgtaaaaatacgacagggccttgtaagaatctggcaggatcagcccgaccggggcaaagaccagccaggccaccaccattaagtagcccaggctggtaaagactgtcacccgctgggccggcgtccggtttggtaccgccagtagccggtaataccccgctagcaaaatcagccaagccaccccaaacgtcaaccaccgtgtctgcaacatcaaattgccctcttctataaatagttctagcttaccgaacgcaaccggacctgaccaccgttgatccccaagcttaaccagaacttaatttcccagcatttcccgggcggtcgccaccaggggaccaaattcggcggcaaaggagctttcctttaagtagatcaaattcaagggatgctcgagcggaaagccggccagcggcaattcaaacaaatcgccccgggccaattcgttggccaccagggcccggtacataaagctgatcccgaccccctgcttaagtaattcaatgatcgccgtcgggctgcttaaggctaaggtctggcgaaaatcactcagctgggcgttgtgcgccgccagccaggtcgtcaaaatctcgcgggtccccgagccggcttcgcggacgatcaaaagctggtcaaacaaggctggcaatgtcgctggcgcctcggcctgggcggtcacgccgataaagggcgcactgcccaacggggcggcggcaaagtcctgccgcgaataattaccctcgatcaaggccgcatctaattgaccggcgagcagctgctgggacaggacagcggtattttcaatcgtcacttccagctggtagccggccgcgatcaccttggccagcagctgcggcagtaaaaaggcccccagcgagcgggtcgcccccaagcgcaacggcggggtctgggccaagcggagccgctttaagaccgcctgattgtcctgcccgagccgtttagcgtaggccactagttccgtggccgccggcgttagcttgacccggcgcccgtggtggaccaacagcgggacatctagatcggcctccaggctggccagctgctgggagacggccggctgggtgataaagagctgctgagcggcggcggtcaacgagccggtctgcgccaccaccattaaggtcgtcaaccggtggtccagtaaattttccatcgccctgcccctttcataaggaaaactaacttacaagaaagaaatcataatttttatttatcagtctagcatggtacattaagaatgtaaaaaaatccggatgtcaattcggaaaggagaaagtgaaatgctcaagaagatatttagctggccctttgcttgcgccgcgctcttaaccttaatttgttcgctggccggcagctacctggccaccctcccctacctcaaggtgattggtgccttagtgatcgccctcttgttagggatggtgatgcaagttggtcgcccggtcctggattacagccggccgggaattggcctgattgccaacaagttcctgcgtctcggaatcatcctgctgggctttaagctcaatttgattgccctggcccaagccgggatcaagacgattgccctggccgtcgtggtcgtgaccttcacgattttagtcacctaccagctcgcccgccgcttcggggtcgaccgccacttagcgatcctgaccgccagcgggaccgggatctgcggggccgccgctgtgatggggatttcatcgcaattaaccagcgatgacgatccagccaccaagttgcgccaccaggaaaatgaggtggttgccgtagcgatcgtggcgatcctcgggacactctttaccctgatcgaaatcgggctcaagccactcttgcacatgaccgccctgcaatttggggtgatgaccgggggcagcctgcacgaaatcgcccacgccgtcgccgctgggagcgccgggggcccggtcagccttgatacggcgatcatcaccaagctttcgcgggtcctgctcttggccccagtcgcgatcttagtcgggatctggtaccaaaaggcgacccggcaagccaacccgaccggtgaaaagcagccggtgccgattccgtggttcatgctcggctttatcctggccagcgtggccggcacctttatcccgggcctggccgcgttggtaccaagtctggtcaaattagcctacctgctcctagggatggcaatggccgccttggggatgaacgtgaacttctccgtgctcttcacccgcggcaagaacgccctcgtggccgccggaatttcttcggtgttgctcttgatcctggtcgcaactttgtccaagaccttcttttaatccgtaattaaacgctaaaaccgccgtcttccaactcccggaaggcggcggttttgtttaaatcatgcgtcattatctgacttcaactccgtaaattgagcatctaatttagcaataatttgagcgcgtaacgtttcgatccgtttggctactgattcccacataaatttaccattagatcctgatttttgtatgtacctcgaagaagatgatgaaacaaggtacagagctgagtcttataatttaggtcaattcaggctaagtatgtcctggaataaattgatacttaaatataggaacagaactattgatgagttacttgttgtattcatggatagtgctactttcatgacagtcactcctagcctaggttccataagtcccatgtctaacagtgatatgctcacattccaatattacctagctgattcgctagatttcgccgttgaaaaactaatactaaatatgaagagatcatcaattactcctaattataatcaacaatcaaaactactaaaaagaattattatttttaagaattataatcagctaaagcaaattaaatcagttttgcagaagcaggatgaatacatcaagggaaaatgcgctcctacaaaagaacaattagaattatgtagaggcgcactttcaatggatttcggaaaggatacccctgaaatgaatcaagggcatatcgaagttatgtgtgaagaagcaaacgtcagtcaattcataaataattatttacaatcagagatcattaacaataaacgttctcgttgattatcgtacaataccccttagggttgacggcactttaaataataaaagcgctgatcctaaggggtattgtacgactgacgaacagaggtaatttttactaagcgacgatcggttgttatcttttagagttattcacgtttaatgtagtttgaaaatgttttctttataacccggtttgtaaaattaagttagaaaaacaaaaaagccatttgtgatagacttttgagtatccctaatcaaaagaaaggcaatcataaatgacctacaaacatcttaccacacgtgaatcaactctcatagctgaattttatcgtcaagacactcgagcttatcaagttgctaaatcactaaggcgtagtgctgaaacaatttatcgagtttatcgttacttggatacgggcaagacaattgcgcagtatttaaagcagtaccaacggaataagcgccgttgtggtcgtaaaccaatgacgttacctgatgatgaagtaagttacattaccaagcaagttagtcaaggttggacaccagataccattattggtcggtcagagaagaaaatcagttgtagtatgcggacactttatcgcatgtttgcccgtggtcaatatgactttgatgttaagcagttaccaatgaaaggtaatcgtcatccaaatggctacgttgaacgacgtgggaaagctggccatcttggtcgcagtatttaccaacgttaccgcgattttccgcattaccaacatgaatttggtcatttagaagctgatacagttcaagggaaagctcaccatggcgctgtgatgaccctagtagaacgaatctcaaaagttgagattgtcttgaatgtccatcacaaaacggtcgaaagtgtgaactattatttggatcagtggctatcaaaacagcctcgtcatctttttaagtccattacctttgacaacggtaaggaatttgcgggctggcgtgagattgccaataagcatgatatccatacatactttgcggaagtcggtgcgcctaatcagcaagggttaaacgaaaacaccaacggtattcttcgtcgtgatggtctgagtaaaaagaaagacttccgtaattgctagggcttcttttagtaatgaccaattaccaacaaggttacattctgctttatccataaatttgcgggaatacccccacttctataagtaggggatgaatcgctctcttaaagcacgttagtgctttttcttttgttctatgatatatttagtatatatctataaaatgtggtgataacaatagaattagatataaatcagcattcagtatacttacttaattaccatttggtaatggtggttaagtatcgtcgaaaagtaattaacgatgaaatatctgaatatcttaaacatcgttttgtagttgtgggacaagcatacggcattaatttgcaagaatggaatcatgatcaggatcacgtacatgttttgtttagagcaacgcctcatacggaaatggctaaatttttaaatgcttacaaatcgtctagctccagaatggtcaaaaaacaatttccagaaatcaagcaatatctttggaaatcagccttttggacacaaagctattgcttaattagcactggtggagcgcctttagaagttgtaaaacgatatattgaaagtcaagggagaaaataatggttctaaaagctgttaaaatgcgcatctatccaaattcagcacaacgaaatcagctctggcaaaccttcggttgtgttcgttttgtatggaatcaaatgcttaatatgcaaattgaacggcgcaagaataatccggaagctaaatttgtgaatgcctttgggatgaataatctgttgaaacaacttaaggttgagtatccttggttgaaacaagcagaatcaactgctttgcaaagtgctaatcgcaatttagccgatgcttttcaacgcttttttaaaggtcaaaataagttccctcgatttaaatccagaaaatattctcagagctacaattcaaagtacgttaatggcaatattaaagttttagattgccatcatataaagttaccaaaactcggtatcgtctattttagagctggtcgattgccaatgggtaaaattaagaatgtcactgttcgtctgaacgttgctggtcaatattacattactgttttagtggaaagcgaaaaccaaactcttcctaaaacaagtaaatatattggtggcgatttaggacttaagtcgttacttaatctttcagatggatgcaaggaaccgatcaatcattttgaagacaaataccataaaaagttgtatcgttgggagaaattacgtagtcgtcggttcttaaaggctcagcaggaaatcgcctgggatcatcataataaagtgttagttccacggcaattagatgattttaagaattatcagaaagctcgtattatggtggcgaagtatcggcaaaagattgccaaccaacggttggatcagctacaaaaattcactactaaattggtcaaaaagtacgacatcattgtgttggaaaaacttaatactaagggaatgatgaagaatcaccatttagctagagcaatcgctaacgctagctggtcaaaattagtagatatgttgcaatataagtgtaactggtacggtaaaaagcttattcaggtcaatccgtcgtatactagccaaatttgtgctaattgtgggaagaataatcatcggttaggattgaataaatcggaatggttagcggtacgtgagtgggattgtccaaactgtggtaaacatttagatcgtgatattaacgctgcacaagtcatcttgcaaaaaggattagctatccgatagataaagttaggctcgggacgagccttggctaatagtcgtaacctctgcttgaaggttcgttcagaatcggtagggtaagtatgcgatgtttccagaatctcccacttcaagcattaaaccgtaggtttagctaagtgggagtagttcaagaaaattgcaataatgggcttgataagattacattaactggtgaagttcaagatatttttaaggattaatagttatttccctcatcgactacaagttagcgatgggggattttttaatttagggaaaaggctaattcaatctggagtggtgatttgtgataatcaattatagtaggtcgtttgaaaaacagagaggtgaaggttagtggaacaactctatgaccagtttcaacgaaaaattgattatttacgattatcaataacagaccggtgtaatttacggtgtgtttactgtatgccagaagaaggattgaagttcttccctaaagataaaattatgtcccaagatgaaattattcagttagtgcaaaatttcgccaaaatggggattacaaaagtccgcctaactggtggcgaaccattattacggcgggacttacccgagattatccagcgtattcggcaaatttctgaaattaacgacatttcaattacgacgaacgggacggccttgaagtatcaagcaaagaaattgaaggaagcgggtcttgatcgccttaatatttctcttgatacttttaatccagcagtatataaaaagatgacccgtggcggaaatattaagcatgtcctgcaagggatcgcggcagctgaacgagagggctttaagattattaaggtcaacaccgtagtcgtgcggggcgaaaatgaccaggaagtcatggattttattaattatacgaaagaccacccgatcaatgtgcgctttattgaatacatgccaatcggacaagagattagcgattggaaaaaagaatatgttccgctaaccagcatttttgataagtgtcgcgaggcggggttaacatatgaaccgttatcattgcccggtaatggtcctgccgataactatcagattaagggttaccgaggtagcttcggtttgattcacccaatttcagagcggttttgtgaatcttgtgaccgtttgcgaattacctccgatggttacgtcaaagcctgcttatattggaatgaagaactggatatccgaccggtcatcaatgactttgcggcatttaagaaagtagtgcagaaggcgctaaataataagccgttaaatcatgaaatggcaatgaaaaatgttcatcagattattaatccagcgccaacgtggcggcatatgagtcagataggtgggtaaaaatggcagctgatcaaaatactggcgctcctttttcgccgacggaaaaccgggtaatggatgctctgcagtcggtaattgacccagaattaggggtagatattgttaacttagggttgatttatgatgttcaagttgatgaccaacaattatgcgtgattaccatgacgctaacgacaatggggtgtccggttagtaacgtcttgagtcaacaaataattgaacaagctttggcaactgacggggtagcaaaatgtaagattaacttggtctgggaaccagtgtggaatccaagcatgatgactcgctatgctaagattgccctgggaattcatgaataagtaaaaatatggcgtgcagctttcgtgattgaaaactggacgccatattattatttagattgttggtcaaagatgaagtggccgcttttaccaccgtctttttcaacgagatgaacatcactaatgactattccccggtccattgctttgcacatatcatagatggtgaggagggcgatttgcacgacaaggagggcttcaatctcaacgccggtgacgtgcttggtcttaacggttgcctctgcagtaatactatcctgaccgttattgtggaagtggatatcgacaccggtgagggggatgaggtggcacatggggatcatttcagaagtccgtttagcggccatgattcctgccacttgggcgacagcgaggacatcgcccttttttatttggccatcttcaattcgttgcagggtggttgcttgcatatggatttgtccttgagccgtagcggtacggaaggtaacctttttagcggtaacatcgaccatgcgggctcggtcctggtcattgaaatgtgttagtttgtctgtcatgataaaaccccttttaattggtagattaactttaggatagcataatcgataagcaaaattattcagtgattttaccaaaataaaaatgacatcgcctcaacaatgtcattataaaaataattattcgtttcttagtgaagttacttcaacatcgttatcgtagtttggactccaccaaccttgcttattaatgtatccggatggtaagcaccagattacaaattcaataacatcaactacaaaggaaattgcttgtaagacattactatcaccactagctaaaataacggcaattagccagaagacaagcactccccaaccactgatgccagcgtcaatcttcaatattaacggaatacttttattaccttaagaaaagcttaacaatttagatataaataaaattataaaacccaaaatgtcaatttaagttagaaagaaaatagttgctcatcagtgacgtaagacatgaatacttcatatggagttcgatagcctagcgatttacagggcaggttatttcgcttactcatcagttaggttaccaattcatcaggaagattgcggaaatctagctgtttcgttaagccatcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgccgcgggaatttccgaagccactgacttaagtgttggttaatcgcatcagccgtcttttcgtgcacattgagtacaatttcgaccttcgattggcgttcggtcagggtcattgccgccccttggtgctttttgccttggacggtatcagcttcaaggtgcccaaattcagtggcatagtgcggaaagtccttggcacgctcgtgaatacttcgcccaattggccagccttcccgcggcgctcgacatagccattcgggtgccgcttacctcgcatcggcaaggaacggacatcgaagccgaactggccacgtttaaacatccggtaaagagttcgcaggttacaactaattgggcgctcagcgcgcccaataatggtatcaggcgtccacccctgggcaattttgtcgttgatataagtgagttcagccagtgacaactgagtacgttttcggccacaacgttgcttattgcgcatatagtgatcttgataatcagcaattgaggcaccggtttccaggtaacgataaacgcgataaacggtttcggcacaacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgatcttgtttagaggaattagtgagaaaacctactgactatagataaaaatttatgtccccgttaaaaaatgatgtaaaaattcggggcaagtcataaataatgatataaagccactagtaacacatattaaatgatactagtggctttattatttacattggttgtccagttgagatttcaaagccggctgttacaggaattacttctcccgtgattgcactagcagctgggctagccacaaaataaattgcagcggcgacttcttcgggttcaacaatccgatttaatggactgttttttgcgaatttttgtttatcttggtgaaaaagcggggtattagtcggaccgggtgcaacaacatttacgcgaatattatttttaccgtaatcaattgccattgcccgagtcatgttaataatcgctcccttggcggcattataagcaaccattgctcgatcaccagccattcctgagacagaggaaatattaacgatactaccatgatcttgttcaatcattgttggcaagaaggctttgctaacgaggaaagttcccttaacatcaacatcaaagattttatcccaatcttcttcactggtttcatgaacctcgccgtgaataacgattcctgcattattgataatcgcatcaacggttttaaatttattgagggttatttgcttagcatgttcaacctcacttgatttactaatatcggcttgaataaaagcaatttgtgccggggaatacgtttcgcctaattgtcgttcaacttgcatccccttttcggtatcacgaccgataagtaccgtattccatccatttttaagaaaaatatcagcagtggcaagaccaatcccagaggttccaccactaataacaactgtctgcatatataaaactcctctctaagcttttctctaattatggcatttttggtcagatttagctatttattagaaaagtccttataataaaataaggataaggagggaatataatgaatacagcaaccttagaagcacttcaaaattggcttcatggacgtggctatacattagaacaagtagacgcacaactaattcttaaatatcatggacaagaacgagcagtcattacgccacctgatcgctatcaagtgaaagaccttgacctgaattttaatgactgggttgaattcaataagtgcattcgcaatattcgccattctttagctagtaacgaatagaaagccttttctttggcaagaatacctcctcgtgatagagttattcatgaagggaatatagtccaaggagggatagtcatgataagagttggaataattggtgcttctggaatggcaggcagtgcaatctataaattagcatcgacaaaaaagatttgaatgtaactggaattgttcgaaatgagagtaaggccagaaagatccttggtgatgatgccaatttgatcagtggtgatatttttgccttaagtgataatttgttgtcgcggtttgatgtaattgttgatgcatatggtactagtccagagaatgcggatcggcaagtaagactggctgagaaattagtagttttagcccgaaaacataaaatccgtttaattttcatcctcggtgccggaagccttaaaactggtaaggataagcatctatttgttgatgatattgaaaagatgcctggtgctgagacatggattaatacaccccgccagcagttaaaagaattacagtatcttgaaactatttctgatattgactggctaggaatttcaccatcggcagtatttgaagctggggttgcgactaattatattcttggtcaggatgaattattatttaatgaacaaaatgaatcaaaggtaactgcaggaacaatggcaaagttagtggtcaatgaaattttagcaccacgccaccatcgtgaacgaattaccgttgttgatgcagaatagttattggaactataaaaggcatgagaacgcaaatcaattctcatgccttttaatattagtcaactaattttccaataattggaagttttgaaaccggtgaacactttttggctgcttgttgataggtgacatctgataaatcatggccgaaaacattaccgtggatttctgcgcctttccattctggaacttcagaaacatcataaacatttccacgcaccccgatatatactggacgaccttcttgcccgttatattgcgctaattcattgtgagtaaatgaccgcataataatccctcccataaagaagctgggaattgactcggcctcttcctgtatgagtgtaatgagatatgaaaatagatgacaagtttattcgttatcctatcaccactataacacgaaaatggtaatgacatcggaaattcaatttattcagttgctaagtttgcagcagggcttttgactgagactttcacgagcattcctgcaatgatagttaggatcgtaacgaggaatgggaaaaatgcccaaggaatgaaacttaatggattgatttgtaaggtactagcgatgaataccccagaaacactccatgggacaattgcgttgactgcggctcctgcatcattgagaatccgggttaaatcaacccgctttaagcctaatttgtcaaatgatgggagaaatgattgtccgggaagaataattgcaaggtagtgttccccaacaaggaggttaaccccaatacaagtaagagctgtggagaatgttaaccgaccaggtgtctttacaatcccagttaagtgattgatgatagcgctaataatattgaacttgatcaataagccacctaaagcaagcgcgaagataattaaggctagagaagtaagcatactagagataccgcctttagaaagcaatgtatcgattgttttatcaccggtatgggagacgtaaccagtcatgatggtattagtaatcgtagtgaggctggttttaggtgcatgaatccagccaagtacgaccgcgaagagtgagcccagaccaagggaagggatagcaggaacttggaaaatggctaatacgattaagagcagaactgggagaagagcccatccagagatccagaacccactttgtagcccggccatcatttggtgaacggcgcctaaactaacatttttggagtttaaccctaagaaagtgtaaagaataagacaaattgcccaggcaggaatatcggtggtgagcagggatttaatatgcttgtagatactaatttcaccaacactggcggcaaggtttgttgttcctgaaagcggggaaatattcgaaccacaaaaggcccctgaaacaattacccccgcagttaaaccggggttaattttaagagttgcgccaatgccaataaaggcgattcccattgttgatacagtagtaaatgaacttccacaagcaaccccaacaagggtacaaacaataaaaactgttggtaagaagaactttacagaaataatctcaaacccaaagtacataattgttggaatagttcctgagaaaatccaggtggcaattaagacgccgatagaaagaaagataatgagagggtcaacaccggctcgcaaaccatgacgcattccccccatcacggtatcccatttaaatccacgaattcgcccgtaaacagcaagcaaaacaaatgaaataaataatggggcttgtggttcttggtgcttaaaaataatagggtagcctaagatgcataaaataacgccaagaataagtaaactttcactaaaaccaatcactggctcaggactattttttgatttgttaatagttttcattgtgtaattctccttattttttaataaaaaaataccaactagatcagcggcatttacttaatctagttggtattacggtagtataaaaactcgcggaaaactacacgcccttactagatcaatgtacctagcaaaggactcattaaaacaaccctgcttaggtacgaacaccgctgtccgtacctaaatgagtacagacaattatgcacggtaagcatagttgttataatacttggttgaagttaatgagtgttgaatcatgttagtcgttcctttcaagttaagttataattattaaaacattctaatttgattttgtcaaactctaattttaaaattcgccagaaatatccttatcagaaaatgaatgagggtcggggacaaaagaaatatcagtgtcaattattccaaatttttctcgcattacattttcgatgtgctctgataattggaaacttttgaggatcgtcattttagcgttaaccatcacggaagcatcaagcgtgaccacatttccgttatagtgagcttttagttcgacaacttttacaacgtgtggaatattggtgattgtttggcggtattcctgttcagcccgcggatcaaagtagtcggttaagttaagactgctttcaaagaaaatttttagtccagaatacagaatgaagaaaccaacgacaatactagtagcaccatcaagccaacgaaggttaaagaggagagcaccgccaattgaaatcaaagttccaatactggtgaaagcatcactcaggctatcttgggcagaagcaagcaacgcggcgttttttaatttaagccctgtttggcgattcatataccaaacaactaacataataactgacgcgattccggccccaatcaatgcgactggttggggaaccacccgacttgcaggatcgaggagacttttaatgccatcgatgataacgcttaaggcaatcgcaaccataacgaccgctgtgacaagggaaaaaattgtctcataacgccaacgaacgaattgtactcgctggtcagatcccatgtgcgcttgataatttcccgaaggcagctgtgcgccgatgatatcatcatcatccacatcctgggcaatgtgtaagcccatcatcaataaaaaggtcgagataattcccgaaaggttgttaaaggcatcggctcgtaacgtctgcgatttacttatttcagctaaccagtactcgataattgaaataacaacataagcaatcaagttatagattaaatggtgttgggaagctcgaatctttgctagttcatttgcttgcgttttttcccagttattcatttcttcggttgtatgtcttttaaatttagtcattaatttaagaacttccttgattaataaaatcagtttaattgtaacgcaaaaaataaaagccgagaaaacgattttctcagcttttactcaaaataataatgaaaataattgctaggcccggttattaattacgtgggcgcatgttgcaataatcagtcccataaaacttactacagcgatcatattactcataattgacatcatattgaacaactcctttacataattaaaatattttttacagcacaactaattacagttgcctttttggaaaacaaattataatgattgttttcccctctccaccaagtattgtaacaggtcttagcaatagtgacgataataattagctaagcttttaatgagcttttctacgaaagaaaggagtgattataagcaaaatattataagtaactatcatatgaattaatgatttttaattattaagtcaaatcgaattatttctttataaaattaatctatttagctaatctgtttaattcttttaaggctagaggaaattttgtgaagccgtcactagtcaaaaagtggccgcctttttctttaactatgagttttgctctaattttattagcgaccgcaatgctattttgataaggagcgattgggtcatctttagctgttataacggtagctttagcaagtttagggagtatatgctcataatgaggctgatctttcataaactcatctaattcaggataagctggtaattctttgtcaaatgctcccacaagtaaaagtcgtgcatctttaacatgatgatgttcaatataacgaagggcggtaatacatcctaaactatgggcaacaaggatgaggttatcttggggatgaatttggtcgtcaaccgcttgatcccattcagcttgttggggattaaagggatttggtagccatatccgatcaagggtaattactggttttgcttcttcttcgagccatggaaaccagtcatcatcacgggtagacgtaccatgaattaagtatgcgttcttcattattaagactcctatttcataaagtgtttcaatattaccatgccgatgattaacaataaaatggcaatcgaattagtaagaatttcataaggctgaccgtgggcggcaattagtccccggattaaagccataattcctaagcttaataggaaatcgaccgcaattcggccatgatgttttagcgcggcaattatcattgtcataaatgaaaagaaaaaagacaataacacgatccaaaatcttaaaaataacatgatccgtattcccatcttgcataaggggaatcagccaaaaagtttccgtaaataagataatagttaataaaatccctagaattgctagtgcgccgattgtacatagacataaaatatggctaaaattagccgctaatttatatatttttttcattctcttatactcctcaagaaaacgctttaaccttaggatagcaatgatcaagaaatttagctaatatttaacaaaatagttgttaaaaatatgcgatacttaaagatgaatactaaaaggaggggcgaaaaatgcgaaaaccctttattgatgctaattggaagatgcataagaatgtccaggaatcggttgaatttgtggacgcaattaaaggaaaactgccagatccgcaagaagttgaagtcggaattgcggcccaagcttttgcattaccgagtatggttcatgctgctgatgattcagggttaaagataatcgcgcaaaacgcggcagctgaatattcgggagctttcactggtgagattagcttacgaggtttagctgatgccggtgtttcatacgtaatgttagggcatattgaacggcgccatttattccatgaggataatgagttggttaatcgaaaagtgttggcggcccttcaaatgggtgttaccccgataatctgtacggatgaaacgatggttcaaaaagaagtcaacggagagattcattacgttttccaacaattaatgagtgtattgaggggcgtttctcttgaccaaataaaaaatgtagttgtttcctatgaaccaagttgggcagttggatatggtcagcatgctaatccagttcttgctgaagaaggatgccgtcaaattcggcgaacgattgctgataactatacttatgagattgctgataagatcaggattctttatgggggcagtgtcaatccagataatatcggaatgattatgaacaagccggatgtggatggagtattaatcggtcgggcaagtttagatgttgataatttcttgcgaatggtcaattatcttaaaaatgatcaagaaaaataaaaaaagtatttctctttgccgtcattttatgttatagttattaacagttgttatggcggtattggtgaagtttggttaacacaccggtttgtgggtccggcacgcgtgggttcgaatcccacataccgccctgacctagcgcgatagcaaaggatttttcctttgccatcgcgtttttttgtattctctgttttatgaattttaattgataacatccaagaaagtaacttaaaatagtaagatggagaaagaaaaaggggctttaattatgaaaaacgtacaaattggtggaacaagttggaaagtatcgaacgttgcattaggtattatgcggatggggacgttagcagtgactaaagcgattgatgccttagaagccgcccacgatgctggaataaactttattgattcagctgatatttatggcaacgacccacagttaggacgtggatcttcggaaatccattttggtgaagcattaaagaaaagcagtcttacccgtgatgacttttacattcaatcaaaaggaggactttttgcgaacgcggataataaaataacgcggtatgattcgtcaaagaagcatttaatcgctgctgttgatggaattttgcaacggatggggattgattatcttgattcatttttgattcatcgtccagaccctttaatggagcccgcagagatagcagaggcctttgaccaacttcaagcatctgggaaagtccgccattttggagtatcaaattttaacccgcaacaaatcgcgctccttcaagcggcgacaaatcaacgacttttgattgaccaggtacagtttggcttaaagcatacggggatgattgattttggcctgcatacaaatatgactgatgatgctgcaatcaatcatgacgggggattattagaatatacgcgtcgtaaacagatgacgattcaaacatggtcgcctttccagtacggtacatttgcagggacgtttattaataatgatcaattccctgagttaaacgcaatgttagaaactcttgcgcaaaaatataaggtaagtaaaaatgcaattgccgttgcatggattttacgtcaccctgcgcatatgcaagtgttgcttggtaccatgacgccagctcatattattgacagtgctaaggggagcgatattacattgacgagccaagaatggtatgatctatatcttgcggccgggaatgatttgccataatgaaaaaagattatctccagttctatcagcatattacagctcctttttatcgatacccgtggacaattcctttattacgggcggttaataaatttgttgtgtggactatgtacgttgcttacatcgttatattagtgtgggtagggaaaaataatgtcttgaaagcaggaccttttctgcttattcccggtattggctttatcctgctttcttttattcgccaacgaattgacgcaccacgaccatatgaagaattttcgattaaccccttaattctacgtcaaaaaactggtgattcattgcctagtcgtcatgttttttcggcgactgttattgcgatgtgtgggttaaggttaaatttgattttaggagtgatcttactcgttttagctgttgtttctgctattacgagagtgattggcggagttcattttcctcgtgatgtggttatcgggtttatttgtggctttatttgtggttcgtttttatttcttgtctaaattttagaaaggtgtatttcatggacaattcagtgctgcaagatgcaattttgaatggacttattagtactcaatatcaaggtaatacgctgctaggtccgcaattattaaccaacaaccaatcatcgacaatttggcaaacgttacggcacgaattactgtcatgtaaagactttacgtggtcagttgcctttattacgttagatatgttagtcccctttaaggcagtgatggctgacttagcacagcaaggagtacacgggaccatcattaccagtaattacttgaattttaatcaccccgcgatgtttgaagaattgcaaaaaattcctaatttaacggtcagaattgctgatcttaatggatttcatactaaggggtatttatttgatcatgggaaatatcagaccgtaattattgggagtgctaattttacacggtctgctttattagttaataaggagtggaatttaaaattaagttcccgccaagaaggaagcttttttcaacaactaacgacggaattggatgctgttaaacatgagagtactgttctaacgtcagagtggattgcggagtatcacaagaattggcaaccaccaaagactagggtgacgcaaccagaaaaattaaaaccaattgaacctaatcaaatgcaacaggccgctttaggacaattaagcactctgataaaaactggcgctaagaaaggattggtcgtttcagcaacgggaactggaaaaacatatctgggagcatttgcggttaaaaaatatcagccgcgccgtttcttatatatcgttcatcgagaacaaattgcaaaaaaatcgttagctagttttcgacgagttatcggcggcaaaaaaactgattacgggttattgacaggtaatcgccatgattggaatgctaaatatttatttgcaactgtccaaacactaagccaacaagcagtactgaataagctcaaagctaccgaatttgactacattttgatcgatgaggcccatcgtgcagcagcacctagttatcaacgaattttaaaccactttatgccgcaattttggttggggatgactgcaacccctgaacgaatggacaatcaagacgtatttaaactgtttgattatcatttagcctatgaaattcggctgaaagatgcattggctgctaaaatgttagcaccattccattacgtgggggttaccgattatgaagttgatggagaaattattactgagacttctaagttaaaccaattgattgctgtaaaacgggttaattatgttcttaaccaattagactattatggatattgtggcgatcagccccgtggattagtattttgtagtcggcaggcagaggcaaaagaattggcagtccaatttgccgcggctaaccatcctgcaattgcattgacaaatcaaagtagtagtcaagagcgagcaaaggcagttgagcaattagaggcaggaaagattgagtatatcattaccgtcgatctttttaatgaaggggtcgacatcccatcagtaaatcagattgtaatgatgcgtaatacccaatcaccaattgtgtttattcaacaactggggcgcggcttgcgtaaatatcctggtaaagattttgtgacagttattgattttattggaaattaccaacataattacatgattcctcttgctcttaaccaggataatagtcgaagtaaggatcaagcgctccgtgaagttaaggtgccaacgaattttgacgtttcaaccattaactttacgaaggttgccgaagaacaaattttagtctcccttgataaagttaaattggactcgatgcgtgaattgcggcaggcataccatgatttaactaaccaactagggagaacaccattgctggatgacttttatcgttatggttctgttgatcccgagtatttgcgcaaaattcccagctcaaccattatggtgacttcttagaaaagatggggatagaacttaaattaacaaattatgagcgtcaagtactagcctttttaactaaagagttgcttaacggtaaacggccacatgaattgattctccttcaacgcttacttcgcggtacgtgtttaattgatgcttttaaagcagaattaaagcatcaaaatattcgcgttacaccagctgttttacaatcagttgacgatattttaagtttgcaattctttaatgtaaaagctggtaaacaggtaaaaaaggatcagtatggcggacagccgattattgatcatccagatttgttaacgtatcagttaaattcaaaaattcgagcaggactagaaagtcacaatgatttcaagaggttgtttatagatgtactaacaacgggacttgaaatcgctaagcaatatgacctcaagcaagcatttaccctttatcagcaatatgaccgcaaagatgtttgtcgtttattaaattggcccctcgatgtaagtgcgccgttatatgggtatcgagtggcagaagatatgtgtccaattttcattacctaccataaggatgtggaagaaaaaagaaatgctatttataataatcaactacaagatggacgttcattgcgctggtacacacggacacctcggcatctttcatctgatgaggtccagcggttgcttgcaggagtaaaagagggtaagccgcaagtaaaattacacttatttgtaaaacagagtgatgcagttggcaaagaattttattatttaggtcctgcttatattcaaccggactccgtaagagaagaattggttgggccaaagaaaaaagcggcagtggggatggatttagttttagaacatccattgacctcaactatgatgaacctattggcaatgtaaccatcaatatatcgcttttattttttgctaaatcttctataattaaaggcgtagaaagaagatgcatattatggcaaaaggaaaggtaaaaactagtgataagcgttcagttcgggatgttaaattagatgaattggctggcttactaaatgaatttgatgtcaatacgataggagcactagtaaagtctctaaagaagagttaaaagaagaacaagcaaagcaagaaagatgaattacgtgataccattgaacgataacaagaacatatcgatgaacaaaaagacacgattgatcaacttaataatcatatttctaaactaattgatcgtcttgataataagctataaaaaaatgaggctgagaaaaaacttttgttttttcaacagcctcgtttttcatacgaatattgttacgatatcgtggaactagccttgagccttgtcgaggagattatttctcacttctatttcttatcattcttttttatttactggttgtttaaataaatcattaaatgcttcactaattgttgggtgggtatagatttggtcccgaagtatttgataggggagttttgcccgcattgcaagaacaatcatgttgataatttcttgcgcttcctggacataaagggtagccccaataattaagttcgtttgtggatcgactaataccttaagcagcccacgggtatccttcaatacttttgcttttggaattgcggcagcaggcatcttaaagagtaggtaatctttcccttgtttttgcgcctctttttccgttaaaccgacttgtgcaagggaaggttcaataaaaacattggttgggacaattaaacgatcactaactcgccgttctttattaccgaataattcatctttaataattcggaagtcgtcaagcgagatgtaagtaaattggggaccacctttaacatccccgattacccacacattaggaacgctagtatggaggaggtcatcgacaacaatcgcgccgtttttagcgaccttaatatctgtgttttgtaaatcaaggtccgccgttgcaggcttccggccggttgccactaaaattttatcagcgaaaatagttgtttcacgattatcagctctagcaaaagtaattgcagcttgctcatcttgttcgctaattgccttaatatcaaccccaacttcaaagcgaaccccgttatccttaaagttttgaattaccatttctgccacatcatcatcttcacgtggtagtaaagtctgatggtgatcaagaaccgtgacgtgtgaaccaaaggaagtgaacatatttgcaaattcaagaccaatataaccgccaccgataatcacgagttcacgtggtaacttaggctgctccattgcttgggtagaattcatgagaaatggactactcttcaatccaggaatatcagggatggttggtgttgcaccagtattgataaaaatacgttcacccttgtaggaaagagtttgcccatctggcgtttgcacatcaatcgtgtggttaccagtaaaatgagcagttccatctaagacagtgatattttcttcgcttgctagcatttgataatttttttgtcggagttgggatgtcattacattttttccatcgaccgcgtcttcaaatgaggttccatgagcagcttcaataattagccgtttggaagggagacaagcaatattaatgcaggttcctccatacatttgcttcgatttttcaataacaagaacttgttctccatgttgagcgagaaacttcgcaagcgtttttccgcccttcccaaaaccaatgataatatttttgactgttttcatggaagaaacctccaattttaattattttatgtaccttcaaattatactaagaataaacgctttgtcacttaaaacgctcaaataaggcaattgtgcagtttgcgttatattgaacaaagtgttaggataatatcgtaaatatattagtcccaactgcagtcagaacttgtatattaaagaaaaacgtattagatgaacattgtatattattgatcatagatggtgcttcatcaaaataaaacgttttactaatttataaaaagttttgattgaggagagattataatgaaagctgcacacttagtagaacactcccaaaaagcaaatgaaaagaagcaagttattcaagagaccaagtttatcgacattttaagcaaggttgcaacagtcgtagctattttgatgtatgtatcttacatttcacagattaagaataatttggccggaaattacggtgctcctttacaaccattagtggcagcgcttaactgtacgttatggtgcatttatgcttacttcaagcagcaacgtgattggccagtcttctgggcaaatttccctggtattatctttggcttaatcacttttatcacatgtttacactaggaaaaataggattgcgagaaaacaaaattttctccagtcctattttttatatgctaactctcaactctatgatataattaaccgaacgtatgtttaggaggagtagagatgccaaaagatgggatgtcggtagttcactttagttcttttgcgccggtgacagagatgattttacagtcgttgccagccgtgaaggacaaagaggaccagaaagcgccggccattaaaaactttgatcaattacgtcaacgattaaatagtcatgcgcgattccttattttggaccttgagttttttcaggatcagcagaagcatcgaaatggcgttgctcagattgcggggaagatgtttgaaacacaaaacagctttaattactacctctatgcccagaatatgtctgctgagcgacaattggcctttttgcgacaatatgacctccgcctttcagaagtaaacggatatgaggttaggcagatttttaaccggatttttcatttcattgcggtagagcggcctgactatattgtaagctgggataatggaactgactttgaatcattgaattatgaagcaaatcgattaaagattaggaaagaggatcgtccctggcgtacgattcagtcgttagatctggaaaagctagtcgctaaagaagtatggaaaagtaaaagtgggatcagcctggaaaagatgtgtcgtttattgcaccttccccgggttaaatatcatcaagcccaaaatgatgtgatggcgattgaacagatcttgaaattttatgcttgtgatttagagcgtgaattaaattgtcgctgatcgttaccaaaatttaaaatttagttcatgatttatcccgattgactttttattattagtaataattgaaagaaggtgaacgagataaatttcatttttcgactgcttaagcggatatttataataggacttttagtaggtggaggatggctttatttcaatgatgcacaagttcaagcaacggcgaaccaaactgcatggaacgttcgtgatcgcattgctaagttaattggcagagacgatacaagctcaaacgataattctaatctgcacttaaacgatacaaacaatggctcttccaaaagtgaccaagaaccaacgacagaacaacaaacaagtacacaaacttcaattccatctactggacgatgggcgactaatcaagcaacggtctatgtaaatacaaataatgctcaacttgacgcagctactaatactgcaattcaaagctggaatcagactggggcgtttacgttcaaaccagtaaataatcaaagtaaagcagatatcgttgttacaacaatgaaccgttctgattcaaatgctgctgggttaacgaagacgtcctcgaattcgttgacaaggagatttatgcatgcaacggtgtacttaaatacatattatttaactgacccaagttatggctatagtcaggaacgaattgttaatacagccgagcacgaactggggcatgcgattggacttgatcataccaatgctgtttcggtaatgcagcctgctggatcattctatacgatccaaccagatgatgtgcaagcagttcaaaaactatatactaataataaataaaatggcgagactgaaagaagtaaatttctctcagcctcgctattctatttagtctgtcattttccgtgcttttagtgcccataagatagagacagtatcaattatttcctgtaacatggcgccgaaaaaggccggaatgattccggtgctagcaataagcattaggatagtacagattgcaattccgattaggaccgcctgttttgcaatccgcagagtttcctgagaaatgctaacggcttttgcgactcgcgaaaggtcatcttttaggataacaacggcagctgattcactagcagcggttgatccgtgagctcccatcgcaattccaacatcggctgtcacaagagaaggtgcgtcgtttacgccgtcgccaaccatgaaaacaggatgttcatttgttggaatggctttaagtgcattgattttatcttgtggaagaaggtcggctttaacctgcgtgatcccgacttgttgggcaactttatctgcaatgacagcttggtctcccgttaacattaatagattggcaacaccaagccgttttaaccggttcattgtttgctttgcttcaggacgaatatggtcggtaaaagtaattgcaccatagtattgcccatctacgctcacatagatagctgttgctgctaacatctggtcaagattttcaggagatacgaattttaattttcctactttaacttcccgcccatcaacagttgctaaaattcctttaccagttaattctttaagttgatcaacggttgataagaaaacattatatgcagtggcataagaaagcagtgagcgtgctaggatatgtgatgattgttgttcagcacttgcagcgtaatggaggagctgcgttgagtctatttttcctgtagggaggattttatcaacggtcaattgaccacttgtaatagttcctgttttatcaaatgcaccagttttagcaactgctagtttttccagtacactccctgttttgacaacaattccatttcgtgaagctcggctcattccagaaaccattgccacgggagctgcgaggattaacggacatggtgaagcaacaacgagaacttccgcaaatcgttcgggacgaccggaaaatacccatgcaagtgaagagataataatagcaataatcgtaaatggaacagcgtatcggtcggctaatcgaacaaagtgggcaggagtcgattcagcctccttaaccaatttaacgagttgctgatattggctatctttggctagtttggtgacctgtaaagtaatggcattatcaccattaactgatcctgacatcacttcgtcaccagctgtttttgaaactggccgtgattcaccagttaatgacgattcgtcgaacaatccctcaccatttttaataattccatcgactggtactaattctcccggtttaacgataagctggttgccaactttgacatcgttaactgggatgtcgctagttttgccattggtgattaaatgtgccgtttgcggtgagttattaagtaatgcttttaattcggtgcttgcttttttggcagcataatcttctaaggcatctcctccggttaacattacaagaataaccatcgctgcccagtattcgctaacagctagcgttgcaacgacagccataatagcaagcagatcaacgccatatttaccgctacggatggtttttatcatgccaataaacattgaaaaagcaacaattgcgccgacaacagtaaccagaatttgagcaaaaagttgtaaatgaaatccaaattggagcacaactgcgattgctgcaattactaggatgatgattaatttttgcttattagatagttttttcataatacccccgcttagtcctcgtgctttctacaatttaattatagggtttttatgcaatgatataataaaaaattagaaatattaaggaaactggtgaaaaataatgcaaaatggacaatcttatcaacgaatttttgtagtgataattgattcattagggattggagcaacggctgatgccaatcattttgagagtttaggggctgacacactaggacaccttggggaacattttcgagtacggctacaactaccgacttttcagaaaatgggtcttggcaacttacacccgattatggggatgtcttcgcttgaaaagcttcacgctgcttatggtcaaatgagttcaatttcaacgggcctgagtgatcgcgagagccagtgggagatgatgggcttagcaacgaccgctgaacctgacgtttttattgatggtgtgccgttggaaatagcgactaattttgcgcgaaaagcaaagcgccctcttttaagcaattccttaatgaatattcgtactgcgttgaaagattatggccttgaacaattgacaacaggtggtctgctagtagcgacggctagttcttcaagtgtttggttaattgcgcatgaacagactatttcggttggcgaattaaaagaagattgtcagattttgcgaaaaatgttggataattccccatatactatcgaaaatgtgaatggccttctttttagtgggaaccaggcggctaatttttatccccaagaactttatagatttcctttagctccagcaagtccaacggttattgattgtctcttggaagagggttatgctgtgaagttaatcggggaaagtacccagttctttggtttggaccataatgaaataaccgggaataatcaagagagctttgttcagttgcaagaactgatcgagaaaaagtttacaggtatttgtatagcagaagtgggagagatagagcaatttggtaaagcacgtaatcctgaaggctttggaacggaattaatgcggattgaccacgaacttacaaaagtcatcgataaaatgcaagatgatgatttactgattgtgacggggaacttcgggaatgatcctacttatcctggtgaaaaacatactcgtgaatatgtacccttacttataacagccccgcaaattaaacaaaatatttctctcggtggcagaagttttagcgatattggggcaacaattcttgataattatgatttaggagataagttgccagttggtaatagttttttaagaaaattattttctgcatatagataaaagaggatggaaaaattctgattttccatcctcttttatctatattaacgatgaaatttatagtaaatagcaattcccataatcaaaagaaggacaagggcagcaagacgcgggtttgttttaaataactcgtgcattgcatgaatttgtccaataccaaggggaagagtaaacatagaaaagacaccctttcaaaatttacttaaacgcttagtagttttttataaggaattctttcatatctgttggttgatgtccagtgatatgcgcaaagtcgtcagtgacttggttcatcaagcccattgcagctgcttggtacatagaagcaagttcgtttccgtcaccctcagcagcgtaaatttcagcaaatttttttacggtaacgggatcgtaaccaatttcttcacccgtaacattagtcataatataactaagttctggcattgtataatttttgctcatggtaaggagataattttgtcccttatctcgcaagtatggcttgactgctacattggcgatggcttcagcgctatcttggcggaaataaaactaacatcgactaaattatgaacatctgccttaaacattgcagttagtgaattctcgaattcgtcaattcgatccttaactaagtaggtaatacttggaatatagataacaatatcaattccgttaaaggccgctgtcatcttagcgacgtcatagtagtcaattgccgcaatttcgtatccggcatctttgaattgggaagcttttgcgggattgtgaacgccaacgcggatattatctggagatataagcttgcttaattgcttaacaacgtgttgaccaaggtgcccggttgccccagtaaccatatatttcattattaattccttctttctttttcagcatcttttagtgcttgcttaacgcgaatagtgtcgatgacatcctgtaaactgattcttgcaagtttagcttttgctgctgtttctgcttgctggtaaaagccatcaagcgtctcttgaatattcccgccaacgatgcattgtggatttgttcgttcatcaatcgtaaatagatgagcatctccttcgatcgcaagaaaaacatcataaagtgagatgttttcaggagattttgcaagtgctggatctgctgcaccatgaacggtattgattaatccggctttgttgagcgcactcatcaaacgtcggacgacaactggtgaagtttcaatgctgctagcaatattattacttgttaatggaataattccttgataaatattaatgaaagcaagaatgtggatgctatcactaaaacgggttgaaattttcatattatcattcctttaatgctaattgtaatttataaagttacatgatgtcaagagattgaatttatcattgccttgacaattatttgttttagatatagtattagtttattgattgaaacttttttagttacaagctaggagaaaataaatgagatttaagaaaatcgttgctctttcattattaagcattgctggcttactagcagggactattacgccggcagtagcaagtgctgccagcaataaaccaattattgtgggttcaaaaaatgtttcagaaagtaagactatcagtgaaatttacgcgcttgcacttgagcatgagggttataaggttactcggaaacccaacatttcaaataatgtgatttttagtgcaacacaaaaaggcgaagttgatgtttatcctgattatacgggcacaattgtagaggcgtaccttaaaaagaaggggaccggcaagagtgctagtcaaatggctaaattagcacacgatggtattcaaaaagacggcttaacgacatttaaatacgccccaggtgataatcgccaaggtgttgcaatgccaactaaggacgcaaagaagtaccacattaccaatttaagtgaactgcaaaagaatgcaaagaagattaactttgcttcacagggtgagttcgaaaaacgtgctgatgcccttccggaaatgaataaggtttatggtaaatttgattttaagtcaattaaggattatgacgtaaatttactctataagattatggaacaagggaaagcacaagcagctccggtttcaacaactgatggtcaattagcaactgacaagtttacgttactaaaggacaataagaatatttggccaccatataatttagttccagtagtaaataaaaaagctgccaaaagtcatcccaaaatggagcaagccttaaataaagttgatgcaaagttaacaactaagcaattaacagatctaaacaagaaagttaatgtcgatgggcaaaattataagactgttgctaaaaattggtataatcaaaatatgaaataagtgccaaaggggcagatagctagtttttcttgctagatatttgctccttcgttataggcaatagatggggagtggtagcttgctagggcaaataattcagtattttcaaacaaatagcggccaatattggcaatatgttggtcagcatataattctgactgttgtaacgctagtgatttcaatgatcattgcattgccattaggatatattggttcgcgaataaaaccagttgctcaattttgtgtgatgtttgcgcaattgttacgaatcattcctagtttggcattgctgtttctattaattccatttattggaacgggggttgtccctgcgttaattgctttaattgttttagcgcttccgccgttgctaatcaatacaattctcggttttaatgaagtgagtccactatataaggaagttgggatagccctagggatggatcagcgccgattacgtcggcaaatagaaattcccctggcgttgccctatattttaaacggaataaaactagcattggttgagatcattgctagtgcaaccttagctacttatattggtgctggtggattggggaccctaatatttactggcttaggcttatacgatatgagttatgtagtgattggcgcggtaagcgttgctattttatccttgctggcaatgattagctttgattttttaattagaaaggtacaaaagcatgacagaaccaattattcaatttaagcatgttgagaagcgttttaacgatcaaatagtgattcctgatctcaattttacagtcaacaagggcgaatttataacgattcttggctcatctggttcggggaaaacaactaccttgaaaatgattaatgggttgatagcgccaagtgctggtgaaatcttagttgatggacaaaagcttcgagaactcgatctagtaaaattgcgccggcacatgggatatgttgtccaacagatcgggttatttcctcatatgacgattggacaaaatattgcagttgtgcccaaaatgctgcattgggataaggaagagattaataatcgtgttaaagaattactaagtcttgttcaactaaatcccgctgaatatatgaaccgctatcctcaacaattatctggtgggcaacaacaacgcgtaggagtggcaagagctttagcgactaatccaccgtatgtattatttgatgaaccctttggcgcgctggatgccttaacaagaatggaattgcaacgagaagtaaaaaagattcatgaatcgttggcagaaaagacttttatgtttgtaacccatgatattaatgaagccttatttttaggtcaacgagtgatgatcatgcatgaaggacgcatcgttcaatttgctacgccagaagaaattgttcgccatccagcaacggaatttgttgagcagcttttagggacgattcgccaaaatcaagatttgtggaggcaacaatatgattgagtattggaatgagaattggccgataatgcttgatgatgtccagcaacatgcaacgatggttctttcttcattagcaattgccttagtgattgcggttgtaataatcttattattcttacggcgtgaaaaatggcttaatagtttgatctatttcttttcactcttatattcaattccaagttttgccttttttgccttactcttaccgatttctggattaggaatgaagactgcaattattgttttaacgatctactctgaatatgttttattacgttcctttattacgggaatccgtggcgttgatccacaattaatcgaagttggtgtggggatggggatgacatctcgacaggtttttcgccaaattcaattgccgctagcattaccggcaatttttagtggaatccaagtggccctagcttcgacaatggcaatggcaactattgcggcaacgattaatgccggtggtctgggtcaattattgtttgaaggactgcaggggcaacaggtcgtgccgattttgtggggaacagtcttaacaatggctttgacattaatttgtgcaggaatcgttcaattgatctcgtggatattgttgcatcggtggaaaggagtattaaataactgagcaggaaattagtagtattcactgagaattcgtataatcaaaataggtaacgaaaacgaggaggatgctgaatggataaaaatgaattaaagaaattaacgccaatgcaatatgctgtgactcaaatgggggttacggaaaaaccatatagtggtaaatatgatcgatttgatgaaccgggtatttatgttgacgttgttagtggggaaccattattctcatcattagataaatacgatgcaggatgtggttggccagcatttactaaaccgattaagaagcgtgttcttacagaaaagcgcgatcaatcatttgggatggaacgaaccgaggtaagaagtaaggaagctgattcgcatctcgggcatgtctttactgatggtccaactgatcgcggaggattgcgctactgcattaattcagccgctttgcagtttatcccagttgataaattgcaagaaaaaggctatggagaatatctaagtttgtttgataaatagttaaaaatcaagggagtgggaaataacctcctcgacaaggcggttggctaagctaggatgatgattagcacggcatgggctgattatccttcgtacttagactcgagccttgtggttattttctacgttatctttctattgttcataaaagtagttgaggatgatgaattgtttaaaaaattcatcatccggtttttattttggactaggagttttttcccagcctccattctcgattttggttttaaattatttatccataattggcgattcatcccccacttctacaagtgggggatgaatcgccctcttaaagcacgttagtgctttttcttttgttctatgatatatttagtgtatatcaatatgagagtggtggtagtaattaaattggatcgtaatcaacgttcagtatacttgctgaattaccatttggtaatggtggttaagtatcgtagaagagtaattaacgatgaaatatctgaatatcttaaacatcgttttgtgattgtaggtcaatcctatggaattaatttacaaaaatggaatcatgatcaagatcatgtacatgttttgtttagagcaactcctcacacggagatggctaaattcttaaatgcttacaaatcatccagctctagaatagtcaaaaaacaattcccagaaatcaagcagtatctttggaaatccgccttttggacacaaagctattgtttaattagtactggtggagcactgttagaagttgtaaaacgatatattgaaagtcaagggagaaaataatggttctaaaagccgttaaaatgcgtatatatccaaactctgcacaacgagaccaactttggcaaaccttcggttgtgttcgttttgtgtggaatcaaatgcttaatatgcaaattgaacggcgtaaaaataatccagaggctaaatttgttaatgcctttggtatgaacaatctcttgaaacaacttaaagttgaatatccttggcttaagcaagcagaatcaactgctttgcaaagtgctaatcgcaatttagccgatgcttttcaacgcttttttaaaggtcaaaataagttccctcggtttaaatcaagaaaatattcgcaaagctacaattcaaagtacgttaatggcaacattagaattctagataggcatcatattaagttgccaaaacttggtgtggtgtattttagagctggacgtttgccgttaggcaaaattaagaacgtcactgttcgactaaatgttgctggtcaatattacattaccgttttagtggagagcgaaaatcaaactctccctaaaacaggcaaatatattggtggcgatttaggacttaagtcattactgaatctctctgacggctataaagaaccgttgaatcattttgaatctaaatacagcaagaagttgcaccattgggaaaactacgcagtcgacgttacttaattgctcaacaagctatcgcttgggatcatcacaataaggtgttaaagccatgccaactcgatgatttcaaaaactaccaaaaggcacggatcatggtagctaaatatcggcaaaagattgccaaccaacggttggatcagctacaaaaattcactactatattagttaaaaagtatgacatcattgtgttggaaagacttaatactaagggcatgatgaagaatcaccatttagctagggcgatcgctaacgctagttggtcaaaattagtagatatattgcaatataagtgtgaatggtatggaaaaaaactcattcagatcaatccatcctatactagtcaaatctgtgcaaattgtggtgaaagcaaccatcggttgggactaagtaaggctgaatggctaggaattagggaatgggactgcccaaattgtggcaaacatcttgaccgcgacattaatgcggctcaagtcattcttcaaaaaggtttggcgattcaataattagataatctaaaaaatacaggctcgggacgagccttggttaatagtcgtaacctctgcttgaaggctcgttaagaacttgtaaagtaagtatgcgatgttcccagaatctcccacttcaagcgttaaaccgcaggtttagctaagtgggagtagttcaattttcttctaacattgcatcataaagtgaagggcgaccacctaataaacgattaacataataggcgactaaagtaattaatgtcattggcaaaatttgttcaactgaaccaaccatttcagttactaataaaattgcgaccattgctttccaattcgttgaaagtgacatattagtgacatatttaataaaatcgtgactaccaccaagaatataagggttccataatccaacaggaataactaataatagtggaataatgttatgaaattcttttggaataaatgtgattttgctgtaccaccaagttaggtttagtgctgcaaattgaaaacggtatgccaagaaaccaatgacaacgccagcaacgattagtcatggataggatgcgactggtaatttagttgtgatcggaatatataggcaaggtttagtaccaaagaataaaaaaagtgataaatgcagaaacgattgaagaagttaaagcaggaatccaaattcgagaattaaaattatggatcatttcttctaataaaaacattgttcctgctaaaggtgcactaaaagccgcagataatccggccgcaacgccatactccatcaataaatatttatctttgtccgtaaagtgaaagaatttttcgttaaagcaggctccgatacaggcatcaatttggatacttggtccttcacgccctaagaaaagtcctggacagatagtaagcaaactagcaacgaatttttgccataatactggccaccaatgaatacgatgctttcctaacaaaacagcttttaattgggtaacgccagaacgaacaacatctgtttcataaggcttaacgatttttccgattaaccatgcaacgataaatgttcctaatatatatggaattaatagccaaggatgtttacccataaaaggataaataattgtcagtaaagtaagggtccggtcgataatccagcgaaaagccccgatcaccagaccagttactatcccaatagcaatactaacgccaaggtaacgagaaacaatggaggtgaatggttttcctaaaatgtcccgtgcccgtttgtgatataaagtattttcgcctttcataaatactgccttcaataaggtattttccctatattagcataaaaagagagtgaacaataacagtctacaagagataagtattgttcactctgcttttactatgaactttttaatttaatctgtgttggtgtttaccacccacaaataaacttataattgaagctactaaaattgcggaaaaacttacaacagcgattacgttacttaataatgacatcatggtaaacaccctttcttaataaatcttgttatcgctttcatcaactatattatagcattagttgaccaagattgatcaaaaaagaccttttattttactaattagggttgttatttcagcaactgcctactctttaaaaaagtcacgaataatttgtttataagctttaattgtagcaacgtaactcgaaatagttgtatattcatcagtttgatgagcaacgttccaatcgtcacatcctaaaattacaactggaaggtcgggacgatttaatgtaaatacacttgcgtcagttgcaccattgataatatcaagcttgatgtcatttggatagtttcgctgggcagcattgagggcaatttggacaaaatcgttattaggttctgtcgcaattggataaaaatcttgaataatttttagctctagttggaaaggagttgtgtggttaatatattcaagcgcatcatttaatcgatctgcaactttaacattattaaatgatgccgtagggcggatatttccttgcaaactagcactgtcggggatggtattaacttgagatccaccatcgataactgtaatactatgttggacttttccaaggtattgatcatctttggtgttatcaaaaaggtgtttttcttcttcgataaactttaacagcccttcaattgcattaataccattttgcgggtgagaactatgacaagattttccataactggtaacgcggtaattcatactccccgagtgagcaaaaataacattcccaccggttggttcgccgactactaatgcgtcaaggtcatcggcaactccttgcttttgtaaacgataagctccaggagtaccaagttcttctccggcggtagcaataaatctaacagttcctgatggcagttgcccagcttcttttaattcgattaatacaatagcctgggcagccagaccgctcttcatgtcagcagctccacgaccaaaaatataatcaccactaatttcaccgccaaagggatcatgttgccagcggtctggattaggtactgccacagtgtcttggtgtccagtgagcccaaggatttttttactttccccagtcccaatttccgcaatcaagtttgcacggcgatcaccaaattcatcaacttttgaatcgattccgtgatttgctaaaagtttttgtaagtagcgtgctacttcaacttcatttccattaacagaatggatttttattaaatcctgcagtactttgactttttcactgacttccataatgatccctcctatatgttagcgatcttggtggttaagcttcttggctaaaatatcgccaactacttgaatgattaaaacaaataaaagaacaagaatcgtggcgacaagggttacgtcgttgttaaaacggtcgtaaccgtatgaaatagcggtattacctaaaccaccagcaccaattgcaccagccattgcagtaaggctaactaaactgattagtgtaacggtggagacacggacaagttcagaacgagcttcgcggaggtaaacgtcaataatgatatcccagttagtagccccaatagcttgggcagcttcaattttaccgtggtcaacactttcaagcgcaacttgaacttgacgagcatagaaagcaaatacacctaatgaaagcggcactaatgcggcggttgttccaatctgtgttccaacaattaattgggtgaagggggcaatgaaagccaacaaaatgataaatggaattgcccggaaaacagatacgactttatcaacgatactaaaaacaattcgattttctaaaattccaccgggctcagtaaccacaagcgcaactccgaagattaatcctaaaattccaccgaaaatagcaggccagaaagtcatgtagatagtttggacgattgaagtaccccaaccattgtcaccaccccagccaagttgaattacatttggtataagattattcattccaaatcctccgatcatcaatctttgtgacagtaacatcattttcttttaagaaatcaatagcttgttgacacttatcagcatcgcccttgataactacaaacagggtaccgactggtgaaccagccaagacttcaatgtttccataaagcatacttgcttcaacttgcagcttcttatataactcgataatgattgatttagtcacgttatttgcatcgtagactaattgcagcaactcttcatcatcatcaaggtgaccaagatcaaatgctttaagggtatcgactgcggctaaggatcctcccacaaattgccgggttaagtcttgttgtggttggaggaaaactttctgtaaggtaccacgctcaatgatttgtccatattccatgacagcaatcttattcgctacccgtttaacagcgtccatttcatgggtaataaggacaatcgttaaatccaatttatcattgagccgtttaagaagatccaaaatctggtttgtattttggggatcgagggcagaagtagcttcgtcagagattaaaatttcaggatcgttagctaatgctcgggcaatggaaactcgttgttgttcaccaccggataattgaacagggtagaattcagctttatcctttaagccaactaagtctaaaagttcaagtgccttcttctcttttgcgtcattgtctaaatcagtatgtttaagagcgaaaagaacattttcaattactgaagtttcatttagtaaattgaagtgttgaaaaatcatgccaatttttcgccgcttttcttgtaattctttattgctaatttgctgttggtggtctttgaaaaagacagtaccattaactgttactgatccagcagagggaagttggaggaggttaatggttcgaactaatgttgatttaccagctccagaataaccaacaatcccataaatatcgcctttttctacttttaaagtaacatccttaacggcgtgaacaacctgttttcgttgcttaaaagttacgctaatgttatctaagtcaatgatcgggttcgccatattaatcctcctttatttattgaagttgaggttccaagcaggaatttctgcagttccgtatagtttcttaatttctcgttttgttttttcagtttggtaagcacgtacaacatctttgtaaatcttgttgttcttttcgctgtctttaacagcaatgatgttgacccattgttttgaatcctagttaactggttcaacgaaaattgcactcttgtaattaagaccagcagcttgtgcatagttagtattaacaactgcagcatcaacgttatctaacgaccgtgctgtttgatcagcggctaattctttaatcttaagatcgcgtgggttcttagaaattgaacttacggttgcgagctttgtgcccttctttaggtcaatcaaaccagcattctttaatgcgaataatgcccgtgattcgtttgaagcatcatttggtactgcgatcgttccaccattaggaatttcctttacactcttgtattgcttggagtataaccggattggagtaataaatgtatcgcctaaagaaacaagatcagttttatgggctttattccaagtttgtaagaataacttgtgttggaaggcgtttaagtcaacatcgccattttccaaagccttgtttggttggttgtaatcagtgaatcgtttgaattttaaagtaacattgtacttatctttagcggttttgcttactgaattccaaatttcatcatcttgttttgaaccagccataatcccgacagtaacagtccgttttgcttgttgttgcggacggataaaactaaagtatccggcaataacaacgataagtgcaactactgaccaaataatgatatttcttcttttctttctcttcatagtaaaaactccctttcaatcaattaaatattttcgttggttaattaaaacgttaacttgctagtaaataaaaaagcactcgtccctttattcaaaggacgagtgctcgcgttaccacctttatttgctgaatcttcacagacccagcctcagtaggttactctaataaaacaattagaattacctagcactaataacgtgtgctaacccgttatcgactaacaatcatcgataccattccaagcccatcttcaatagttacgcttgcttcttcacaccaccagaagctctcttgtaagcctcgctacttactctgcttttcgatatgttttaacgttcaattaattattatgtgttccattataatgattctctaatttttgtcaacgcattttttaatttaaattttgttttatttgggtcatcaatcgttttttattttgcctatctatagtaattaaaaaataattatgctaagattaaaaaataattaaaaagaaattgaaaggggtcatagtaatgacacgaaaagttggagttatcggaatgggtaatgtggggtcaacagttgcccactatattgtggcaatgggttttgcagatgacctagttctgatcgacaaaaacgaagcaaaggttaaggcagatgcacttgattttgcagatgcgatggctaatttgcctttccataccaatattactgttaatgattatagtgcgttgaaggatgcggatgtaattgtatccgcgttaggaaatatcaaacttcaagataatcctaatgctgatcgttttgcggaacttccatttacccgccaagaagtaaaagaggttgcacaaaagattaaggaaagtggctttaacggtaagattgtggctattactaacccggttgatgttattacctcgctctaccaaaaaataactggtcttccgaagaaccatgtattaggaacagggaccctgcttgactctgcacgaatgaagcgggcagtagctgaacggcttaatttagatccgcgttctgtagatggttataatcttggagagcatggtaattcacaatttacagcatggtccactgttcgcgttcttggccgtcctttaactgaattagcagataagcgtggattagacttagaagagcttgataaggaagctaagatgggtggctggactgtctttcaagggaaaaagtatactaattatggggttgcaacggcagctgttaagcttgtcaatgcaattttatccgattcattaactgaattaccggtatcgaacttccgtgaagaatacggagtctacttgtcttacccagcggttgttggtcgtgatggagttgtagagcaagcacaacttgacttgacagaagaagaactgcaaaagctgcaaacatcagccgatttcattaaggaaaaatatcaagaaagtttgcaagcaaaagattaaggaaaatttaaataaagaaaatagactagcataaaaaaattatgcatggtagaattgcttctatacttaacaaataaaagtggcgtcatcagataaatttggtggcaccacttttattctgtaaaaatatagaaaggaaatatatcatgacaaaagaagtaaagcgtataatctttgtagttcttttttgtgagtttttgatttgtctcggaatgagtcttatcttcccagttgaaccattcattaaaaatgaataccactttactgcctttgacatgggagtgatgtcttccctatttgcgtttgtgcaatttattgcttcacccattgttggtcggatttcagataaagttggacgaaagccaatgttagtatggggattgctaatatttgcgattgctgaatttgtttttgccttagcacagcatttatggttatttgacttatcgcgggcggtagatggattatcagcagctatgtttgtgccaacatcaatggcattagcggcagacattactagtgaaaaagaccgcgccaaagttattggttggctatcagcggcttttagtggaggattgattttaggaccgggccttggtggaatgttagcgcatgtaaattataaattcccattttgggttgctggtattctaggcttgattagtacggttgttgcttggcgctttttacctcatgatgaggatgaactatttaagagtgaaactaaaaatcctgaaaatgaactattgactggtggttggaatcagttgaaacaaattatgaccccaatactaatcacgctctttggaatgatctttgtagcttcatttgggttagcaggttttgaaagtatttatagtttgtatgtcaatgaagttcataattttgacttaaacgcaattgcgcttgttttaactctcaatgggattatttcgcttattttgcaagtctttttctttgatcggctagttcgctggctgggagaagttcgcctaatgcgatatagctttttccttagtttagttggaacgatcatggtaatttatgatcacaatcattggcatatcattattgcaaccttgtttgtttttgaagcattcgatatgttacgcccaacaattactacattattaactaagatgagcaagacaaaccaaggattattaaacggggtaaatatgtcattaacgagtgtgggaaatgttattgggcctcttattagtggctatttattagatgtcaattatcaatacccatattggttcgtatcgatattcctaattatttcctgggtaataacacttgttttaggacgggaaagaaaagcagctgctaacgattaaatatttaactttattaagaaaatagcgaggaattaggaaaaataaaatttttctaatttctcgctattgttgtatttatgcttaattttgttgtgcctgttgcaatgcatccttggttgcttctttaatcgcacgacttgttgcactggctccagtaataccatcaacgtctgcactattagctgcaataattttgccgggaagttcatctaaagcccatttgcccatttcagattcgtggtgtttgattacttgtaaatcttgaatcttgtcatcttggtaggttaataagacttttaattcaccaccataagcactaaagccatttccaatatattgggttctttctatttctctcattttattatccatttaaattacattattttgtcctgttacgcagagtgataatagcgggcaagtctgacatttaggatttcttgccgtacagacatacctaccccaaaaaatcatactatgatgagcatctaaccagtgttcagggggaatagttttcattaatttcttttcaattgcaagaacggatgctttgggctcaactattctgagacggcgggcaacccgactaacatgggtatcaactggaaaagcaggaatattaaagcattctgcgaggaccacatcagcaactttccttccgactccagataaggtcattaattctttgagggtgtggggaacctcccgttaaagtcagtaacaatttgttgagaagttttgactaagaatttagctttatttcgataaagccctaatcttttgatataaggctcaacttctgcgggttcaatccctgctaaatctgctggcaacggaaaacgagcgaatagtgctggcgttacttcattgacagattgatctgttgactgtgcactcaagattgtagccaaaagaaagtggtagtttgtgtcagcaatcaaagttgttcctgcttcgggaaatgtttgccgcatgaccttgattgagtaacgaatttcatctggtgataacatataaaatcactcttttcgaatatgattataactattttaacccgaatgattaaaatagcgaagggtaataatctcattttatactcattaaattattatttgtaaaattgagggttagcaatatgacatcaatttatgttaaagaaaaaatgtttaataaagatataattgtagaaatcgctttctttgattaatttaaataaacgattgacctagggaaggcgccttggtaaaatgtattaaagattttcttataattctaatcaaaatttaattattcagaaaaggaggataattatgagtttttggaaaacaattacacgtaaagaagacccgcgtgtttatgataataaagacggtcatttagttcgatctttgaaggtgcgggactttttagctttaggtgttggaacgattgtgtccacttccattttcactcttcctggtgaagtggccgcaatgcatactggaccttcagtagttatctcttttttaattgctgcgatcgtggccgggttagttgccttcgcctatgcagaaatggctgctgcaatgccgtttgctggttcagcctattcatggattaacgtcgtgtttggagaattttttggttgggtcgctggttgggcactattagctgaatactttattgctttggcctttgttggatctggtctctctgctaacttccgggcattatttgttccgcttggctggaagctgcctgcttcattatcaaatgcttttggtacagaaggcggagttgttgatattgtttcagttgttgtaattattttagtagccctcttaatttcacgcggggtatcacaagctgctcgtgttgaaaatcttcttgttattcttaaagtttttgcaattttactttttattgttgttggtttaaccgctataaaagcaagcaattttatgccatttattccacaataccatgaaacagctaatggtgcatttggtggttggcaaggtatatatgccggggtatcgatgattttcctttcctatatcggatttgactcaattgctgctaattcagcggaagcaatcaatccacaaaaaacgatgccacgtggaatccttggttccttagtaatcgcggttgttctttttatagcagttagtcttgtactgattggggtattaccatatcaacaatacgctaacagtgctgaaccagttgggcttgcattacgtgcagctcatcatagtggtgtagcaactgttgttcaaacaattgctgttctaggaatgtttaccgccttgattggaatgagtatggctagttcgcggttgatttactcatttggtcgtgatggaatgctgccaaaatggcttggaaaacttgataaacataatcgaccaaaccgtgcactttggacacttacaattggtgttgttttgatcggtgctttcttcccattcgcctttctttcccaattggtctcaactggtacgttgatcgcctttatgtttgtttcacttggtatttatgcattacgtcgtcgtgaaggaaaagatattccaaatccttcatttaagatgccattctatccagtattaccagctcttggttttcttgcttcattacttgtgtttatgggattagattaccaggcaaaactttacgctggtatctggtttgtctttggcttaattatttactttgcttatggaatgcgtcactcgtcaatggcaaagaaagaagatgaacaaaatgttaaaaacgaaactgaagcaggagaaaacaaatagagatgttttattagaagaaaaaaatgcatttgcaactgctgcccggattaagtactacgatattgtattagatcatggacggggggcaatggttactgatattgaaggaaatgattatatcgatttgcttgccagtgctagttcgactaatactggtcatgcgcatccgcgagtagtgcaagctattcaagaacaagcagctaaaatgattcagtatactccagcgtactttgctaattcacaagcagcgcggttggcacctcgattagcagaattagcgccgataagcgggccagttgaaatggtatggggtaattctggttcggatgctaatgacgcaattattaaatttgcgcgagcatatactggacgccaatatattatttcctttacgggggcctatcatggttcaacttacggttcaatgagcttgtcaggtgtttcattaaatatgacgcgaaaaatgggcccaatgctaccaggcgtagtaaaagtaccattccctagtccctgggaacgattaactaatgaaagtgacgaagcgtttgttgagcggatgtttcatcaatttatgctgccttttgaaacttatttgccagttgatgaagttgctgcaattcttattgaaccaattcaaggtgatgggggaattgttaagactcctcctgcttatatgcaaaaggtatacgaatttgctaaagctaatggaattctctttgccattgatgaagttaatcaagggatgggacggactggtaaatggtggtcgatccagcattttgggattgaaccagatttaatgtctgttggtaagtccttagcttcgggaatgccgcttagtgcaatgattggtcgtaaggagattctggaatcattaggtgcgccagccaatgtttacactacagctggtaacccaattacggctgcagcagcgaacgcgaccttagatgttattcaaaatgagcatcttttagaacgttcacaacgccttggcaaaaaagcagctgaattttttaagcttgaacagcaaaaatatccttttgtgggtgatgttcgaatgtatggacttgatggtggtattgatatcattgatccagttacgggaaaaggtgatacagaagcaacaaccaagctaatgtaccgcatctttgaattaggagcaattatcattagtttacgggggagtatacttcgtttccaaccaccattagttattacagaaaaagaattagatcaagcttttgcgatgattgatcaagcattcgcggaattagccgctggtaaattagcagctcccgcaaatgcagaagagttaggttggtaactcttgcaatttaagaccatcttcgggtatactttaagcgccatcttagctcagctaggtagagcacatccatggtaaggatgaggtcggcggttcgaacccgctagatggcttaaaatgaactaagaaaagagatttagaaaaacgattcgtttttctaaatctcttttcttctttataagaatatgaccttgctagtaatataattaggattgaaattacggctatgttaaaatcaaaattatgtagcattagcttaattgataaattggaggaaaagaaatggaatttattgcagtgttggcggggttattgcttgcaacccagatcgtagcacacttatgtcgtcgcgttgagattccagaagtgattggacaaatcctagttggaatcattgcaggacccgctgttttagattgggttcatctaaattcaatgatgaatgaatttcaggaaattggggttattatcttgatgttcatcgcaggattggaaagcgacctatccttactaagaaaatacttgaagcccgctgttgttgtggcgcttttgggggtaattgttcccattgtaattatgggaccagtaagttatatgtttggctttactaagcttgaatcactttttatcggggttatttttgcgacaacatctgttagtatttcagttgcagtattgcgtgaatttaatcgcctagatagccgagagggggcaacagtgcttggagcagcggttgccgatgatattattggtgttatcttgttaagtgtgatgattagtgtaatcaatggaagcagcaatagtggccacggcaatggtcagcctttaggaattgtcctcttgatgcagttagtgttctttggtggaacttacctattaattcgttggttagcaccttacctgattcatatgagtgatcgcctattaacagttgcttcaacgtcggtaatggcgatgattatctgtttaggcatggccgcaattgctgattatgttggcttgagtggggctgttggctccttcttcgccggaattgctgtggctaacaccaagcataaagaagttgttgaccggagttttattccaattggatatgcaatgtttattccgctattctttgtcagtgtaggcttgaacatgcgctttgataatattggtgaatcgtttgtctttgttattgtaatgacaatccttgcatgcttaacaaaactgcttggatgtggagcgggtgctaagctatctggctttagcatgcccagttcttatattgtcggtagtgggatggttgcccgtggtgaaatgggattaattacagcccagattggttatgaagcacatcttctttcgccaatgtattattcagatgtaattaccgtgattattatcgcaactgtattagcgccatttattttaaagaatgcattgaaacgatcagccaacgaacttgagtaaagggggcttttgatggaaaatcatgaacgagaaacggagcaagcgcgggttgataatgttgaaaaacaaattgaccaacagatagctgctaccactaaagctgttgaagatgctcatcgtgaaacacgggcagttgaacgtaattatagtgaaaatgcatctattaatcgttatgaagttgatgatattgctgaatctcggtcaatgattgaacagcagcgacaattggtttcacgagcagcggaaagtgaatcaattctaaagcaccagttaagaactttgaaaaacttaaaagggtcaccgtattttggccggattgatattcaagatcctggtgaagataagagtgaaacgctatacattggtacttcttctttaatgaatgaagataaaacagactttttaatttatgactggcgggcaccgatttctggggtttactataatggtacccttgggaaagtcaattatgaaacgccagctgggatgcaaaccacagaattaaaaaagaaacgccaattcactattaaggatggcaagatcactaacatgtttgataccaatgaaacggttggtgatgaagttttgcaagcagctcttggaaagcaaaatgaccagtatatgcataatattgtggcaacaattcaaaaagagcaaaatgatattatccgtgatacgcgtagtgatcttttgctagtacaaggagtggctggttcaggaaagacttcagcgatccttcagcgaattgcatacttgctttatcatagtcgaacagaattgaatgcggatcagattgtcctctttagtcccaataatttatttagccactacatttctgaagttttgccaagtcttggtgaaagaaatatgcggcaagtaacattagaagggtttatccggcggcgttttgaaggcttgcaagtagaaacattatttgatcgctatgaagaacggcaaaaacctgaaaatgcttctcatgttgttgctgactttattgaaagtgaatcttttatgacgtcaattgcacattatgtcgagaaaatgacaattgaggatttgcagtttgctgatattcgttttaatggtcaagttttcttttcagctgaccacgtcaaagatctttataaagaattaccattgacgatggctcctgctgataagttagttcaattgaaaaataagttaattcgtgaattacagcggcgagttaaagatgaagctaaaaaagattgggtagctaaagaactggattcacttgatttacaacaattgcacaatctttgtggtaagaagtcaattgatgactttaaggatgaagatgagcaatatgtttacctttcgcggcgtttagctaaacgacgcttacgtgtgattgcagatgcgatctataataattactttctcgatttttataatcaatataataagtttttgcatcaagttgaggtacctaagacaattagtcagcgggaatgggcaacaatgattcttgcttttcaagatgagattgaataccatcggctggaattaatgcatgcggcacctttgatgtatctgcgtgatttgatttccggtacaggacaaaatcgttcttttcaatatgtatttattgatgagatgcaagattattcaacagcgatgttaatctacttaaaacacgcctttccccaagctaagtttacggtcctcggtgatagtgaacaggctctttttaagccattgcagttaccggaagagttattaaacaaacttagtgggatattaaaggctaagcggcctaatttaattgctttacggcgaagttatcgttccacgacggagattactaattttgcgaaggccttgttgccggatggagataagataatttctttcactcgccatggaaagaaaccacgcttgttagttcgttattctgataaagagagtcagcaaagcttgttagatgagacacttaaactagctaacgaacatgaaactgtagcgatcttaaccaagaatcaagagcaagccgctgttatttatcaattacttcgccggcaaaaggttgaaaatattcatctcttagataaggatgcaagtgaattgccaaaggggatcttaattctcccaatttacttagcaaaaggactcgaattcgatgctgtccttgctgcggatgtctctgctaaaaacctagctaatactgatgaagtcggtatgatctatacaatggcatcacgggcaatgcatgaactggtccttttaagcaacggttcagttagcgacgcaattaacgagaaagctgggcgtcttttaacgattgaatatcaattgccaaataaaaattaaatttttctattgtctaaaaacgctttcaagaagtgtcgacttatgataatctaatggagtagatatagaaaaaggagatgcttcgccatggttaaagacgaatacacacttgtactagtaaagcctgatggggtaaagactcgtcatattggagatattattacccgtattgaacggaaagggtataatattgaagctcttaagatgattgacccatcagaaaaaaagcttcgtcaacattattttgataaagttgacaaaccattcttccctgaattgttagaatacatgacagaaggaccaattgtcggaattgttgtttctggtactaatgtaatccaagcaattcataacatggcaggagctactaaccctggtgaagctgaatggggaacaattcgtggtgactatggtcgtgaatggcctgatggtaacttgcgaaatatcattcatacgtctgataacgttaacagtgccactcgtgaaattggtatttggttcccagaatttgatattaaagataaacagtagaaaataaaaagactgagagaaaatttttcctctcagtctttttacttttcacttgccctttgttggcgtttaatttttcgttgtactgccaaggtattgcgttcccagaagactccgtcagtgtagccttggatgctaggatcatcttttatttgattaagtcggtactgtccccatgcacaatatagaagactttgctcgattccaagataacggcggttaagtttagcagcagtcactaaactcgaaccggaaccagcaaaaggatcaaaaatgaagtcattaggattagaactggcaaggataatttttgccagcaatttctcaggcttttgcgtagggtgaccagtattttctggcattgaccaatacggaattgaaatgtcatcccaaaaattagacggcattgtatcccgaaagttaccatttttagtagcttgccagtctttagctaccccatcttgacgataaggagctaccacctgtcgtcgttgcttaacttggtcgacgttaaaggtgtaatcactcgggttcgcggttaagaaccaaatatcttccatcccatttttccaatttttcagtgaaccccggcccttttctcgttgccaagtaatccgattttgaattgtaaaatttttttccaggatcggtgctaaggccatgctggttgcccaatcagaaaagacatagatactagcattttcttttaataatggttttaagaggtcaatccacttttgcgtgtaagcttgatattggcttgtggacatttttttaaagcttaaaccatcatactgtttattaaggttgtaaggagggtcaataagggcgagatcaacctggtgtggtgataatttagtcattaccttgaaggaatccccgttgataatcttatcggatattgtctggagattatcagtaggctgaataatttggttgaggagctcaggtgaagcttcctccagcgtgaaatcgattgttttatttctttttgagcgcatatagaccactcctgttcgacgtttaatattattatacttgtcatattcaggattgtcttgcctttttagtaggagttggattaaaattaattatattaagtagcgcgagccttagcgaggggcggtcggtgaaaaggtccccaaagtgcgaaatggtcacaacaagatacacaatgagcggcaataatgattgcaatttaggtggcaccgcgcgaaaagcgtcctatttagtttatacgactaagtagggcgttttgtaatttaggaggaatttaaaatggcagaagaaaaacacgttattttaactggtgatcgaccaactggtaagttgcatattggacactatgtaggttcgttaaagaatcgggttgaattacaaaatacaggtaaatatgatacatttatcatgattgctgaccaacaagcattgaccgataatgcccgggatccggaaaaaatccgccgtaatctccatgaagttgctctggattatttggcggttggaattgatccaaagaaatcaacaattttggttcaatcacaaattccagcattgagtgaattaacgatgcactaccttaacttagtaactgttgcacgtttacgccgaaacccaactgttaagactgagattaagcaaaagaagtttggtgaaagtgtgccagctggattctttacttacccggtaagccaagcagcagatattacagcatttaaggctgatacagtgccagttggtgatgaccaagaaccaatgcttgaacaaactcgtgaaattgtgcggacattcaaccgtatttaccaacaagatattttagttgagcctgaaggggtattcccaccaaagggtcaaggacggattccagggctagatggtaatgcaaagatgagtaagtcgcttggcaatgcaatttatctttctgatgatgctgatacagtgcaaaagaaagtaatgtcgatgtatactgatccaacacatatcaaggttagtgatcctggtcacgttgaaggcaatactgtctttacttaccttgacatctttgatccagacaaagagcaagttgctaaattgaaggagcaataccaagctggtggccttggggatgttaagattaaacgctacttaaatgaagttcttgaagctgaactttcaccaattcgcaagcggcgtgaagagtatgcagctaatattgattatgttgatcaagttcttaaagaaggctcagcacgggcaaatgaggttgcaaaccagacgcttaaagaagttcgtgatgcaatcgggattaactactttggctaaaaatataaactaaaaaagcgaggctgctaggaaaataagtttttacctgagccccgttttttttcgtgtctcccatagcagaacatggtaacataaaagagatgtatttatacgaaaaataattaattaaagcggaggtgaaaatggtggaaaacctcgcgattgtagacctcggctcaaactcggcccgaatggcaataacagaaattgctccagatggacgatttcgtgaaattcgacgtgtaaaagaaaatacacgtttatctgagggaatgggacgagaaaaaatgttacaagagagtgcaattgaacgcacaattgcggctctaaaacgatttaaaaaaatctaccaagagattcccaatattaaagttcgtgcgatcacaactgctgcagttcggcaagcacgaaatcgtcaagagtttttgaatcgtgttcaacaagaagtcggtattcatctacaagttttatctggtaaaaaagaagcctattatgattatctaggcgttgttcggacattgcgacttaaccactgtttgattctagatgttggtggagcaagttgtgaattgatattggtgcaacagcgaaaagcacgtaatttgatttctattccggtgggagctgttaatttatcagaacaataccacttaaatggctatgttcgttcggctgacctttttcgtgcgcaggtagcgataaatgaacgattgaccaaaattccttggttacgatatacaacgcgtgttccgattgttttattaggtggtgctaaccggactttggcgcgtatgactcaatcctatcatcaccatcaccgccgaaacggttcgattcatgggtatcaactctcctcacgagtagtatttgcgacttaccgtgaattattaaatcggaacttggcccagcgtaaacggctgactggtctagaaccggaacgagcagatattattattggtggaatgctgcctcttgtaacccttttgcaacgcaacagtgatggccgggttattttttcagagagtggtgtccgcgaaggaatcatcactgaatatgtaaatcaaaggaagcgacaccatgactgattggcaacacggtttttataagttatctgccgatgatcgacgtcaacaattagcaaaagctcgtcacctatcccctatggaagagcaagtattagcaaatacaagttcagatttaggggatgagttagtcgaaaattatattactgattattctttacctgaaggagtagccttaaatataaccgtaaataatcgtccgtatgttgtaccaatggtgattgaagaaccatcagtcatagccgctgctagcaatggtgcacaccgggtaagtaggtcgggaggatttactgctcctcggcaagaccgacaattagtggggcaagttgtgttagatgatgtgaccgataaagcagcagttaaagcatggttattagaacaccaagatgagattttaacaattgctaaccaggctcatccctcaatgcaggcacgaggtgggggtgcgaagtcgatgaaagttcgcactcctgggaactttattagcattgacctggggattgatgtttgtcaggcaatgggcgctaatagtgtcaatacgatggcagaagcggttggaaaatggttaacagaccagggcttccatgttattaccgcaattttaagcaatcttgcaacgcagagtctgcaagccgctacttgtaaagttgattttcgatacttagcaactccggagatggatggtaaagaggttgctcaacgaattgctcgtcttagtgatcttgcacaagttgatccttatcgagcagctacccataataaaggaataatgaacgggatcgatgcggtcatgatcgccagtggaaatgactggcgggcaattgaaagcggggcccatgcctatgctgctcgtgatgggcaatatcgaggattaagtacttgggaaattcaggacgactacttggtaggaaaaattgttcttcctttaccagttggtgtaattggtggttcaattggattaaataagatgacaaagataaactatcatattagtcaaattaaaagcgccgaagagttagcagcagtaacagcaagtgtcggattagcacaaaatttggctgctttgcgggcattgacaactactgggattcaagctggtcatatgaaactccaatatcgctcattagcggcaagtgtcggagctacgccagcagaagtaccgttagtggtagctcaattaaagcagcaatcacatgttgaccaagcacttgctaaagaaatattatcaacgatcagaaaggaccaagttaatgactgaagagagaattacactaaataaagaaaatcaagcactccttgatcaggttaacagtctatatcctgaaggtagtgtctttgttcagtttcatggtgacaagtcaggatacgttcgccatgaccaagcaactcaacaaactattcctggtgccttggttattattgtgactgacttaactgccccaaattacactgcttcacatgagttattgcaccttttgatgttgctaaaagggtttccacaaatctttttccaactatctcttggtgataaggaactcgatgaacagatgatgattatgtcaacggatttgtataatattgccatgcatcgagtagtggttgcagaacaacgtaagcatggttttattaccgatgagattgaagagcagtatctaaaggggattgaacacacattaactccggaaaaagaggaagatgatgaacggacgttacggttgttaacccttttggatgccttggtcttttatggtgatcacctctcaaagtatgaaaaaactttagcagaaaagtacccgcttgcactgaccgcggcaaaaaagatgtatgctgagattacaaagaagccaattaagtcaccattcgatatgcgccggtcaattgttaagatttattctttgtttgatcaacaaatgcaggaatggggcttaccagccttacataataatgaatatacaactctctcaccggtattaagtgcccggcaattacgtttagagatgcgtcaagtttttgaaatctatcactctgatatgaaagaacgggggacagataagcgcgcctatgttggtcttcggcggagtgatggtcaaaattcgtttactcttccggcaccggctcaaaatgcgccagaagaatttaagaagatatatgatcaaccagtgaaggaatttcttgaacagaatagcattccatacattgtaaggaagtgagttagatggatgcgacgattcaaaaaacatttgacgacgcaaaaaatattgtctttctaacgggagctggtatctcaactgcttctggtattcctgattttaggtcagcaaacggtttatatacgcaaaatcggaatgccgaatattatttaagtcaccgttattttgctagtgatccagaaggcttttacgaattttgcaagcagaatttatattttccagatgcaaaacctaacgtaattcatcaaaaacaggcagcgttgacgcaacaggatcgcgcgacagttataacgcaaaatattgataacttatatgaagaagctggaacaaaacacttaattgattttcatgggaacctcttccacgtttattgtgaaaagtgtcatgaaacagttccggtgagtgaatatttgaatagtcgcttgcatcaaaaggataatggtcccttgcgtccggatattgtgttatatgatgaaggaattaagcaagaggatattgtcaattctgtcaaggcaatgcaacaagctgatttagttgtgattgtgggtacttcgatgaaagtatacccatttgcgggcttgctagattaccgcaatccaaacgcaaaggtgattgctgttaatcagcagttattgcaatttccttttaactttcaaatggttcaagatgacgcaacaaaattctttgacgaattaaaagtataaaaaagaagctgcagttgtctgaggacaatttccagcttctttttgctccagtagttattcaaagaaaacgaccttcccatcaactttgaatgggagtgctactaaatgagaacccttctttttagtagtagccttttcttgataaaaaatgtgacgaatacctttgttctttagtagcatttctgatcgctcctttcatattgttcacttgtaaaataacatgttttgaacgttttccctagagaaataatgaagtatgagaaacgatttcattttaatgggtgaaaatgatgcataatccgttcgttttttactacaaaaatgaataaaagcgataaaaacaacgattcaagtccttgaaaaatgaatatagatttattttgtagtgtataagaatttgctaagtaatttgatgaggattttggggtacgaaagagaggattaaagatgaaaataacgatggggatgacaacttggacagagcatccagtactcattcatgatgaacaacgcccagtaaggcttgatgagtatgctcaacattttccagtcgttgaggtggatacttttttctatgctttacctcagatatcaacgattcaaaactggcttgctactgttcctccaacttttcagtttatcgttaaagctaaccagaaaatgacactgcatcagcgaaaccaggaacgtggcgaattagaacaggtctttcaacaatatcgccggataatctcccccttggtagctgctggtcaattaaagacgatattatttcagtttcctccatattttgatgcaactgtgcgtgatttttcttacttacgattaattcgggaatggttaggaaacttgccaattgcagtcgaatttcgtaatcaaacttggtataagaaagaaattttaccgtcagtcttagacttctgtcgtgaactcaatttcacattagtggccgctgatgaaccccataatacgccaacgtcagtaccatttgtgcttgcaacaactaatcccgacttagccatgctgcgccttcatggtcgtaatcgcaaaggatgggaaaatcaaggaaaagaatggcggaaaacgcggactttatatcgatattcgacggaagaactccaattctttaaaaaacaaattgagtccttgcagccgcaacctaaagaactctgtgttatcttcaacaacaactcagctaaagatgcagcacccaatgcattgagtcttcaaaaaatgatgaatattgaattcgagggcctggcacctaaatcgccagaacagcttgatctgttttaggatggagcaagccctaataaaatgctatactaaatgttaaatcttaattagtaatatcttagaaagaggggcttcatatggctgaacaaaaaccaacttattacattacaacaccaatttactatccatctggtaaactccatattggtaattcgtacacaacaattgcatgtgatgcggaagcacgttttaagcgtttgatgggttatgacgtattctacttaacaggaaccgatgaacatggccttaagattgaacaaaaggctgaaaagctcggcatgaagccacaagaatacgttgatcaaatggctgcccaaattaaagagctatggaaaaaacttgaaattacaaatgacaagtttattcggacaactgacgactaccatgaaaaagctgtccaaaaggttttccaacaattgcttgaccaaggggatatttacaagggtaagtatactggttggtactcagttgatgatgaagaatacttcacagaaagtcagttagcagaagtttaccgtgatgaagacggtaatgtgatcggtggaaaagcgccatcaggtcatgaagttcaattagttgaggaagaatcatacttctttaagatgagtaagtatgctgactggttaatgaactactataaggaacatcctgattttatcgaaccgcaatcacggatgaatgaaatgattaataacttcttaaagccagggctagaagatcttgcagttacgcggacatcatttgcctggggggttaaggttcctaatgaccctaaacacgtggtatacgtatggattgatgcattatcaaactatattactgcgctaggatatggcagtgatgatgatagcctcttcaagaagtactggcctgctgatgttcacatggtaggaaaggaaattgttcgtttccacacgatttactggccaattatgcttcatgcgcttggcttaccattgccaaaacacgttattggtcatggatggttaacaatgcgtgatgggaagatgtcgaagtcaaagggaaacgttatctatcctgaaacccttgttgatcgttacggccttgatgctacacgttactacctattacgggcaatgtcatttggtaatgatggcgtctttagtccagaagactttgttgataaggtaaactatgacctcgctaacgatctaggaaacttgctcaatcggactgttgcgatgattaataagtatcaaaacggcaaattgcttggtactaatgatgcaactactgattttgatgctgatttagaacaaactgctagtgatgtaatcgctgagtataaagaactgatggacaaaacacgatttgctgaagcattggcagctgtttggcagttggttagtcgtgctaacaagtacattgatgaaactgaaccatgggtattagcaaaagatgatagtaagaaggatgtattatcagatgtgatgacccatctagcaaagagtttgcggattattgcagccctaattcaaccaattatgccgcatgcaccaaaacaaattgttgaacaacttggaattgaagggactgacttatcattaaccgatcttcaatttaatgatttcccagcagaagctcaggttgtcgccaaaggaactccgatcttcccacgattggatgtgaaggccgaggttgaatttattaagagcaagatgacagtaaacgaaaagaagaagggaagaaaggcaatggctgaagcaaaagaaaaagcccaggaagcagcacaagaagaaaaagcagatggcaaaaagccaattcggattgatgtctttgataaagttgaattgaaagtagctcaaatcactgctgccgaccatgtagaaggtgctgataagcttctgaaattccacatggatgatggaacagaagaaggtcggcaaatcctttctggaattgctaaatggtatccagatccttctgttttagtaggtaagaaagttttgattgttgctaacttgaaaccacggaaaatgcggggcgaattaagccaaggaatgcttttgtctgctgaaaaagacggtaatgttcaagtagtaactgttcctgacaatttagtacctggaatgggcgttgaataaagtgagtaatcatcaacaccagcaattggtttatgattcccatacccacctaaatgacgatgtgttttatgatgatgtgcctgcctttattaaccgtgctgctcattatggcgtgacggagatgaacattgttggctcgaaccagctattgaatactcgtgctttaaagttgggacatcagtacgataacctgcatccaattatcggttggcatccagaagatattgctaattggaatagtgaaaccaagaaagaattacgccaacaattagcagatcccttagtcgtgggaattggagagattggcttagattattataatgacgagcattctcctcaccagcaacaacaagaaatttttgctgaacagcttgagtgggcgcgagaacttaaattaccggtctcaattcactgccgggatgcactagctgatgcatatgaaattttgcggaatgcccacgtcgatgaatttggcggggttatgcatagttttaatgggacttcagaatgggcagagaaatttatggatctcgggatgatgatttcatttagtggtgtcgtaagctttaaaaatgcgacagaagtccatgaagcagcattagttgttcccctggaaaagatgatggttgaaacggatgctccttacctaactccgctcccataccgaggaaagcaaaacgaacccggttttactaaatttacggtggatgcaattgcagatttaaagcaggttgatgctggcaaagtggcatataaaacatttacgaacgctcgccacttatttttggaaaatgaagaaagaggcctatgattagaataaaagaagttatagttgttgaaggtaaagatgatactaagcaaattttaaaagcggttgatgccgatacttacgaaacaaatggatctgcaatttcaacggctgacttggcaaagttgaaaaagttacaagcaagccgaggcctaattgtttttactgatccggactttaacggggagcggattagaaaaataatcagtgaagccattcctggcgttaagcatgcttttattaaacgaaaagatggtgtgccaactgaggctcacggtagcttaggggttgagcatgcaacgccagcaattataaaatcagctttggagcacctttatactcaaacaacgacacctcagcaagtttttaagcgagaagatttgcaaaaatggggattaacaggtcaagcagattcacgaaaacggcgtgaaaagttagggcaattactcggaatcggttatggaaatgggaaacaattgattcaccgtttaaacatgtttcaagttgaccgggcaacatttgaaaaagcgattaagcaaataaatcaggaggcagatcatgagtaattcaccagaaattggtagtcgaacacgtacccgcgcgataatggaaaagtacgggatccgaacaaaaaagagtttcggccagaatttccttactgatttgaacgtcttaaaaaatatcgttgaggcagcagatattacagctaatgacaatgtaattgaaattggtcccggaattggtgctttaacggagcaattagcacaagcggcgggagaagttttagccttagaaattgatcaagatttaattccggtattaaaagaagtattatcaccatatgataatgtaaaagtgattaatcaagatgtccttcaagctaatttaccagagttaatcaaaaaggaatttaaggatcctagtcgaccaattaaggtggttgctaatctcccatattacattacgagtcccattctaatgaatttgctggctagtcctgttgagtgggcgacgatttgtgtgatgatgcaaaaggaagttgctcaacgactcactgctaaaccaggaactaaacaatatggtgcgttgacattagcgattgaataccaaatgcaagctaaaattgcttttgatgtttcacggaaagtattcgtgccgtcgcctaatgttgattcagcaattgtggtattaacgccacggacaaatccgcttccggttcagccttttgataagcaaaaattatttggctttatccggggatgctttgctcatcgtcgcaagagtctttggaataacttgcaaagtgtaattggtaaggatccagcggtaaaagagaaaatgactgctgtcttagctcagctggatatttcgccacaaatccggccagaaaaattaaccctcaaacaatttattgaacttgcgaatgctcttcaccggcaaaatctcttgtaaaagatggttgaccgttataaaatattatggtacaattttgatttttgtgtaaaaaaagagtatgctagtctacagtgaggtgaaggagtcgtgcctaatagcattgtagaaattaagaagaagctagatgaacggattggcgagcatgttttagtaaaagcgcaagctggacgtaaacgtattaccacccatcacggtattttaagtaagacttatcctgcagtatttgttattcatttaaatgatgaacaaggaacattggatcgagtttcctatagttatactgatttgttaacacgaaatatttcaattgccttcgatgaagcagaataaactgataatttaaaattcatatttataaaataataggagtgagtaaaaatacctttcaacaggaaggcagtttttattcactccttttgctttaggaatagttaggaaacagtagttgcaaggattatagttccgttagtataatttaactaactaaattattacaaataaggagggttgccggatgatagttacagaaaaagcaccagcaaaattgaatttgagtttagatacgccgatgcgatattttgatggttctcctcaatgggatatggtaatggtctcggcagacctggctgattatgtaactgttgagacacaccggcgccctgcaacaattaaagtctatacaaatagtggctttttacccaatgaccaacgtaatttagcataccaagcagctcatattttacgtagtcgttttcattgtaaagatggcgttacaattcggattaagaagcaaattccagtcgcggccggattgggcggtggctcttcagatgcagcggcagttttacgcgcattaaatagtatttggcggttgggcttgagtttatcagaactagcaaagatcgcattaacaattgattctgacgtcccgtattgtatatataacaaattagcccacgttactggccatggtgaaaaaatcgaattgttaccaccgcaacctcattattgggctgtaattgcaaaacagaagatcagtgtttctacgccgcaaatcttacgacaaattaattatgagaagcttcaacatcttaataatgaagcattactgacaaatttaaagaaagaagattggcaagaagcaacaaaatatatgggaaatgttttagagcccttaacgatgaaattttatccagagattggtcgtctaaagaataagatgaaagaattgggggccgatgttgcccagatgagtgggacgggaccaaccgtcttcgcaatctgccatacagaatcgcgagcaaaacggattcaaaatagtatccggggattttgtcgcgacgttcatgttgtaactttgctttgattatatttaaggacaagaggaatgaggctgagagaaaacttttgttttctcccagcctcaactgcttttatgaacaatagtaagataacgtgaaactagcttcatgtcgccacaagactcgaggctaagtacgaacgctaatcagcccgtgccgtgctaatcatcgttctagcttagcccaccgccttgtcgaggaggttattttccactctcctcttgtcctttttatttttatagttgcaatctagcataaagttcgatattatattcattgttctaaatagtaatgattacgattaaagaagagggaaagaatgaaaaaatatattatcagtattagtagtattgttgctttgttggttataattcttgggttatcctttgttccgtggaaatcgatggggaaaaatcaaaagccaattagagtggtaactgggatgaatttctatggtgaagtagcgcagaaagtagctggcgatcatggccaagtgatttcgtttattgataatgcttcggttgatcctcatgattatcaacccaatactaagcaagcccagcaagttgctaaagccaatgtagtaattgaaaatggtcttggttacgatagctgggtaaacaaactcgttaaatcaagcagtaaccataacaagattaaagtaattaatgtagcatctttaaccggcaagaaagatggcgacaatgagcatatttggtatgcacctgagacggtcgaaaagttagcaaatgatcttgcaactcaatatggtaaaattgatccgcaacatgctaaggattaccaaagaaatgcacgcaaatatttagcttctcttcaaccgcttaatgaagaaattgcgaaagtaaagcgccaggtaaatcctaataataatcgagttgcagtcagtgaaccagtttttgattatgccttagagaatgttggttatcaaattatggacaagcattttgaaaaagcagttgaagatgggaatgatccatcaccaaaagatattgaagaaattcaacaagcaatcattaatcaccaaattgccttctttgttgataattcgcagacaagtgataaagttgttgataatttagttaaacttgcccatgaacataatgttccagtattaaaggtaacggaaacaaagccgaatgggtatgactatatgcagtggatgctcaagcaataccaagcattgtctcgcattcaacaaaaggagaattaagaagataatggcagttgtatcagttgatgatttaacgatcgcttatggaaatcatactgtaatcgatcatttaagcttctccattaatgaaggggattttcttgtcgtggttggtgaaaatggggtcggaaaaacgactcttgttcgctcaatgcttggttttttaaaaccgaaaagcgggacaataactattccgcaaagtacacgacttggctacgttcctcagtttcgtaatattgacgaggaatacccgctatctattcgcgattttgttgctttaaatactaaaccacgccttttgccatggctgactaaaagcgagcgaaaccgtgttgaacggatgattcgtgaaaataacctaacaaagattgctgagcggccccttggtttagcatcagggggtgagaagcaacgagcatatcttgctcaagctttattacccaatccaaatctccttattctggacgaatcgacggcaagtctggacaatgaaatgaagtatgaattgctagacctggtaactcgttttcaacaaaatggtttgagtgtaatgtttattactcatgattgggatctagcaaaacaatatggaactcgtttcttgtatttatctcccggttcttattccactgggccaattaatgagttacccagtccggtaaagggggataaaaaataatgttaactttaagttttatgcgtcatgcatttgtcgctagtacatttattgcgattatttgtggaattattggagtttttgtcgttgcacgaaatttatcattcttaacgcataccttgtctgaaattgggtttgctggtggtgcttttgccgtttttgctggatggccagcactaaatgggatgattctgtttacaatgttaagttcagttattgttggacaaatgagtataaaagaatcacgacgagaagcggttattagtgccgtttcagcgctgttcattggcttaggaattcttttcttatctttgagcagtcagtcagctagctcagcaacaagtattttgtttggtagcgtggttggaattagtttgaatgaggtctggcagcttgtctacctttccattcttgttttaatcattttgctattgatgtatcgtcgccttaagtttgattcctttgattcaattggggcacaggtcagtggaataaatcaaacagtgatttctgttatttttcttttactacttgctttaagcgttagtgtcgctgctcagattgtcggttctttgctaatttttattctcctaacgttaccagctgctagtgctaaatactttacgcatggtgtcgcacggatgattattttagcgattttattttcactgttaggaacatggcttggtctttttctcggttatttgacagattggccggttagtttctttatcgcagtgattgaagttatcatctataccacagccttgatttatagtaaatttatcgaatcgaattagactgtggcttaagtagttaagcaggtaaacaacatagtacaacaatggtcttcaacgcccggcaaagtgttggagactattattatttgcggggctttcagatgctagcttcgtggtgacaaaacgcccccctatctcggactctttttcttcagtaaatactaaaatttttgccgaaaatccgaacattttatgttaaaatcaatgttaattaatcctttttgaaaggcagagaaagaacatgaaaattagacggagtaaccgattggtggatatgacacgttacttgcttgaacatccgcgatcattagtatcgttgaaattttttggtgagcgatatgactcagctaagtcatcaatcagtgaagatttaggaattgttaaacataccttccaaacgtggggacagggacgattagaaacaattcctggtgcaagcggtggcgcgatattaacgccattttattctaaggaaaatgctcaggcggccattgataacttggttgaccgggttaatgatgactcgcgtttgctaccgggaggttatgtttacttatcagatttaatcggccaaccggaagtcttgcggcagattggtaagttaatcgctactcaatacgttgatactgatgttgatgttattatgacagttgagactaaaggaattccgattgctcaaagcgttgcgatgtatatgaataaaccatttgttattgttcgtaatagttcacacattactgaaggacctactgtaagtgttaattatgtttctgggtccgtccaacggataaagaagatggaattgtcccgtcgtacattatcagctggggcgaatgtcttggttgttgacgactttatgaagggcggcggcacgattaacggaatgaaatctttgattaaagaatttgatgctaacttggttgggattactgtttttgcagaaggtcgtccggtaaatgggcaacggttagtcgataactgtacttcattaatcaaagtggaaactaaagatggtacggagaagaagattgcagcacaagcaggaagcttcatggaaaacgtgtttgataagaaagtagagaattaggaaatgacaaaacgtaatgcaattattttagctgctggtaaaggtacacggatgcgctcaaagctatacaaagttttacaccaagtttgtggtaagacaatggttgagcatgttttaactcaattggaaaaagccaaaatcgataatattattacaattgttggttttggggcggaaacagttaaacaacgattaggacaccgtactaaatatgcgctgcaggaacaacaactcggaactggtcatgccgtaatgcaaacaaaaaaccttcttgcaaatgaagatggtgaaactattattgtcagtggtgatactcctttatttacggctgagacttttgaaaagctttttgaatatcatgaacaacggcatgcggcggctactattttgacttctattgctcctgatccaactggttatggtcgaattgttcgaaatgatgttggaatcgttgaacgaattgtggaacaaaaagatgccactattcaagagcaggcaattaaggaaattaatactggagtttactgctttgataacaaaaaactatttgctgcccttagtaagatcacgaatgataatgctcagggtgagtattatttaactgatgttattggtattttaaagcaagaaaatgagatcgtaacagcctacaagatggataactttgacgaatcgatgggggtaaatgaccgagttgcccttgcacgtgccaacaaggtaatgcgtaaccggattaatactcattggatgcgtgaaggggtttcgatgattgatcctgatacaacttatattgatgctgatgttaagattggtcgtgatacagttattgaaggtggcgttgtgatcaaggggcatacagaaattggtaacgattgttatatcggtgctggttcacggatcattgattccaagattcacgatggggttaaaattatttcttctacccttcaagaagcagaaatgcacaatggcagtgatatcggtcctaatagtcacctgcgtccagaagcagaaattggcgaaaacgttcatattggtaacttctgtgaggttaagaaggcttacattggtgaaggaacaaaggtcggtcatttgacttatatcggtaatgctactttaggtaagaatattaatgttggctgtggagttgtctttgttaactacgatgggacaaataagcaccataccaatgttggggaccatgcctttatcggtagtaacagtaacctagtggctccggttaatattgccaaggattcatttgtcgctgctggttcgaccattacagacagtacagaacaatatgatatggcaattgcgcgggcacggcaggttaataaagaaaattatgctaagaagctaccatggtaacttgctttttgcctcactaatttatattatgtaagtggtagtagtataacttttattaatcagcggaggacctaatgacacagcaatattttgatcaaaatttaaaaatctttgcgttaaattcaaaccgtcccttagcagaaaagattgctaagcatgtcggtgttgatttaggaaaattatctgttaatcgttttagtgatggtgagatccaaattaatattgaggaaagtgtgcgaggagacaatgtttatgtcatccaatcgacctctgccccagttaatgacaacttaatggagttgttaattatggtagatgcacttcgtcgtgctagtgccaagacgattaacgtggtgatgccatactatggttatgcccgtcaagaccgaaaagcacggagccgtgaaccaatcactgctaagttggttgctaatatgttgcaaaattccggtgttgatcggattattgcacttgatcttcatgccgcacaaattcaagggttctttgatatccctgtcgatcatttgatgggtgctcctcttttagcagagtattttatcaaccagggtgttgctgaaaatgcagttgttatttctcctgatcatggtggagtaacacgggcacgagcacttgccgagtttttaaaatctccaattgcgattattgacaagcggcgtccacgggcgaacgttgctcaaatcatgaatattattggcgacgttaagggtaagaagtgtattatgattgatgacatgattgatactgcgggaactattagtttaggttcgcaagcattaatagatgccggcgcagaagaagtctacgcatcatgtacccatgcggtattatctggcccagcaattgaacgtttacggaatgcaccacttaaagaagtcgttgtgacggactcgattcaattgccaaaagaaaaacaaatcgataaaatcaagcaggtatcggttgctccactaattggggatgcaatcaaacggattaacgaaaatcgtccggttagtccactatttaagcaagtattccaaagtgcacagttggaaaagaagtaaggcttaagtaaattgagattagtaaataagtagggactgtgacataagtcaagttactttcataaaagacaaatggcacagtacaccaatggcttccaacgcccggtaaaaccgaacgttggaggcctattgttgcttgcggggctcgaaaacgaagtcacaagtgacttctgtctcgcttcctttcttatattccatttctgtatttaaaagaaaataaagatttgggaaagacaaacagtcattatcaattcatgttataatacgatgtgaaataaggaggagaaaaatgacaacaattaagtttttcaaaaaagcaatggttggaacagctgcagtcgctactatctttgccttagctggttgtggtaaacaatctgcgtcaagtagtgatacaagttcttccagcacatcgtcgtctgtccgttcttccgaaagtaaagcttcaaaggcttatcgtacagctaataagcttatccaaaatcatgattatgaaggggcttatgaacagttaaaccaattaaatgatcataatgctcaaacggaagcacttgctgatgatttacaaagctacatggatgcccaaaaagcatatgaaaatggcgattatgatggtgctaagaacaaattgaaatcacaaaagtcaactagtccggcaatgcggaatgcatacgctgatttacaaagcaaggtaagttctgcacagggttctactagttctcaaacttcatcatctactaataatagcaagcaaacaaataagcaatccggttctacaagtgcagcaactcaacaatcatcctctgctgctaaccaagctgcatctgatgcaactagcgataatgtagtacaacaatttgctaacaagatgggcttcagtggctcccaaggttaccaaattatgccaactggtaagactggtaatgtttacaagtttgaagtacgtcaaaacaatagtgataacactgttgctaacttaatcggtatttaccaatacaatagtcaaactggagcggtaacaaaaatcgcttaatatataaaagatgacaaaaataaaagcaagaggtgtagaaagtacgcttcttgctttttatttctgtctttacttaagaacatatttttcaatcgcttttccaacaccatcatgattattatcagcggttgttacgtcagcgatctttaaggtaccaggaattgagtttcccatcgctacccctaacccagcaaattcgatcattgaatcatcgttttgtgcgttgccaagggccattacttcttcttttttaattccgagttcttcgctaagtaattgaagggtatttcctttacttgcttgtttattcatgaattctagataaaagtcttcgctgcgaacaatggaaaagcggtcacgcatttctgccgaaagctctgcccaggctttgtcaatttgttctttagtatcaaccatcattgctttggcgattacgtattgatcttgcattttagaaagttcttcaaaggtacgataacgaattggcatacttacaaggtctgactcgtagactgtataaggactcaaatcccggttaattgtgtagatgtaatctcgcgtttcgatttgggacttgacgccttctttaatacaataagtttgccagtctgcatagtcattgaaaggcatcgtgtaatttaccaggacgttcccactagttgattgggccagtgcaccgttgaagctaataacaaattcgttatctgaatcatttaagcccaattggtcaaggtatgcttttacgcctgtcattggacgtccagtgcataagacaatctttactccctgcgcgctggctttttttattgcagcaacagtttgtggtgtgatttcacgttggtcattgattaatgttccatcgatatcgattgcgactaatttaattgccattatttttgctcctttgggttaataatatgattattcttgatatagctttgaaattcttcatagattggttcgaaaatttcaatattgtttcgcgtttcaagcatctcttttgggaaaaagaaccgttgatctccggcttctcgtcccgatacgctagcgactaaggtactaacttgggatagttccacaaaatcgccattaggttggagaagctcgatttgcgtttgagtattagaatcttgtggatgataagtatcatatggaagtttaaaactatcgttgactgcggtgtaatactggctattaaacccagcagtttggatgagctttcgtaaagttggtaaaagtttttgtgtattttgatcataaatgactgatttaaatggtcggcggttaagaaaacgactagcaaggtcgcttaaaatatcatcacgagaatgggtccaatgaataaaataggtggttaagacaccatcgtcaagcgccaaatagtcatccaaggtaaacttaccattaaaaaacggcatcagcatatgaggggtgaagtcgggctcaaagtcattaggatgttggtaaatatattttgcccgcattaagaggtggtctaagataacttccattgaacgggaaactgggtgaaagtagacttgcagatacatttgaaggcgactgataatgtaatcttctaccgcatgcattcccgaaatttcaaaggcaattcctctcttaactggtcgcataacatgaagaacacgatcaagatcaaactttccgtagtttgttcctgtgtaatacgcgtctcgttgcaagtaatccatccggtccgcatcaacttggcttgagatcatttgcaccacttgtggattttcataagtatggtcgatcacactagcaacttgatgaggaaaatcaggggatacccgttgtaatattttattaatattagtgctgctgtcggtgatcaactggcgggtaatttgctcatggtttgtatggaaaatatgctcaaatgtatgggaataaggaccatgccctaaatcatggaggagggctgcacataaggcaactggtcgttcgtgatcatcccataggccgtcgccaggatgctgactaggatagtttcgctggaaatagttgcacatttggcgggtaatttcatagacgcctaagcaatggccaaagcgggaatgctcggctccatgaaaagtaaatgatgaagttcctagctgcttgattcgtcgtaatcgttgaaactcaggagtattaattaggtccataataatttgattatcgacaataatttgtccgtgaattggatcgcgaaaaaccttttcacggcgaagtttttcgtcataaaagtgattcatattaatcttctttctctaaacgttcttgtaaacgttccatgctgattagttctttattgagggttgatataaaattaggcgaccacattaagttattaaggctgtcaggaacaatgatttgaacgactgattggattcgctggatcgcatcctgaacgcttaattgcgtgttgagggctttagagatagttgtcatcgctcccggccaaacatctggaaaatgccacttattttggctttgctgcaatcctgtatcatagaagtcacgaattagtttgccccgatcctgctgattgccaccgacacttaagtaaagcattactgtaactcccattttgtttcggcgttgggaaatgccaccgattttttggccgttaacgctgatatcaaaactccccggacagtatgaatgagtgatttcaccagtagcgatttttaggctaggaaaagcagcctgaattaggtcgaccattcgttgatatgcttcatcaatagttaattcatggtcttcgaggtgccatggatagaaaattgacaggtttaaaataccgtcgtcacttacaactgctaatccccctgaattacgcatgaaataatgaaaaccacggtgcgtaagcgaagtaagggcagttgataaatgcggtaatcgttgatcttttaaccctaaaataaccgtatcttctaaggtccaaaaatgaagaagaggatatttgagtttgttagctgaacgtaacaaagcgttggtatagatgaaagacgaaagattatccgctggagttaaaggttgaataaaccgctgaaaacactgattcttaaaattagccatcgtacttcttcttttctatgaaataatatatctatattatacaagaacttacgagaacatggatatttcacggggtatttatccataaatttgcgagaatacccccacttctataagtaggggatgaatcgctctcttaaagcacgttagtgctttttcttttgttctatgatatatttagtatatatctataaaatgtggtgataacaatagaattggatagaaatcagcattcagtatacttacttaattaccatttggtaatggtggttaagtatcgtcgaaaagtaattaacgatgaaatatctgaatatcttaaacatcgttttgtagttgtgggacaagcatacggcattaatttgcaagaatggaattatgatcaggaccacgtacatgttttgtttagagcaacgcctcatacggaaatggctaaatttttaaatgcttacaaatcgtctagctccagaatgatcaaaaaacaatttccagaaattaagcaatatctttggaaatcagccttttggacacaaagctattgcttaattagcactggtggagcgcctttagaagttgtaaaacgatatattgaaagtcaagggagaaaataatggttctaaaagccgttaaaatgcgcatctatccaaattcagcacaacgaaatcagctctggcaaaccttcggttgtgttcgttttgtatggaatcaaatgcttaatatgcaaattgaacggcgcaagaataatccggaagctaaatttgtgaatgcctttgggatgaataatctgttgaaacaacttaaggttgagtatccttggttgaaacaagcagaatcaactgctttgcaaagtgctaatcgcaatttagccgatgcttttcaacgcttttttaaaggtcaaaataagttccctcgatttaaatccagaaaatattctcagagctacaattcaaagtacgttaatggcaatattaaagttttagattgccatcatataaagttaccaaaactcggtatcgtctattttagagctggtcgattgccaatgggtaaaattaagaatgtcactgttcgtctgaacgttgctggtcaatattacattactgttttagtggaaagcgaaaaccaaactcttcctaaaacaagtaaatatattggtggcgatttaggacttaagtcattacttaatctttcagatggatgcaaggaaccgatcaatcattttgaagacaaataccataaaaagttgtatcgttgggagaaattgcgtagtcgtcggttcttaaaggctcagcaggaaatcgcctgggatcatcataataaagtgttagttccacggcaattagatgattttaagaattatcagaaagctcgtattatggtggcgaagtatcgacaaaagattgccaaccaacggttggatcagctacaaaaattcactactaaattggtcaaaaagtacgacatcattgtgttggaaaaacttaatactaagggaatgatgaagaatcaccatttagctagagcaatcgctaacgctagctggtcaaaattagtagatatgttgcaatataagtgtggctggtacggtaaaaagcttattcaggtcaatccgtcatatactagccaaatttgtgctaattgtgggaagaataatcatcggttaggattgaataaatcggaatggttagcggtacgtgagtgggattgtccaaactgtggtaaacatttagatcgtgatattaacgctgcacaagtcatcttgcaaaaaggattagctatccgatagataaagttaggctcgggacgagccttggctaatagtcgtaacctctgcttgaaggttcgttcagaatcggtagggtaagtatgcgatgtttccagaatctcccacttcaagcattaaaccgtaggtttagctaagtgggagtagttcaatggtaaaaagagtataataatgacgatgagcaaagtgaaaggaggagtttattatcaaaagtgtaattcctgttcatgtaaatctctcaacgatcattgatcaaaatggacagcaagaaaaatttacctttactgaagaaggtacttttgttgaaatgaatggtaagtattatttacggtacattgaacaccaagatggtcaagaaacgccggtccaaattaaatttgaagatgagctaatccgcttaagaaggcgtggaaatgtcgaaacaaacctatttttagacccaacacaagaaaccatcatgcggtaccaaacagaatacggcatgattaaaattgacgtgttaacagaaagtttggaaaaagacgttgatgtaaaggctccggctggtcacctttctgttaagtaccaactaaaacaagcgggacaattaataggtagttaccaactagaattgcaatttgctgcttaatattgtatgatgtagtttagactttttgaagggatgtgcaccaatttggatttaaaggtttttgacggtcaggacaaatcagaactttcaatgattgaagtcgcacacgctattttagctcaccatggggaagcaatggcgtttgttgatttaaccaacgaggttcagcaatatctgggtaagagcgatgaggaaattcgtgaacgtcttgcacagttctatactgacttaaatgttgatggcagttttatttcccttggtgacaacacctggggtctgcgtgcttggtacccattcgaatctatcgatgaagccacagttggtgaaaacgaagaagatgaagaggatgatcgtccaaagaagaagcggcgtaaagtcaatgccttcctcgcagacaccgatgacgatgatgatgtaattgactatgacaatgatgatcctgaagatgaggatcttgatactgacgatgacactgattctgaagatgattatgatgacgacactgatgacttcagtgacgacgatgatgatcttgacgacggtattgaaggtcagctatcagaattacatgatgaagaagatgaagacgaggatgacgaatgattttcaactttgtgcttgactattatttattgaccctgtattatttttcttgggcgcctgtaaaaacaggccaataagttcgtagataaataagctccctgtttcagtgttttatttgaaatagggagttttttctattatcacacccgcaaatataaaaaaggagtagacgacaatgacgaaatacatttttgtaaccggtggagttgtatcatcattaggaaagggaatcgttgctgcctctttaggacggttattaaaaaatcggggcctgaagattgcaatccaaaaattcgatccttacatcaatgttgatcccggtacgatgagtccataccaacacggtgaagtttttgtgactgatgacggaacagaaactgatttggaccttggtcactatgaacgttttatcgataatgatcttaataaatattcaaatgttacaacgggtaaaatctactctgaagttcttcgtaaggaacgccgtggggattaccttggtgggacagtacaagttattccacacatcactaatgccattaaggacaagattaagcgtgctggtgaaagtactgatgctgaagttgtaattaccgaaattggtggtacagttggggacattgaatcacaaccattcatggaagctattcgccaaatgaaagaagaagtgggtagtgaaaatgtattgtacatccatactaccttagtaccatatcttcgtgctgctggtgaaatgaagactaagccaactcaacacagtgttcgcgaattacgtggtttaggaatccaacctaacattttagtcgttcggacagagcaaccaattactgatgatatgcggaagaagatcgccttattctgtgatgttgatcctaaagccgttgttgaatcgatggatgttcataccctttatgaaattccgttaaacttacaaaagcaaggaatggatcaattggttgtcgaccactttggtttaaacgtgccagaagctgacatgacagaatggactgaaatggtaaatcatattgaacatgacttaactaagaccgttaagattgcgatggttggtaagtatactgacttacaggatgcttatatttcagttaatgaatcattacgtcatgctggttatcctgtcaatgctaaggtaaagattgaccactttaatgctgaaaacattactccagaaaatgttgaagagacattgaaagactacgatgggattcttgttcctggtggttttggaaatcggggagtagaaggaatgatcactgcaattaagtatgctcgggaaaatgatgttccttatctcggcatttgcttagggatgcaaacagcatgtattgaatttgcacgcgatgtattaggctacactgatgcaaactcaactgaatttgatacaaacactaaacacaatattattgacttgatggcagatcaagcggacattgaaaatatgggaggaacacaacggcttggtgcatatccatgtaagcttaagccaggaacagttgcggcagcggcttatggtaaccaatcaatgatcagtgaacggcaccgtcaccgttatgaattcaacaacgactaccgtcaagaaatggaaaaccatggtttagttatttctggagtaaacccagatcggaatttagttgaagtagttgaaattcctgataaaaaattcttcgtggctgctcaatatcacccagaattcaagtcgcgtcctaatcatccagaaggattatttgctgcatttgtaaaagcagctgctgaggacaaataaaaattaagttgtataatatatttaatacaagagatgggggcaagaatgtcgcttctcttgttttttgtttagtagaattgttaaattttaagttaaatatgctaatttttggcctgaccttatgattttttttaagattgtttataaaaggttgtaattctcttgatatttcattatcattacagttgactgttttgtaactgaaataatcattaacttagcttaaatgaaaaacagactaaaatttttaagtgaggaaacgcagaaatgaagaaaatgatcattcaaggaggaaaccgtctttctggcgaagttacgatcggtggtgccaaaaatagtacagtggcattaattccagctgctattcttgcggatacccctgtagagtttgacacggttccagatatcttggatgttcacaatctgatgattattttggagtcaatgaatgtaaagtccgagtttagtcacggagttttagatattgatccaacacaaatcgtagaagctgaacttccaagcaaggcaattaaaagtcttcgggcttcctattactttatgggtgcattattaggtcgtttccatcgcgcgacattaacatttccgggaggcgataatatcggcccccgcccaattgaccaacacttaaaagcatttaaagcacttggagcaaccgttagcgaagaaaagggtactgttcatttagatgcgccgaatggcttacatgggtctcggatctttttagatatggtatcagttggtgcaacgattaatgctaccttagcagctgttcgcgctgaaggaacaacgattattgaaaatgcagctcgtgagccggaaattattgatttggcaacattcttaaataatatgggcgccaaaattcggggtgctggaaccgatactatccgtatcactggagtaaagacacttcagtcaatgaatactcatacaattattgctgatcgaattgaagcaggaacatacctatccttggcagcagcgcttggtgatggggttatgatccataatgttattcctgaacacttagaatcatttaccagtaaaatgattgaaatgggtgttgaacttcaaatcgatagcgataagatttatgtaccaaaatccagtcatttacatccggttactgttaagacaatgccattccctggttttgctactgatttacaacaaccgcttaccccattgatgtctcttgctgatggtgatagtacgattgttgataccatttatcccaagcgtgtaaagcacatttcccaactacaaaaaatggggatgaagattgaagcacatgatgggatgattatcgttaaacatacagaaaagcttcatggcgcagaagtctctgcaggtgagattcgtgccggagcagctttaaccattgctggattaatggcagatggacagactgtaattaataatgccggaaatattttacggggttacgatcgaattgtatggaagcttaatcgccttcatgccaatgtttctattgaggacgattcttcagtaaaaattggttagaagttgcgtacttctttaaatcgtggtatcctgttagagttgattatctatgtttcaggcaatgattcatggcaaaaggagcgtaataaattatgaaacaaggaattcatccagattatcatccagtagtttttgaagattcatctactggttacaagtttctctctggctcaacagccacttcaagtgaaactgttaagtgggaagacggtaacgaatacccattaattcgggttgaagttacttcagattcacacccattctacactggtaagcaaaagtttactcaagccgacggtgctgtcgacaagttcaacaagaagtacggtctcaagtaatcgaacttcttataattcaaaaaagccgggaaaagcgaaagtttttcccggctttttttgaattaagtctaataaatcattattaacgttattttgcgtctttaagtattgatctttctctgcgtataatattgataattgagaaagtgggggctacctatgcatgaaaaaataattaatcgaataattgctctgcatcgttattcttttgttagaataactcggcagacattaattatgatttttcccattgtttttattggaacgatggcaaagatgattttgaaaactgtttttaaaccagatggatttatttataatattgcttttcttgatgtaataccacagaacgtgttgcggattattcaatttatgttaactagcattagtcaattaaccttagggattctaggaatttatactgtttatatggcagcaaaatttacggcgaaaaggtatcggcgagacggtaaatttgccggaataaccgctattttgacccttttactaatgtcttatcgttatggcaagtcgtccccgcaattttcccttagcttttatcaacggctcctcagtggcaatagtttgttaatcgttttaattcttggttacggaatcggccagctttaccggtggttaaccccgcccaaagatggtgataataccaatgcgttgccgttattacaggaacgatcatttagttcaatgctgccaatgacaattagtcttatttttggagtgacggttgctcttttcttaaattccaacacaatctatcatgcttggtcaacaagttactccacgttagttacgactgcccaagagcatcggcaattatggctgacgttattagctacaatggggctaacaatatttgattggttaggattaggtgttccatacacttcgatggcgttaacctctggagattcatttactgctaacttgaactatgcgctcgctcatggaactccgtggaatgtaccgtatgagtttttaggcagttctctttataattcatttgctaactttgggggcgatggattgatccttgccttgatagttgccattctgttaacttctaatggctcctatatgcattgtgttgcccagtggacggccttaccaacactatttaattttaattatgcggcaatgattggcttaccggttgtatttaatcccttatttctgatcccatttgtcttcttaccgattgtaaacattctccttgccagtttagcgattgcgattaacttaataccttcaacaccttacccggttttgcaggggacaccgggaccccttattagttttttggggacaaatggtaattggggaattttgatttttaccttggtattgcttttaatcgatagcgctgcctatatcccctttgtaaaactggccttagtcgttgaaaatcgcttaatattagcagaacaggacgtgatcagtcatgaaaaaaatgactaaatcaattctccacactcgtttagtattgattggcctaatattgatcttagtcctaatggcaattccagcatattattggatgaaagatacaaataaatatttagctgcccaacataattctagaatgtcgccgataattatggttcctggaagctcagcaacacaaaaccgctttaatccacttattcgtaaacttaacgaggatagccctaaaaaacatagtgtgttgcgcttagaagtaatgaacagcggtaaaattgtttcgcaaggatggataaatcgcggcgataacgagccgattatcgtgattggctttgagaataatcgcgatggctatcaaaatataaagaaacaagcgcaaatggttaataaagcctttgaacgattgacggaagagtataattttaataactttaaggcgtttggccattccaatgggggtctagtatggacttattggttggaacattactactctgaatataaagatgcgattacaattaaaaggctaatgatactgggaacgccatacaactttgcggagtcttctgttagccatccgacgcaaatgttttctgattttgtaaagtatcgaagtcgaattcctaaaaacttattagtttattcggtcgcagggacagaaacttatacatcggatggtctcgtcccagaaggaagcgtcgatgccggtaagtacatttatcaaaaacaagtggcccattatacgagtatgacggtcacgggaaaagatgctcaacactctaacttgccacaaaataaacagattgtacggttaattgaagagtatttgcttgatccaaatgacaacggtaatcctaattcgcaaaataagcagggggctactcaaaattaattaagcaggttatactaagttcataataaaaagtaaggagttcaatatcgtgaaaaaagataaaaagcgatcatttgaatggttatggtggacagcggttgttgtactgttattgatttcagttgtcttaatttttaaccaacagattaagtcttacttagtagggagttataaacctgagattactcggcaaacggttcaaagcaaccaaaagaaaaaagcgacctatgattttcaaagtgtcaaagatcttaacttgcaaacggctgccaaggctcgtgcaaataagcaatcgattaataccattggagcaattacggttccggctattaatatgacgattccaattgctaatgggattgataatacaacccttgcgttagcagcaggaacccttcgtccggacatgaagatgggggaaggtaactatgcgttagctggtcataatatggcccacgggagtaaaatcctattttccccattgtattatcatgctaaggtgggacagatgatttatatcaccaacatggatcgcgtttatgaatataagatttatcaacgtgaattcattgcggcgacccgggttgatgtggtagataatacaccggaaaagattattactttgatcacctgtgatgctaccgggaccaatcggttgatgatccgcggtaaatttgttaagtcagaaccatttacgcaagcaccacaaaatgtgcaaaagaattttagcgagaaatatacaacaggtcgttaaacaacctaagattagttcaggaagcgagacagaagtcacttgtgacttcgtttttcgacgcgaagcaagcctctgggagccctcgcaagcaacaataggcctccaatgttcggtttttaagccggacgttggaggccattgttgtactgcgtatttgctttttatgaaagtaacttaacttatatcaaagtccttttttgcttgcaaatttttagcaatatttgtaatccattccaaattaagaaaaacacaatgacgataaaaatagccaaattaaaataaattttaagtaaacagatgagcgaacggacaggaatgccaccgtttgctcatttttttgctgtaaataaatttcttgactcttttttaggaaccacctaagaaggagatacattgaatttaaggagatgcagtaatggaaaaacgcgaacaaatgaatgttttatggtttgatgaattgcatcgctcggacgttaatctcgttggtgggaagtcctcttcattaggggaaatgacttctgcaatgaaaattccagttccatatggatttgcgacgacaactcacgcttatcgtcaatttatggcggaaacgggattaaacgaccaaattaataaattattagccgaaattaatgactatgaaaatgctgacgaacttcatcgggtttgctcacatattcggcagatgattgtcgaagcaccgatgccaagtgagatcgctatgacaatcaaaaaagcttatgcagccttatcagaaaaaatgggtgaaactgaaccatttgtagcaattaggtcaagtgctaccgctgaagatttaccgaatgcttcttttgcggggcagcaagaatcgtatttgaacgtgcgtggagctgaaatggtattagcaaaggttcaagaatgttatgcttccttgtttaccgatcgggcaacctattaccggcataagcaacattttcctcatgaaaaagtggctttatctgcggccgttcagatgatggttttctcaaaagcttctggggttatgttttcagttaacgtggcgaacggaaatgatgcccaaattgttattgatacgatttggggattaggtgaatacattgttttaggaaaagtaacaccggatcattttgtgattaataaaaataaccttcaagtagtagaacgttcggtagttccgaaagcaattgaattgtgtcaaacccctggtggcggagtacatgaagaaccggtgccagcagaccgggcaatccggccagcgctaactgaaaaccaaattcatgaattagcaggatacgcaaaggaaattgaaaagcactatggttgttacatggacatggaatttgcgctagacgcccgcacagatcggttatggctagtacaagctcgtccagaaacggtttggtcgaataaaaataataagcaagcaacaaaggagtccactgtctcaatgaataaaactaaaaaaatcttggtcaaaggattaccagcaagtccaggcgtttccactggaaaggtacatgtaattgcggatcctaaagatattgatgaatttgaagaaggagaaatattagtaacgttgatgacttcgcctgattgggtaccggcaatgaaaaaagcagcagcaatcatcactgataatagtggaatgacctgccatgccgcaattgtttctcgtgaaatgcagattccgtgtatcgttggaaccaagagctgtgggcaggcagttactgaaatgctacaagatggtgaacaagtgaccattgatgctaaaaatggagtcgtttatcaaggtgatctcgcagaacaatttaatggcgaaaaagagacaacggaatgtcaccatgcagaatattacccgccgactgcaaccagggtcatgatgaatttaggcgatccagaactagcagaaaaatatgcagaactccctgttgatggcattggcttaatgcgagaagaatttctttggacgacttatattcatgaccatcccctctacttaattgaaactggtcatcccgaaaaagttgttgatatgttagcagatgggattgctaaagtggctcgggcgattgctccacggccgatggttttacgtttttctgattttaagtcgggagaataccgtaatttaacgggcggcgataaatatgagccccatgaacctgccgacttattgggatggcgcggcgcttctcggtactatgatcccaaatatatcgaagcttttaagctagaacttgcggcggtaaaaaaggtgcgtcgagaattccagttaaagaacctcaatgtaatgattccgtttgtccgcaccgttgccgaagctgataaagttacaaaattaatggcagctgccgggttacatcgtggtccagattttaaggtatacatgatggccgagatcccaagtaatatcatcttggcagatcagtttaataaatatgttgatggttattcgattgggtccaatgatttagcaatgcttattttaggttgtgatcggaataatgatacagtggcccacctctttgatgaacgtgatcttgcggtgaaacgtgcgattagccaccttattaaggctgctcaccaagataacaagacggtttcaatatgtgggcaagcaccatctgaatatcctgaattagcatctttcttaattcagcaagggattgattatatttcagttaatccagatatggttaaagaaaccaaacagaacgtggcaaggattgaacagcgcataatcctggataacgcgacgggtaagggacgacaagctgtggaaaattatgcatggtagaaaggattgaataaaatgcaaatttttgttgatattaatgcttctgaaaacggtaatggttcacaagagtttccgtttaagtacatccaacaagcggcagatatcgctcaaccgggggattatgttcaagtaatgccgggggaatatcatgaggaagtccatccacaatattccggcactagtgataagccgattatttatgtatctgctaagcaaaatcgggcaatcattacgggcgctgaccgtgttactggctggcaacatgttgctggtccggtatggcaattaaaactccctaatgccgaatttggtaactataatccatacaacgttttagttgatcaaacctttaatcatgccggtgaaatcttcctaaataataaagcaatgtatgaagttgatcagttagcaaaagttgaaacaccaagtgaaaacaaattttcccaagaccggaaatttacctgctatacctggtataccgaacagttgccagcagaagattcaaccgtaatctatgcaaactttcaagcgcaaaatcctaatgatgaatatgttgaactgactttccgtgagacgtgtttctatccagaaaaagcaggactcaatcaccttattctatcgggctttacaatgacgaaggctgcttgtcgatgggcatcttcgcaatataataaggggattattggtactaatcgtggtcagggatggaagattgccaagtgtgatatttctcacgctaagtgttctgggatctcccttggtcgaaatattgttccaaccattgacgatgataaggtttatccacaccggattaagaacaatacgattcatgattgcgggcagactggaattatcggtgttgaaggcaacccatcgccgattattgaacacaatagtatttacaacattaacgtccgccaaaaccttgtcagtgatgatgtcagtgcgatcaacctttcgccagcgattggggctaagattttacgcaactgcattcatgattgcacgcgcggaatttggcttggtggcaaggttgaagatacccaaatttcacggaatgtgttctacaacaattcactgccagattcatttgaagtcacaaacgaaaatcgggaggacttagtagcggcccttggtgaagatattgaaattaaggattcgatgggtgtgaccttgattgataacaatttcctattatcggattatgcgcttaagctcgaatctaagggcgtccttctcgttcataacctaattaatggcagtgtggaatggttaagcaatacgaatgttgctgaaaatgatccttactaccaccgcctttatcaacaaaatgcgccagaaagtgctccttacgattcttcttgtttctataacaatgtctttatccggaagaacctccggagtgaaatggcaaaattaattgcatttgcccacaaacaggcaagtgaacaaccaatcgataatcatattagcgatgataatgctgcttatgttggcctagccagtggacaacgaagctatattccagctaataaagcaggaaatatctttatgaatgatgagcaagaagacgttaaggtcgccatcgattcaagtgaagatggggtatttcttaatagtaatatttgcgactacttgaatgaagatactagtcgggtgatcgcggttggtgttactcccgagactgcccgtgattttgatacagatttcttagggaaacatcgtgaaggaattagtgtaaccgctggaccttttgatacgaaagaagaatatagtcaacgcttatttagactactgttttaaggaggtaaaggaatgcgcaaaccgtttattattgcgaactggaaaatgaataaaaatgttcatgaatccgttgcgtttgttaaagcaattaaagaaaaactcccggcaaataaagaaattgggatcgcggcacaagcagtctcgctctataacatgaaaaaagtggcgggatcttccaacttacaaattattgctcaaaatgcatctgctgagttagagggaccgtatactggagaaattagcatgcgaagtttagcagatgcgggcgtaacatacgtgatgctagggcatttagagcgccggcgcctttttaacgagaataatgaatcaattaatcaaaaagttttagcagccctcaatgctggtattattccaatcatttgtacggatgaagagatggtccaaacagaagttaacggacaaattcattatgtatttcgccaactaaaaagcgtccttaaaggggtaccagctaataaactatcacagattgttatttcgtatgaaccaagttgggccgttgggagcacgcatcaagcaaatccagacattgcggaagagggatgtcaggcaattcgtcaaagtctagttgaaatgtatggtaatgagattggcgagcaagtccgaatactctatggtggcagtgttaatcccgagaatattggtcaaattatgagtaaaccaaatgttgatggggcgctaatcggtcgcgcaagtctcgagattgaaagcttcttacaaatgattaattatatcgaattagcgagcaagcagaagttacaggtaatttaggaggaagaatgatggcttactttgataacggaaacaaactttttgatgatgcacggaagaatcaatacgcaattggggcatataatattaataatcttgaatggacccgggcaattttgcgggcggcagcggagactaatactccagtgctgatccaagtttcaatgggagctgccaaatatatgggtggttataaatttgtcaaagatatggttgaagaccagatggatgcaatggaaattaaagttccagttatcctgaatcttgatcatggtgactatgatgcagcgattgaatgcattaacttagggtattcgtcagtcatgtttgatggccataagttgccgattgaagaaaattacgccaaaaccaaagagattgtccaattagcgcattcacgcggcattgcggttgaagccgaaatcggtaaagtgggagaaaatcaggataccagcagtggagaacttgctgatgttgaagatgcaatggcgtttgcagcaatgggggttgaccgtcttgcttgtgggattggtaacattcacggcatttaccctgctaactggccagggttagactttgaccgccttcaagaaattgcgaatgcgattgatattccgctagtgcttcacggtggttcaggaattcctagagaacaggttcaaaaagcaatttcaatggggattgcaaaggtgaatatcaatactgaattccagttagcgttccaagatgcaacccggaagtatattgaaaatgaattagacctcaataaagaacaaaaaggatatgatccgcggaaattattacttcccggaacagatgcaataactgctaaaatgaaagatatgattgaatggttaggcacgccagcagtcgcctaattataatggaggttatcgaatggcaatcacagtttactttgtccggcacggtgagacctacttcaaccggtttgctcgcctgcaaggatggtcagataccccgcttacagaaaaaggagagatggatgctaaaaagatcggccaagttttagcggacttaaggatcgattaccttttctccagtgatttaaaacgagcagttgatactgcacggcttttaattgcggatcacctaactgcgacggtgaaggaaccaatccaaaaaaagttcttccgcgaggtattttatgggtcttttgaaggtcatagtaatgaagaaggcgctatctgggcaagctatcttgaaggcaagcgatttaggcgtatcggtgaattagttgatgagtttggcgttgaaaaagcgcatgacttactgaaagccgccgatccggctcaccttgcagaagatagtaatgaattaaatgcccgtgtagagcaggcaattgcctttttgcaaagcttaccggatgagagtaatgtggttgtagtagcccatggatcgattatccaatatattgcggggatgtatgggaaacctggatacaagtatgaaaacttacataacggcgcgctgatgaaggttcagctaacagctagagacgttgaaattactggatacaatcaatttaaactataaaaagaggcaaggaattattttccaaacctcttttgttgttaggacaattctttagtaattttatccagccataatggcaatgtctcgtttaggctattgtaagtatcttcaaagcggtgagtataccaaggatcaggaatttcttgatcttctttgccaggaattacttcatatgctaagtggactttatcacgatcttgcgctggtgcaatgcgttgtaagttgtacttgttcatattatccatgcagatgatgtaatcagcccactcgaagtcttgtcgtgtaattggacgtgagattaagccatccgttgataacccgtgtgcgtgcattgtctttgcggcacctgggtggggaccatttccttcttcttcgttacttgttccagcagaatcaacattgattttgccatttaatcctgcgtcatcaaccatttgcttgaacattgcctcggccattggtgaccgacaaatgtttcctaagcagacaaataaaacgttcatgtaatcacctcgtttatacttctatcataccgaaaaagataatattttgctaaaatattcgggaatcctaacactatccttaagtttttggtaaaattaagaacaaatatttttagaggaggaacaaaaatgacccttattattgtaattgttgtcattgtcttgttgattgctatttatgcaggactttacaacagtttgattcaattgcggacacacgcacaagaatcctggagtcaaattgatgttcaattacaacgacgtaacgacttgatccctaacttaatttcaacagttaagggctatagcaagtatgaagcgggaaccttggaaaaggtgacaaagctgcggacggaattaaatagtattccagacagcgatcatgctaaaaaaatggaagtttccaatgaattaacgggaactttacggacattgtttgccgtcgctgaaaattatccagacttaaaagcaagtgctgaataccaaaaattaatggaagaattaaccaatactgaaaacaagattgcctactcacggcagctttacaacagtactgtggcggctttagatgctaagattcaatctttcccaagcaatattgtggctaaaattcatcacttccaacaaatggattacttacaagtgccagaagaagtcaaggctgtgccaaaagtttcatttgatgatttaggtgattaagcatgttatatcagcaaattgcccgtaataaacgaaaaacaattttggtgatgtttgggttctttgtattgcttgctttaattggggccgcgattggctatttatttgcgcggacagcgattggcggcatgatcattgcggcgattattgcggtgatctatatgtccgtgatcattggtcaatcgactgatgtagtgatgcggatgaataacgcgacggaggtacgatcagcgagtgatgcgccagaactttggcatattgttgaagatatggctttagttgcacgggtaccaatgccgaaagtctatatcatccatgacccaagtcccaatgcttttgcgactggtaatgatcctgagcatgctgctgtggccgctactactggtttgatggaaaaaatgaatcgtgaggaactagaaggggtaatggcccatgaaatgactcacgttcgtaactatgacatccgtctgcaaacaattgcgttagccttagcatccgcaatcgcaatgcttgttaattttgctggaaatttctggtggattggtggtcggagcagtagtgatgaccgggataatccatcaagtattttcgccatccttggttcgattcttttgattatcttagcgccattggcagcaaccattgcgcagatggctctttcacgtaatcgggaatacttagccgatgcaggtgctgtggaattaacccgtaatccgcaagggatgattagtgcattggaaaagctaaaaactgctgttccaatgaaacatgtggacccaagcagttcggcattatatattagcgatccagaaaagaacgctaagcaccatcctttttcaaatctatttgacactcacccccgctagataagcgaattgaacggttgcgtcaaatgtaataagtttatagcaaagactgagaaaaaacttttgctttttctcagtctttgctatttttactcacgacttattgtttttaatcgccttatactagtgagggtgatataattaaaaagctagaccaaagtatcaaaagaagaggtatctttttcatgaaaatgaaattagcggaaattgccaaggcgatcaacgcacaaaatgacattgaacaatggaaagacgtagaagtgactagtgtgtcatttgacagtcgacacttagatcaagggagcttatttgttccattgcaaggtgcccaagacggccaccaatacgtaccgagtgcttttaccaatggtgcagtagctagtttatgggctagtgaccatgagataacggatcagacgcacccgctattagtcgttagtgatccactagcggcccttcaacaactagggaagtactacttgcataagatcaatccgattgttgttgcagttacaggcagtaatgggaagacgacgactaaagatatgattgcgtcaatcttaagtacgcagtttaatgtcgcgaagacatatgctaattttaataatgagattggggttccagtaacgcttcttaacatggagtctaataccgaagcagtggtagttgagatgggcatggaccgttttggtcagcttgacttcttaagtaagcttgtaaatcctgacattgccgttattacaatgattggggaagcacatatcgaattcttcgggactcgtgataagattgctgatgcaaagatggaaattacccatggcctaaaggaagatggaacactagtatttaatggggatgaaccattattagaggaacgggtaaaagatcttgcccaacgacagatgcgctttggtcggcaactaagcaataatttgtatgcaacaagtgtccacgatgaaccacggcagttatcatttaccgtcaacgaatggccagatgaagaattcactatcccaatggttggtgaatacaatattaataatgcgttagcggctatggaagtgggtaagattctgcatattactcccgcccacatgaagcaagcgttggcaaacgttgaattaacggaaaatcgtgctgaatgggttaaaggaaagaatggtgaacagatcttaagtgatgtttacaattcaaacccgaccgctgccaaggaagtccttaagacgattgcagaaacaccagtagctggtcgccggatcgccgtattaggggacatgctggaattaggggatgctgcggcaaagttgcatgctagcttagcagaagagattgaccaccaaaagattgctagtgtttaccttgtaggcgaacaaatgaaaaatcttaaagacaagttgatccaagaaggatacccagctgaagatatctatcattatgctgctagtgaccttcaacaattaattgccgatcttacgactactttgacaggtgatgatattgtcctattgaaggcaagccatggcattcacctagaagaagtcttgacggcattaaaagcagaatagttaatatatttgccagtcgattactgatgcttatatcataaatcgactggtcatttttaggaggaaaatttttgaagtttagtgaattaggcttatccgatagcctattaaaagcaatcaaacggagcggatacgaagaagcaacaccaatccaagaacaaacgattccaatggttcttgaaggtaaggatgttattgggcaagcacaaacagggactggtaagacggctgcttttggattgccaattattgaaaacgttgatactgaaaatctcaatattcaagcaattatcatttcaccaacacgtgaattagcaatccagactcaagaagaactttatcgtcttggtaaagataaacatgttcgcgtgcaagtagtatatggtggggcagatattcggcgccaaattaagagcttgaaacaacacccacaaattctcgtggggacccctggacggttacgtgaccatattaaccgtcatacagttaaacttgaccacattaagacccttgtcctcgatgaagcagatgaaatgctaaacatgggattcttagaggatattgaatcaatcatcaaggaaacaccagatgatcggcaaacattgctcttctcagcaaccatgccaccagaaatcaagcggattggagttcaatttatgtctgatccggaaactgtgcggatcaaggccaaagaattgactactgacttagttgatcagtactatattcgcgcgcgtgactatgaaaagtttgacatcatgacccgtttaattgacgttcaagatcctgacttaacaattgtctttggtcggacaaagcggcgggtagatgaattgtcgaagggcttgattgcgcgtggctacaatgcagctggtattcatggtgaccttactcaagataagcgttctaagatcatgtggaagtttaagaacaatgaacttgatatcttagttgcaacagatgtggctgctcggggcttagacatttccggggttacgcatgtttataattatgatattccatctgacccagacagctatgttcaccggattggccgaacaggacgggccggacatcacggggtatccttaacctttgttaccccaaatgagatggattaccttcatgagattgaaaaattaacccgggtacggatgctgccacttaagccaccaacagctgaagaagcatttaagggtcaagttgcctcagcctttaatgatatcgatgaattaatcgcgcaggattcaactgatcgttatgaagaagccgctgaaaagctactagaaactcataatgcaactgatctggtagcagcattgttaaataacatgacgaaggaagcggccagtgaagttccagttaagattactcctgaacgtcctctcccacggcgtaacaagcggaataaccgtaatggcaaccgaaataattcgcatggtggcaaccactaccggcgtaagaatttccgccgtcaccaacatggtggtggtcaccgaaatgataaccatggaaagagccattccagtcgccatgcatttaatatccgtcatcgaaaagaagattaattagctaagaagtctttggttgagatttgaccaaggactttttttaatttggcagattgcaagaaataatttgaacaaagttagtgacgcagattacgcaaaaagatctcaatcggttgacctttggggataaagcgtcgtagtactcggttgcgattctcattactgccccgttcatgtggagaataagcatgcgcaaagtagaggggaatcctggcctgctcttcaattagcttgtagttagcgaattctttcccatggtcaacagtaagggtcttgagattatcttctaactggttagctaattctaaaatggccttggtcattgaggtactatctcgtccctgaagccgtttaacgatgataagacgactcttacgctcgacaaacgtagctattgcttgacctttacgctttccagataaaactgtatccgcttcaaagcgacctgaggtatgacggtcaataacttcagcaggacgatcttcaatggaacgtccatggctaaaagtcccacggggttctttggctcgtcggcggcgaattccatggtcaggtaaatcagccacgtcaatatccaatactccttgatcaatccagttgtagatggtcttgtaggcgattctaactacatgagccacttgttcaatcgaccatttttggatcttaatcttttcttcaattaatcgcttgaggttagtcgttaagatggttttacgcccacgatgactaagtttagcttcatgatcagcttgagctttaactgcgtgatattcaccagtcaaacgatgaacctcattaaagatcgtggttttaccgaagccaaggtaatcagcgatgtatttaagggagcggttttcataacgaagagtttcgatgacaacacggtcttcaaatgataaaatagtggtgcccataaaggtccttctttctaatggaatgttgtggtaacaccattaaagacctttatgggtttttatgtccactaatatgttcaacttaaattttgcaatctaccataaattaaatatgggtttgtgacttaagttaagttacttccataaaagacaaatggcgcagtacaacaatggcctccaacgcccggtaaaaccgaacgttggaggcctactgttgcttgcgggggctcgaaaacgaagtcacgagtgacttctgtctcgctcccatttcgttatcttttttataaaaatatttattctaattatttgatttatttataatatatttgttgcgactattacgatgattagtatctgagaagatgagctcatgtagatattaggctattatttcatcatgcaaattaagtgtaaaggggggctaatttttcttgtttggtacttgaggagctgcagagttatttatgccttgtgtgagagaggttttgacgatgcaaaaattagagcaattgattgataaaaactttgctgaaacagctcatggtaaggttgcaaactatattccgatattaggaattgttgatccgcaacaactgggcattgccatttatgacgttgacgaggacgaaattgggaccgctggaatggcaggaacgagatttgcgatcgagagtattgcgaaggtcataactttaatattaacgatcaagagattaggacataagcgcgtcttagcagaactagaaaatggttcggcagattatagcctaagttcggtactattggatgacgagttaaccgagcaggtccatcggataaattaccttaataattcctccgccttgttaacgacagccttaattgaccagttgatggggcagaatagttttaatgcccttctcgggttctgccgtgagatctgcaatgacccatgcattagcttgaatgagcgtttatttcggtcagtaattatgaatgataaagatattcatgcactggcttactatatgaaagataaggatattttagagactgttgatcaaacattgataacttattttatgcaaagctcaatgatggtgacatcacagagtcttgctaacttaggagcagtcttggcaaatgatggaattaaaccttgggataatgagcgtcttattagccatgaagataacgagttggtaaagaaattgctaacaacagttagctcgtttgaagaatcaaaagaatacacaattaaaattgaactccctattaaaagtggtactggcggcggcttattggcttgtgccccgcaaaaatgtggtattggtatttttttagtccagctcttgatcaacatggcaatagtttggcaggaatgagtttattacaagatgttgttgagcaattagtagtttaataaaagcgaggcccgaagaaaattcttcaagtctcgctttttgttaatgtaatttttcttggaatttctgtaaattaccaggagttggggttaagttagtccattctggtgaaaggaacttactattgatttggtaatgtggttgcggttgcttattagaaataaaactattagtagctttatcaacttttacccaaccagcccaaccgatatggatagtgtcttccataaatccaggcttatcaccatcatgagaaagatcaaaaatatgattgaacccttgttggcgaagctggaatttaatttttttaacagattggtaatacatattcatgtccatccccgtgtacttttcccactttgaattaaccggtgggatgataaagaggacatttgaattggtattcttaaactgattcaaaactacttccaaatcgccatattctggtgacttagtataattgaaatttcgttgtgatccctttgttttcgctaagtttttctttacacgctgggtatagaagctgtttttgataccgaaacggttgttatcagtatcacgtgcggcttcattcattgcatcatcataaagttcattataattgtaatgctgaggaagcttcttaacatttgggaggatatgcttgccatagttattatttaattgaaaacctgagaagatggcatcttcatgaacaagcatgttaagtcggaagcggataactcccatgtcgaaactgctcagggattttccttcagcgatttttttagcatacgaagaaacagtcccatctttgccaagcattgcaattaatcgcgttgcaatgtaacgatcatatggtgatttaggattagcgtgttgaagccagttaaggttagcgagttcaccattatagtacttgaaagctggtggttgaacaccctgcttggtaaaccattgtggtgaaatgatatagactgccttattatttctcatctgcgtttccattgaattaatgttaaagaattgcggaagagattgggtaccccgtgaaccaaagaggaaaggagtatagttatgataacgagcagccattacagaaggatggaagcgatccattcgccgtaattcactagaaccaaagaatggaacatagtgagtgtgcttatcactgagcgcttgttgcttaattgattggttcttaaaaacaacggggcttagtgatactgcagctttatgttcaatcgccgctgagtgctttttactaatcggcagtgaaaacaaaagaactactaatagacaagcgacaatcagcgggccaaagattgaccacagctttttgccattatgcattttggagctcctttacccgttcttcaatcttttcaatagtgtcccattggctacggtcaaattctgaaactggtacttgaacgccaaaagcatcttgtaaaccgagaagaagactaacagttgccattgagtctaaaagaccactttcaaaaaggttttgacttgcatcactaaagtctgcagtatcccgaccagttgcatcagctaaaatattaataatttgttcttgcataattaaaatcctcctaaaattatttgaatagataagtatctaagaacccactgaagatcaagaaagtaaacattacaaagttaaatgtgacaaaaatagcaactccagtagtgaacttattatgtggtagctgttttaagtttttgcgcttgaaacgcagccaccagtcattaactactaggcctagaccttggagaaaaccatagagaatatagtaccaggtaattccatgccaaaagcccattagtaacatattaagcatatatgcggttgatgacaaggcatttcgattcttaaaccatcgttttttggtagcaagaaagacgaaccgcataaaaatataatcacggaaccagaaagaaaggctaatgtgccaacgattccagaactctttaaggtttttcgatttgaaaggctgcttaaagttcatcggggtacgcacacccataaagtaactaatagcaactgcaaataatgaataaccggcaaagtcaaagaataagtaaagtccgtaagtgtacatgacaccgactaagttccaagaagggaatgatggatcagccaaggccgctttttcaaagaaggggtaaaaacgctgaccaaagaaataaccgatgacaaacttgtacaagaacccaaggaataagtagaaaattcccgtattaacaagattcaaatattcctcgcgggtcggaacctttttataatctttttcaaaacgtcggtaacgatcaattggtccagaagtaatggttggcatgaacagaatgaaacgaatgaacttccatggggaaatctctttgatcattccatcacgcgtttcaattactgttccgactgcccggaaagttaaataactaattcctaagaaaccaaggagggagttatgaccaaccattgccggtgagagcttaacaattacaatcggcaaaattgataaggcggcagtgaagtaaaaaacaccactcgaattattattttgccggtagcgatgataagccatcacaataattgtctggtaaataacataagtaattaatgaaattccttgttgccagcttgaaccatcgaacattaagaagataaaaatgaaactaattaatgcttcataccagttaaacctcttcccaaagtaaaggccgattcccaacggcaaaatagcaagaagtaagtagaagaagtataccggggttccataagcactgaaattaggaaggtttgaaatccaatcaatcattacttgttagcctcagcaatcatttgtttaactgcaatcttgccatttgcagacattgggaatgattcacggtaaacgaattgggtaggcatcatgtatggcatgattaagccgtccaagctttcacgaatttgttttgttaatccagccgtatcttcagtagattcgtttggaataacataagcgatcaggtgcgtaactttgccgtctttattatattttggaaccgcaactgcttgtttgattagaggactcttttcaagactggcacgaacttcatcaagttcaatccggtaaccatgtaatttaatttggaaatccatgcggcctttgtgatgaagtaagccatcgctgtcaagggtacccgcatccccagttcggtaagcaggcacaccatcaatcttaaagaatgacttggctgttttttctggattattcatatagccacgtgccacactattaccactgattacaatctcaccttgttcaccgggagtagtgatttcttgatcgccattccaaatggataatttaactccaggctttgcatagccaactggtaagcggtcattattttcaatgatttcaggagtaatctcgattcctgatacggcaaccgttgtttcagtcggaccataagtgttgaagattttagcatctgggaatcgttggtgtaatcctttggcagtctttactgttaattcttcgccacagaagagaaaggtctttaagcttggcattttttgttggttaaatgctgggctaagcattaacatatcagcaaacgatggtgtccctacaaatacctcaagatcaaggtttggtagagcagtgaacatctgaccaaaattttcaacaacttcgtgaggaagcgccttgattgtcccaccattaagtagtgctggtaaccagtacatgtttgaaagatcaaatgaatatggtggctgccctaagaaattagcatgttctttgattttaaattcatcacttagcatccagtcaacaaaggtcataaagttatcatgactaacttcaaccccttttggtgaaccggtagttccagacgtaaagaggacataagctagttcgtcaccattaatcattgctgaagtatcaaaagtttgcggtgttgccaaaattttttcaagctgttgatgatcgacaatcggggcatcaaactggagatcattgcttggaaaatcattaacagcaataatcatcgccggtttagcagtatccagaattgattgcatccgtggaattgctgaatcgttggacactggaatataagtatgtccagcttttagagccgctaaaaagctaataatcatttcaacttgatgatcaccatatacgagaatcggactacgatcaggcaaagattgagtactaagccatgccgctaaagtatcaactgctgagcttaagtccgcataagtggtcgttttgcccatttcatcatatgcgatccgcgttgagttgtccttggcaatttgctcaaagacggtaataatattcttactcatatattatctatttcctccgcattagaattcgttgtagataaatggctcttggcctgctccataataaccataaaggtagattaataaaagaagcactacaaagtaaaataatgtttttaagatgaattgtaatgcaggatggcgttgaataatctgagccatagttctccttctctcatctttataaatttgtaattgacattcatatcaagaataccattaattatgtatctcggctaatagggtgagttactttcaccttactgtaaagtctttaagaaaaaattaatgaaatgttcagaaataagaatgcttattgccttaaaattataactttttctgagctaattgtaactagaaaaatataaactttatttataattttatatgacatgacaatgatggactaatgtaacaataattgcaagaagtgcttattttcgataagattaagcggtagataatagtgataattaaggagacgaacgctcgatgattaaggggattggaatcgatataaccgagattgaacgagttaagaaagctgcgacagcgcattctcaattcatccagcatgtattgacaccgactgaactagaacaatatagtcaatttagcggtcaacgatcagtagaatatcttgctggtcggtggtcactaaaagaatcttttgctaaagcatatggaacgggaattggtgctaaactaggctttcatgatattgaaatcattgataaccaatatggtgcgccaattgtgattaaatcgccgtataatggtaatgctcatgcttcagtgagtcatactgccgcgttagtaatgacagaagtaattttagaaagtgagaataaataaatggttaatggtcgtttgcgagatacatcattaatagtggacttagatgcattacgtcataatattcaagaacagaaaaaagttttgcccaaaaatagtagaatccttgctgttgtaaaagcaaatgcttatggcaatggattgattccagttgcccaaacagcaatgaccagtggtgcaagtggtttatgcgtagcaattttagacgaagcattggaattgcgggataacggtattgaagccatgacacttgtccttggaattacgccagttgaagatgcgttgattgctgctcaagccggagtttctttaacagtcggctccttagattggcttgaacaatatcatcaactagcacaagttgccaagcctaagaaaccattaaaagttcatctgggaattgattcaggaatgggccggattggttttacagaggtcgctacatttaagcaagctgttaagttgcttgatagtcctgaatttgaatttgaagggatgttcacgcattttgcaactgctgatagtcctgatgaaaattactttaatcaacaggttcaacggtggcatcaatttgttgccagtcttgacgaactgccaccatatgttcatatggcaaattcagcgactggtttatggcatcgggaaaaaatcacggctaatacagttagaatggggatttcaatgtacggacaaaacccatctggacgtgacttgaaattaacgcttgatttacagcccgttagttcattagtttcatcaatttcttttgttaagcagttaaaggcaggaagatctgtcagctatggtgctacttatacagcggagcaagatgaatggctagccactttgccgattggttatgctgacggttatccccggtgtatgactggttataaggtattagttgacggtcaattttgtgatattgccggacgagtatgtatggatcaaatgatgattcggcttcctaagtattacccagtcggcactccagtagtattgatgggcaaatccggtgaccaagaaattacagcaactgatttagctgagcaggccggaactattaactatgaaatcctaactaatattagtaatcgggttcatcgcatttatcaccaaagtaaataattaagggaagcgaaggtaatgacaaaacgaaaagtaaaacggggtgacatctattacgctgacttatccccggtaattggatcggaacaggggggcgttcgtccagtcctgatccttcaaaatgacgtgggaaatcattatagtccaacagtgatcattgctgcgattactgcccaaatgcaaaaaaagaagatgcctactcatgtccaactaaaaggtaagtcgttaccgttaactcatgattcggtcattttattggagcaattacgaacgattgataaacaacgattaaaagaccgaattgctcatttgtcgccagagacaatggcaaaagtggataaagcattaacgattagtgtgggattaagtgctgcctatgatgaaaataaatgagtttgacaatttgcgtcagaactcgtatactcactattgaattaatcacggttcttttaatgtagcccagagagactacaaaagacaaaataatataagcatagtgggcacaaaactatgcttcctcttttgtaaagctctaggaccattaaagggactagagctttttaggtctaaggaggatatcttgtgaaagagcaaaaggggacaacaatttttagtattccaatgaagaacagaaagactaatacttgggatatgtttgccacgtgggtcggtgcaaatgccaataatggaacctggtttgttggcggagtgctcgccgcttgtggattttcggttgccatgaaggtcttagtattgtcatctgccttatcatatgtatttttaagtttggtaggttacattggttataagactggggtatcgacgatgactttaagtcgtgcctcctttggtgaacggggcagttatctcccatcattagttaatattactcaatttattggttggacagcagttaatacttttattgcggcccagtcggtaagcattcttttccatgacttattaggatggcctgtgtggggacaacatggcggctatttagggctagtagtcgggattattatcatgagcattctccatattattagtgtttctagcggatcacgttcagtccaaatgattgagcggttagggataatccttgttcttgtattcgtcatttgggagtcagtagctgtttttcgaaccgtttccttcagtcaaattgtaaattggcatgttcctgcgcaatcaaaaatggcagtcggtgcggcggtcgattatgtagcagcttttaatttagcctgggtaactgccggtgctgatttcacccgctttactgctaaagaaaagaatgcgactttgacgccgttccttggtgctttactaggggttgtatggtttgctttcatcggtctgatttcaacaattagtattgcaatttcaagtggggtatataacgcaaataactctgatccctcaacgattgctagtaagttaggactgggggtagttgcccttcttgttattattttgacctcaatgacggcaaatgctgttaatttattagcggccggatcagctctttcaaatatctttacaaagctcaaattaaagtattcattatggatcgtcgtattgcttgcgacagttgtgacctttattccgatgtttgtcggtagtttcttgagtgcttttgaatcattccttgactatgtggggatggtgttaggacctacgatcgccattatttgtactgatttttatttccgtgctcaccggcaatatgatgttgatgaattaggtaaaattggtggaaaatattggtatcgtggaggcgtcaactgggtagcgattattgtttttgctatcggggttgccttcttcttaggtgttcatcagttaccaatcttcgtaaatacgattggggccacatttattgatatgtgtttgagtggtatcctatattatggaattatgttgctggttgaccgaaaggaagatgaattatgctattaaaaaatgtacatgttgataatcatgaagaagtagtcgatgttcgaattctcaatggaaaatttagtgagattaaggctaacttaacgccccatgacggtgaagaagttattgacggtaaagaaaatttacttttgccaccatttgttgattctcatgttcacttagatgctacgcttactgctggtcagccagaatggaatgaaaccgggactttatttgatggtatccggatttggagtgaacggaaacaagatttaacgaaggaagatgttaaatcgcgcgcgaaaaagacattactgaatatggttggtcatggaattcaacacgtacggagccatgttgatgtaactgatcctcatttaattgccgcccgtgctcttcttgaattgcgtgaagaattaaaagaccagatcgacttgcagttggttgcttttccgcaagaaggtattcttagctatcctcatggacgtgaattaatggagcaggcggttaaagaaggattagatgtcgttggtggtattccccattttgaatttacaactgaatatggttggcaatccgtccatttcttaatggccctcgcagataagtacgatcgtttagttgacgttcactgtgatgaaatcgatgacccagcttcgcgtaaccttgaagttttagcgaccgaagcctatgaacgagggatgaaagaccgggtcactgctagtcatacgacagcgatgggctcatataatgatgcttatacttataagttattccgactattaaagatgagtgatattaactttgtatctaatccattagttaatgttcaccttggcggccgtttcgatacttatccaaagcgtcgtggcgttacccggattaaggaattaacagcagcggggattaatgtttcctttggtgaggatgatatccaagacccgtggaatcctctcggcgatggtaacatgttagatgcagttacgatgggtgtttatattgctcacttgatggggtatcaccaactgcaagatgcctttaattatgtaacttataacggtgctaagacattgcatattagtgataattatggaattgaagtaggaaaaccggcaaactgtatcttattgaatgctcacgacttttataatgcccttaataagcatgttgaagttctttataatattcgtcatgggaaagtccttgctgagacgaaaccagctgaaaccaaagttaatataaaataaaattaaagaaatctcataatagttattgacaagttagggaatggccggtatattatatccagcaattaaatttagattagaaaagcgttgaaggaaataatgatttgaaattggtaacagagaattagcgggtggtgtgagctgatcgagatttctaattgttaatcgttcctgagttaccggctgaaaccaagtaagctgaggttggctgccatccattattttggccacaaatgattgtttgtgaatgagaggatcgactacgagttgatcaaagtaggatggtaccgcgcagaagcgttcttacaattgcgataaagcaatgtaaggacgcttttttctttctaaattttaagaaaatattttgtcttggaggtaattattatgactgaattaaacgcacgacaggaagaatttgctaaggctctttttgaagcttatgacactaatacgccgttaaaagaggaagaatggaaagacgttgtgactgatgatgaaacagcatatgcagttcaagatgcggtagtaaagttaaaagggaagccaactgctggctataaagtttcgttaactagtaaagaaactcaagacatgtttgatgctgattcaccattgtatggacaacaagttgctgaacgattcctccagtcaccggcggatgttgacttgcagatgttaaatgaaccgttattagaggttgaattaaccttccgcgcaaaagaagacttacaacctagtgatacattagaagatttatttcagaaagtaactgttgcgggagccttagaattgcctgatgcccgtttcgtcgattggtttccagatttaggaaaatataatgtaatggctgattgtgctgttggtggtcttgttgtatatggtgaagaacatgatgcagatagcgtatttgaaaatgttgacgatgctgctaatgttcatgccgttttattcaaagatggtaagaaattaaaagaaggggtatcatcagaagttttaggcaatccctttaagtccctccaatggttagtacaaaaattagctgaacaaggaaaagcatttaccaagggtcaaatggtatcatccggaacatttgtcttaccacctaagctcactgctggtaagtgggaagttgagttcgatagcggtttaggaaacgttgtagttaatgcgaaataagcgttgaaagcaggtgggaaaattgggtgagaaatcgccagcagaaattaatattctaaaaattaaaaggggctgggagaaaacttttgttttctctcagcctcaaccgcttttataaacaatagtaagataacgtggaaaataaccacaaggctcgaggctaagtacgaacgataatcagcccgtgccgtgctaatcatcgttctagcttagccaaccgccttgtcgagagggttatttcccactctccttaatatttaatagctttggtgcaagtcttcaatttctgaaacttctaacccttttttctcgagtcgtttaacaatccgttccatcttttctttagtaacatcagcaggcaaggtgtataagacccgtttcattgtttcgtcttctggatcgagtgaaatgacatttacgatctgacaaaaacgagtgatttctttagcagccgttactagcgctccccgttcatcaggagtaataacagttaaaacataactcccattattcacgttccagccagcagctaacatccgtaaaagactattatgggttaaaatcccataaaactgattattgttatccaataccgcaatatatggaaggtctcgaatagcaaagaagatagagaagaaagccgcgttaattgagataaatttagtagcattctttaataatgcagttaccggtaaatgcatatccccctgtcgtgctttatgccggtaaagatgcatcttataaatatttccccgaaagatctttcctgacttatcaagaactgggacacaccgatagccggtatcctccaagacagtcagagcctcatccaatgtcgctgtttctggaagagttgttaaggttgctttgggtttgattaatgaattgaaaatcataattaacatcctttttatcgattaaatgcactcactataataacacatttctatcaaaaggattagaaaaagattagaagatttatgctgttaattcaaattagtatgctgaaaaaagtaacatagggtataatactagttaaaatttatgctggacgggaaaagtgaccgtgcggcttttttgcgtgaaaggaatgaaagaacaatgaaaatgattgttggcttaggaaatattgggacgcggtatgatgaaacccgtcataatactggctttatggtggttgatcaactagcacgagattatcacctgggagcattcacccacctaaaacaagaagcagtcgcagttagtgggataattaatggtgaaaaagtaatgttggtaaagccgacgacgttcatgaatgattcaggacgagcagtcggaccactagtagactattatgatattgacttggataatctcgtaattgttaatgacgacttggatatgccagttggcaaagtacgtttaaaaacacatggggcttcaggcggtcataatggacttaaaagcattatcagcgcgttaggaaccaagaactttaaccgggtaaaagtagggattgaccatccccaacatggaacggtggttagtcatgtcttaggtaaattttctaaagaagaacgtcctaaatttgaccaagcagttgaacaagctgagcatgcattagaagactggattaatggagaagactttgccaaattaatgaatgcttataattaaaatagaaaggtggcgttgatggtgcaaatagaaaatttaatcgagaagacgccatcatttaaacaaattacggctgacctccaacccaagaaccatcaattaataacggggatttctggatcagcgcgaaccgaattactaagtgctctttctaaagaagggcagcgaccaattctagtagtgaccgacacgatttcccatatgcaggaattggctagtgacttggagaaccttcttcctgctaatcgtgtttaccagtttccggttgaagaggttttagcagcggaagtagcaactagttctcctaactatcgtcttcagcgggtactggccttaaatgcgttgattaataaagaaccggcagttgtagttgcatctgctgcggggttacgacgcaatattatttcaccagaatactttgcccagtcctcgttaaagattaagactggcggggaagtggatccagcaaaaattcggcaacaattaagcgcaatggggtatcaatatcaaaaaatggttttgcgtcctggtgattttgcaattcgtgggtcgattattgatatctacgccttaaacactgataatccgattagaattgatctttttgatacagaagttgattcacttcggtattttgatgctagtactcagcggagtattgataatgttgaagaagttcagatactgccagcgacagattttattatcccatcgactgaattttcgcgggtgtatgaagcgctagatactgaatataaaaaggtggggaaggagttaagtgctgacgatgcggatattaaacagcaggtggctaaccgctttgaaccattattgaacgcacttaagaaccagcacttgcctaatgaacttttagaatttagcaacctggtttatccggctaagcattccttatttgattatcttcctgatgatgggacaatttactttgatgacttgacgcggataaagcaatttgccaagcagatgacccaggaagatgcaggctggtttaaagataaggttgctcaccatcaattaacggatgttccagatcttagcaatgacgtatcggccataataaaaaaagacccgcatccgcaaatttatggcgccttatttaaaaaaggtctcggtaatattaaacttagccaaattaccgacctaaaaagcagaaccatgcaacgtttctttggtcaaatgccactgctgaaagccgaacttcagcggtggattgatcaagggcaaacggtagtactgatggctaatagtccagaacggcgaaagcaaattgcccaaacgcttgctgactttgatatcaccgcaacagaaactgaattaacaaatatcaagccgaatgttgttcaaattgttgctgctaacttaaacaatggatttgaaatgccacttgctgggctggttgttattacagaaagcgagatgtttaagcaggtaaaaaaggttcatcatcgtccacaaaaacttgccaacgccgaacgattaaaaaattatactgaccttaaaccaggtgactatgtagttcatgtcaatcatggaattgggatttttagtggaattaagacgatggaagttgaccatgttcaccaagactacatgatcatcaattaccgagataacgctcagatatatgtgccagtaacccaactaaatcttgtccaaaagtatgtatcatcagaatctaagaccccgcatatcaacaagcttggcggtaacgaatgggcaaagactaagcggcgcgtttcttcaaaaattgaagatatcgctgatgaattagttgacttatatgctaagcgagaagcggagaagggatatgcttttccgaaagacgattatctccaaaaacaatttgatgctaattttccatataatgagactcgtgatcagttgcggagtattgatgaaattaaagaggatatggaaaaaccaaagccgatggatcgactgttggtaggggatgtcggctatggtaaaactgaagttgcaatgcgggcaatttttaaagcagtcactggaggaaagcaggtggccttccttgtgccaacaactgttcttgcccagcaacactacaacaccctgatgcgccggtttgagggcttcccaatcaacattgccttgatgtcacgtttcaagacgccaaaagagctaaaagagacagaagcagggctaaaggatggaagcgtcgatgttgttgttggaacccaccgaatcctatcaaaggatgttgaatttaaggaccttgggctgttaattgttgatgaggaacagcgctttggggtaaaacataaagaaaaactaaaacaattaaaaaataatgttgatgttttaaccttgacagcaaccccgatcccccggacattacacatgtcaatgctgggcgtacgagatttatcagtccttgaaacaccgccagctggtcgttacccaatccaaacctatgtaatggagcaaaatagtagtgcgattcgcgatgggatcattcgtgaaatgcaacgcggcggacaggtttattaccttcacaatcgcgttcatgacattgaagagacagtggcgtggttacaagaccttgttcctgaagcccggattggctatattaatggtcagatgagtgaaaatgaactggagacagtcctctatgagtttattcaaggaaattatgatgtattagtgactacctctattatcgaaacgggggttgatatcccaaatgctaatacgctctttgttgaaaatgctgatcggatggggttagctcagctatatcagattcgcggacgaattggtcgtagtaatcgggtggcttatgcttactttatgtatcagcctaataaggtcctaacagaattaggagaaaagcggctagctgcaattcgtgattttaccgagttgggatctggatttaagattgcaatgcgagaccttgctattcggggagctggtaacctcttggggaaacaacaacatggatttatcgattctgttggttatgacctatattcagcgatgcttagtgatgcggtagctaaaaagcagggtaagaagcaaactattcactccgatgcagaagttgagttaggggttgaagcttacctaccaacggattatattgcagaccaacggcaaaagatcgaattatataagacaattcgccaagctaagacagatgaagaagttattgatattcaaggtgacttgattgatcggtttggcgattacccggcaccggttgggacgctgttgcttgtcagtcaattgaagaatcatgctgacctggcaatgattgctgagattaagcggcaacgtgataatattaatatcaagtttactgaacgtgctagccgcttgattaaagcccctgcaataattaaggagctagctaatacgcgatttaaagcaacaatcggtgaagacaatcagcaactaacgattcggctggttattcaacctaaaatgactactgatgattggcttcaccagctactacaatttgtaacgactttaggaaacgttattcaagccgatgaaaaaggagcggaaaaatgagattagataaatttttaaaagtatcacggattattaaacgtcgatcaattgctaaggaaatcgcggatcaaggacggatcttaattaatggtcaaccagcaaaatcatccagtcgggtagcggttggtgatactttaacaattaagtttggtaataagacagaaacagttaagattaatcggattgttgaaacgacgaaaaagagtgaagcggaagatatgtatgaaattgttgatgaaacttacgcggaatcctttgaccaactataatatcttctgagatataaaaaagttgataatcatatggacattctccgcggtatcttgctatacttaaagcgtgataagttaaaatggaggggaatgtcagatgaaaggacaatctgatagcaaagtttcacaattaaataccccatatgcccgccaggtttcgaatcaaaaaacatataatcggcatgtgcataagcgccgttgtcagcggattattgccgtttttttggttatattcttaatctttggaattcagatatttcaaagcaaacggacattagcagatattaatggcaatattcgacaagcacaatcacaattaacaaaacaaaaacaaaagaatcaacaactacaacgtcagattaaaatgttgcataatcccgaatatattcagcaggttatccgtgctaagtataattactctaagaagggcgagataatctataatttgaactaatgatcacaaaataggatgtttttagtagggttagaatattttaaatgttaaaattgagaatgtaattgggtgatttttcagcttagttttttatgagaagtttagttattttcatacgttttcaagatgaagttatgatatactcaaatacaaaaatatgagatggttcaggaggatctataggtttcatggcaattgaagttggagcaaaggtttcaggtaaagtttcaggaatcactaattttggtgcattcgttgatttagatgataatcagacagggctagtacacatcagtcaaatctctgataaatatatcaaggatgttcatgatgtattggctgtcggggatgaagttacagcaaaagtaacacggattggtgatgacggtaagattgctctttcaatcaaggctgcagctcctcgtgaacatcaagatcatcatgaaaataaccatcatcgtgaaaataatcaccgtgattttcaccacgaacggaataataatttccgtggtcacaatgataacttccgtggtggttttagtggtcgtcaccacaacagtcaccaacacgaagactttaatgacatgttagctggctatttaaaagaaagcgaatcacgtttatctactttgaaacgtcaaactgatggtaagcgtggcggccgtggtggtcggcggagctaatatggcggatttacaacaagcatttgagcgacacctagtaaggagtcgcttttttgctacccaagataaggtggtagtggctgtctcaaccggagtcgattcgatggttctgttagatctcttgcaacatttgccgttaaaatatcgtccccagattatcgttgcccatatgaaccatgagttacgaaaacaaagccagcttgaagaacggttcattcggcagtattgtaaacaaaatgatttaaaactagcagttgcacactggccacaagatcttcatccacagaccggggtcgaaaacgctgcccgtcaagcacgctaccaatttttccgggaagtgatgaaagataatcaggcaagcattctgctaactgcacaccaccaaaatgatctagcagaaacaatgctgatgaagatggctcgtggtggtcagttgagtcaattagtgggaatacgagatcggcgaccatttgcttctggaaccttaattcggccgcttttaccctttagtaaacagcagttaaagaaatatgctttgcagcatcatcttaagtggtatgaggataagacaaataaggacttgaacattcaacggaatcgatttcggcatgcgataattccaatgcttgaagaagagaatcctcagttgctttctcacctcgaaagctatcatcaacagttaacggatctccttgcctggcgtgatcaagaagtggcagatcaattagcagcatgtgttgatcaacaaggaaggatgatcctggcaagattattgcaaaataaggaaatcattcgaaaagaaattttacgacaatggtttaatcaacaaggaatatatgatattaaggaccagcaacttgatgaactgctgcagatcctagaaaacgagcaaaagccacagcaaatcattgagttgccgcatcgatatattcttgagaaagcctacgctacttgtgtgttaaaaaaattggataatccgcttgagaacctacaaaagccccaagatcatgtgataaaattggaacaatggtatcaagtagatccaataaacttaatggcagtgtcagctgaaaagtcgtttttcaatgatgaagagcaggtagttttgcaatggcttgctccagatcaatttccgctgcgtctacgacaatggcgacaaaaagatcgtattcgcttaaaaaatggtcatcaccagttagtcaagcgggtcctaattgaccaaaaagtttcccgaaaacagcgtgaccagcaaatggtcctagttgatgcgcatgacgaggtcgtctggatagttaaccgaaagtggagttggtttgaacggccaaccggctatcagcagacatgtcggtcatgttttattggaataaaaaataaggagaagaaggtaaatgaataacgatattgagcgtgtcttatacagcgaagaaatgcttggcaaacgaatggacgaattagcaacggacttaacaaaagattataaggataaacggccaattatcatttccgttctaagcggagcagttttatttactgttgatatgattgaacggctagatatcatggcccaaatcgactttattgatgtttctagttattttggtggcttaggttcgactggaaaagttaaacttattcatgatttgaaaacagatgttaaagatcggcatgttctaattatggaagatattgttgataccggtcatactttgaagtacttgatggaccttttagccgaccggggagcaaagagcataaaggtttgttcattattaaataagccagaaggtcgggaagtagatgtcgaacctgattatgttggttttacggttcctaaagagttcttggtagggtatggccttgattacaaaggattctaccgaaatttaccgtatgttggaattttgaagccatctgtataccaaaatgactaaaaatgttagataattaggatgacggaaaaatcaatattaaatggacggtattttaaagatattcttaattaacgtccatttttatggatccgtaaatatgtagtatgtattattaataacattggcgataaaactattaattcttctgtaaaattaatggtcaatatttgtcaaatatgctatgataatgactacaattataaaatatcgttgctggtagataggaggttgttatgaacaacaatcgtaaaaaaaataattttactcataacgttctcttctatgccgtgatgttcttgtgtattatgggaatcgcctacttcttctttgggggcaatgcctcaacaggacaaagtaagacagtttcccaaagcgagtttatctccgaactgaagagtaataaggttaagagcgttcagcttcagccaaatggtggggtatataaggttacgggtacttaccgtaaacctcagtcaaacaatgacaattccgccaacaatactggctttgctcttacaccacaacgaaacaataaggtaactcaattccaaagttctgttttggaaagtgacgtaactgttagtcaacttcaaaactatgctaaccgtcataatgtaaagattagtactcgtgctgaagaatctaatagtgtctggatgaacctgttgttgactgtcttgccattggtcatcatgattttcttcttctacatgatgatgggccaagctggtcaaggtgggggtggccgtggagtgatgagctttggtaagaccaaggccaagccatctgatgctaagaaaaacaaagttcgtttctcagatgttgccggtgaagaagaagagaaacaagaattggttgaaatcgttgaattcttgaagaatccaaagaaattcactaagcttggtgctcgtattccatctggtgttttactggaggggcctccaggtactggtaagaccttgctagctaaggcggttgccggtgaatcaggggtaccattcttctcaatctctggttctgactttgttgaaatgttcgtcggtgttggtgctagtcgtgttcgtgacttatttgatcaagccaagaaagctgctccagcaatcatctttattgatgaaattgatgccgttggtcggcgccgtggaaatggcatgggcggcggtcacgatgaacgtgaacaaaccttgaaccaattgttagttgaaatggatggtttccaaggcgatgaaggaatcatcgtcatggcagctactaaccgttcagatgtcttggatcccgcccttttacgtccaggacgttttgaccgaaagattttagtaggtcgtccagatgttaagggtcgtgaagccattttacgagttcatgctaagaacaaaccaatggcaagcgacgttgatttaaaggaaattgctaaacagactcccggttttgttggggctgacttagctaacctattaaacgaagcggccttattagctgcgcggcggaacaaaactgaaattgatgctgctgacttagatgaagcagaagaccgggtaattgctggaccagctaagcataaccgtgtccaatctgaacaagaacgaaagactgttgcataccacgaagcgggtcacacgattgtgggtcttgtattaaatgacgcacgagttgtgcacaaggttaccattgtcccacgtggtcgcgcgggtggatatgctatcatgcttccacgtgaagatcagatgttaatgtcgaaaaagaatgcgatggaacaaatcgctggtctgatgggtggacgagctgctgaagagcttgtctttaagtcacaatcttcaggagcttcaaatgactttgaacaagcaacccaaattgctcgttcgatggttacccagtacggaatgagtgataagattggtccggtagaactgcaaagttctggtcaggtctttacaggtcaaggctatgaccaatcaccttactccgaaaagactgctgctttagttgatgaagaagtacgtcgaatcttaactgaagggcacgaaaccgccttacacattattgagacgcaccgtgaacaacataagcaaatcgctgaagcattactcaaatacgaaacgcttgatgaaaaacaaattcttagcctttataagactggaaaagttcctgataaggatgtggctgctgaagacgaagaggcacgtgcacaaacctttgaagaatccaagcgtgaacttgaacgattggaaaatgagcgtcacgatgaagcaaaggataatcaaaatgattcatccgatactaagagtgacaactcaaatgattcacaatcaagtgatgattcagacaattctgaagacaagtaaactattgaaaagacggaagatacaaaacctgattggtaggtggtgatcttccgttttttctttaggattaattttaaggagaaatttaaaatgaaaacaacagattatttagtaaagtcaatgactaaggatggaaagtttcgggcttatgctgtaaatgctacccaagtcgttcaaaaggcacacgaaattcatgatacatggagtgcttcttcggctgcccttggtcgaacgttaattggaacgattctcttggctacttctagtttacaaggagaagcaggaatgacggttaagattcagggaaatggtccagttggctttattattgcggatggaactgctgaaggaaccgtaaaaggctacatgggtaatccacacgtttctttaccagccaatgataaggggaagatcgatgtcgcaaaggcaattggtaatcaaggaactctttctgtaaccaagatggctcctggcgacaagacaccatataccggcgaagtaaatttagtttctggtgaacttggtgatgactttacttactaccttgctcaatctgaacaaattccttcagcagttggcctttcagtattcgttaaccctgatgaaaatattgacgttgctggtggcttcatgattcaagtaatgcctggtgctagcgatgaagaaatcagcaagcttgaaaagacattgaagagcttgccattggtatcacaaatgttacgtgatggtgatacgccagaagatattttaaagaaaatttttggtgatgacttaaagatccttgaaacgatgccggttcgttatgcatgtgattgctcgaaggagcgttttgcacatgcccttgcaagtatttctaaagatgatatgaagaaattgattgacgaagaccaccatgcggaagctgtttgccaattctgcgggaagaagtacgaatttagcgaagacgaattaaagaagatctacgcggaaatgactgcaaatgatgataaaaaatcaacagatgaaaagtaatttttggtgctaagcgtgttgatatgctatgatagttgagttatcggacaattaaaaatgaaactggatggccagcacagtttcttaagcagtaatgaggtgaaaaaatgaaatggaagatcggtaacgttgaaattcctaatcaagttgttgttgcaccaatggctggagtaaccaattcagcctttcgggttatctgtaaaagatttggtgctggctacgttgtctgtgaaatgatctcagaccgtggcattgtgtatcataatcaacgaactttaaatatgatggatgtcgacccggaagaacatccaatgggaattcaaatttttggcggaaccaaagagacattagttgaggctgctaagtatgtagatcaacatacagcagctgacgtgattgatataaatatggggtgtcctgttaataaggttgtaaaaactgacgcgggtgcacggtggttactggatcctaataaagtctatgaaatggtgtcatatgttactgatgctgttaagaagccagttaccgttaagatgcgaactggttgggacgacaagcatattttagctgttgaaaatgctttggcagctgaacgtgcaggagctagcgcgattgcgatgcatggtcgaactcgaaaacaaatgtatacgggacaagcagattggaatatactaaaagaagtagcgagtcaattgaaaattccgttcatggctaatggtgatgtgaagacaccagaagatgctaagaagattcttgatatgactggcgcaaccgccgcaatgatcggtcgggcagcaatgggtaacccatggatgctaaagcggactgaacattacttagagactggtgagctgctcccggaagcaaccccagaacaaaagattgaaatggccaaagatcatcttaatcgtttagttgatttaaagggtgaatatgttggagttcgtgagttccgtgggttatccacgtactatatcaagggtattccgcgtgctgcccggactaaggtagcgttagtcgaggcagaaacacttgatgaaatgaacgatatttttgaccgctttgctgaacaaactgcagaacgagctgcaaaaagacagcaagcttaattacgaggaggagaacttaagtgtcacaagaactagatcaaatgcgcgttcggcgtgaaaaaatggaagagttaaaagaagcggggattgaaccgtttggccgtcgcttcaaacgagaccatcttgcccaagacttgcatgataagtttgatcaatacgataaagaagaattaaacgagatgggcgccaaagtaattattgcgggtcgaatgacaagaaagcggagtagtggtaaggctggtttcgctgactttgttgatcggactggtaagattcaagtttacgctcgtaaggatatggtcggggatgagccttaccatgttttcaagcggtcagatattggtgacttccttggaattgaaggggatgttatcaagacggatacaggtgaattaactgttcgtgcacataaaattaccttcttgtcaaaagcattgcgtccacttcctaataagtgggatggggttactgatcctgaaactatctatcgtcagcgctaccttgatttaatttctaacccagaaagtttcaagcgtttccaccaacggacagcgatcatcaaggccgtccggaagtacatggatgataatggctttacagaggtagaaaccccaattttgaacactcaagctggtggtgctaatgcgcgtccatttatcactcaccacaatgcgcttgatattgatatgtacttgcggattgctaccgaattgtaccttaaacggttaatcgttggtggctttgaacgggtatacgaattgggccggattttccggaatgaagggatggaccctcaccataaccctgaatttactacaatggaaacttatgctgcttactttgacttccaagatgttatggatgaaacagaaggaatcgttaaggcagcagctaaagttgtttcagatgatggaaagattacttaccaaggacatgaaatcgaccttggagggaactttaaacggatcacgatggtggatgccgttaaggaaaagactggcattgacttcagcgatgaatcaatgacggacgaagatgctaagaagttagccgatgaacacaaggtcgaatataagccttactggacaaaggggcatatcttgaacgcattctttgaagagtttgttgaagatacacttattcaaccaacttttgtctatgaattcccagttgaagtttcaccattagcaaagcggaatgctgataatcctgcgatgactgaccgtttcgaattgtatgttgacggtagcgaattggcaaatgcctttagtgaattaaacgatccaattgaccagaaggaacgttttgaaatgcaagcaaaggaaaaagctaacggtaatgatgaagctgaaccagtcgacttagattacgttcaagccctcgaatacggaatgccacctactgggggacttggtattggaatcgatcgtcttgtaatgctccttactgatgctaaatctattcgggatgttattctcttcccaacgatgcgtccggaaaaggaaactaagaacgattcaaagaaaaagaagaacaagaagaagtaagctgaatggttgatgaaaaattagcataaatagataactcgtattccatttttatggggtgcgagtttttctgttttagttatgttagaataactatcaatttagaggagaaatgaggggaattgatgggagaattagaaaagttaaagcaagactgtatagtaaaacaaaagcgtgggttgcatataataattgcttcgatcgtagtatggggcggtattcttgcagtagaactacttaatgttcccgttcttactaaaaacttattcgtatttgtctgtacggccttacttttaccaatatcttatttcatatcgcgattaattaatgtggattttcaaaataagacaaatccgttaactaagttggggatgttattttcgatgaatcagcttttgtatcttctaattgcaatgtggatttatccgactattcccaataaaatgctaatggtgttagcgataatatttggtgctcatttactgccatatagttggttgtataattctagggcttattttatttcatcgatagtaatttcaatattagctttattggtgggaactaattttaaaccgtttattttagcatcagttatgcttaccatagtagtagcattttgcattaccttaatattagaaaatcatcaacttgactgaagggctccgatccgtaaagaagatcgaagccttttttactatattattttaattcttgtgaaacttctaatagtagaaaaaacaattgcaaaaagagactaatagttatcaaggaatgttcctaacaatctatccaagaagatataaaaattgaattggtccggctattcagctactgatttaatggctgaataataatttccagcgttaagataaaaattgaatgggtaaatatatcgagttactaaccgagtttaatattgatgcttttctccatactaattaggtgattttcgggatggaaaagaaatgctaattggtaagaatggtaaaggaggcaggcaaacttattaaaggaatagtgagtttaagaagctaatagatagcgatgaaaataaaattcaaaaaagttgaaaaaaggtgttgacgaaagaatgaaatccatgtatagtagttatcgttgtcaaaacagctaagtgctgttgagatggtttaacaaaaaagttaaaataattgttgacatcgacttggcaacatgatatattaataaagttgctgattgagttatcgatcaaaagaaattaaaaaataatttaaaatttcttcttgacaagttaatccgatgcatgatataattaaattattgattggctgcttaattagccgacaggtagacctttgaaaactgaacaaagtttcgacgaatcaaatgtgtagggtcttcaatcacgatgtgatttgaagcaaaacatttgcgaagtcaattcgcttaataacaaagataattgagagctattcaagttcttatatattttatatgagagtttgatcctggctcaggatgaacgccggcggtgtgcctaatacatgcaagtcgtacgcactggcccaactgattgatggtgcttgcacctgattgacgatggatcaccagtgagtggcggacgggtgagtaacacgtaggtaacctgccccggagcggggataacatttggaaacagatgctaataccgcataataacaaaagccacatggcttttgtttaaaagatggctttggctatcactctgggatggacctgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcaacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccttagagataaggcgttcccttcggggacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcaagctcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatggaagtttgtaacgcccaaagtcggtggcctaacctttatggagggagccgcctaaggcgggacagatgactggggtgaagtcgtaacaaggtagccgtaggagaacctgcggctggatcacctcctttctaaggaataaaacggaacctacacatcgaagaaactttgtttagttttgaggggtttaccctcagagcttgtactttgaaaactaaatactatctaatttctttattaacaaaacaataaaccgagaacaccgcgttatttgagttttaattaacgaattataatcgctaactcaattaatcagacaatctttgattgtttaggttaagttatgaagggcgcatggtgaatgccttggtactaggagccgatgaaggacgggactaacaccgatatgcttcggggagcggtaagtacgctttgatccggagatttccgaatggggcaacccaatcagcttagtcgctgattacttgactagtgaatacatagctagtaagaggtagacgcagtgaactgaaacatcttagtagctgcaggaagagaaagaaacatcgattccctgagtagcggcgagcgaaaagggaagagcccaaaccaacaagcttgcttgttggggttgtaggactgaacattagagttaccaaagtgcgacgtagtcgcaacagttgggaagctgtgccatagagggtgaaagccccgtagacgaaacgtcacactctctgttcaggatcctgagtacggcgggacacgtgaaaccccgtcggaacccgcgaggaccatctcgcaaggctaaatactccctagtgaccgatagtgaaccagtaccgtgagggaaaggtgaaaagcaccccggaaggggagtgaaatagttcctgaaaccatgtgcctacaagctgtcggagcccgttaatgggtgacggcgtgcctcttgcagaatgaaccggcgagttacgattacatgcaaggttaaggtggaaaaaccggagccgtagcgaaagcgagtcttaaatgggcgtaaaaagtatgtagttgtagacccgaaaccaggtgacctacccatgtccaggttgaaggtgcggtaaagcgcactggaggaccgaacccgtgtcagttgaaaatggctgggatgaggtgtgggtagcggtgaaattccaaacgaacttggagatagctggttctctccgaaatctctttaggggagccttgaggtaaagaatcgtggaggtagagctactgtttggacaaggggcccgtcatgggttaccaacttcagataaactccgaatgccatcgatttatactcaggagtcagacgatgagtgataagatccaccgtcgaaaggggaacagcccagatcaccagttaaggtccctaaatatatgctaagtggaaaaggatgtggagttgcatagacaactaggatgttggcttagaagcagccaccatttaaagagtgcgtaatagctcactagtcgagtgatcctgcgccgaaaatgtaccggggctaagcatattaccgaaactgtggatgtgcactatgtgcacgtgataggagagcgttctaagggcggcgaagtcagaccgtgaggactggtggagcgcttagaagtgagaatgccggtatgagtagcgaaagacaggtgagaatcctgtccaccgaatgactaaggtttcctggggaaggctcgtcctcccagggtaagtcgggacctaagccgaggccgagaggcgtaggcgatgggtaacaggttgagattcctgtaccagttaactgcgtttgacgatggagggacgcaggaggctaagcaaaccgtacgactggaagagtacggccaagcagtaagtcaggatgtgagtcaaatgtttacatccgtgttgacaagctgtgatggggagcgaaattaaagtagcgaagttgccgatgtcacactgccgagaaaagcttctaaggagtagttaactgcccgtaccgcaaaccgacacaggtagtcgaggagagaatcctaaggtgagcgagagaactctcgttaaggaactcggcaaaatgaccccgtaacttcgggagaaggggtgctggccgcaaggccagccgcagtgaataggcccaggcgactgtttatcaaaaacacaggtttctgcaaaatcgtaagatgaagtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcgctgtctcaacgagagactcggtgaaattgaaatccctgtgaagatgcagggtacccgcgacaggacggaaagaccccatggagctttactgtagcttgatattgagtgtttgtactgcttgtacaggataggtaggagccgtagaagtcgggacgctagtttcgacagaggcgctggtgggatactacccttgcaatatgaccactctaacccgcagcactgaacgtgctgggagacagtgtcaggtgggcagtttgactggggcggtcgcctcctaaaaggtaacggaggcgcccaaaggttcgctcagtatggttggaaatcatgcgcagagtgtaaaggcacaagcgagcttgactgcgagacagacaggtcgagcagggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacataccgctggtgtaccagttgttccgccaggagcaccgctgggtagctatgtatggacgagataaacgctgaaagcatctaagtgtgaaactcgcctcgagatgagatttcccatttccttcgggaaagtaagacccctcagagatgatgaggtagataggatggaagtggaagtgccgtgaggcatggagcggaccattactaatcggtcgaggacttaaccaaggagcggtaaggtttattggaagagaatagataggatttagttttgagagcacaagctctcgtccgaagggacaaagagtgtggtgatgatggcttgaaggatacacctgttcccatgccgaacacagaagttaagcttcaacacgccgaaagtagttgggggatcgctccctgcgaggataggacgttgccatgcgttattccggcatagctcagttggtagagcacctgactgttaatcaggttgtcgtcagttcgagtctgactgccggagtcgatgaagatgttgactaccttcggttagttaacatctttttttgccaacttagctcagctggtagagcatctccctcgtaaagagaaggtcggaggttcgactcctctagttggcattatgaaaggtttataaccaattagaagtctacagattaagccgataaagcttattatgtaggcttttttgtatacttaagaagttaagtgaattgttcgtaagcagtcaataacagtacgtctagctctagctaccccggatcttctatactgagactatcatcagtaaggagattttttatttatgacagaacaaaatgaaattattaccccagttttcaaaaacaagccaagtaatttacaaaagcattcttttacggcacgccctgccgtaaaaattaatgtgaatgaagtcgaattaacgattttcaaggggactaattctgttttagcttcggatatcgttaaagtggttattcgttatgctcgttaattggcatgacccagattatatctatttagtctgtggaaaaacagacatgcgaaaaggtattgatgggctcgcaatggtaatcgctgagaactatggattagaattatataataattcgcttttcttattttgcggcggacgtaatgatcgctttaaaggattgttttgggatggcgagggctttattatgctctataaacggtttgaaaatggccaccttagttggccgagaaacagtaatgaagccaaagaattatctgctcaacagctcgactggttattgcaaggactgaacccattaccaattcgtaaaattcaagctgttcgaccaggaagtttttattgagttacctctatttaaaagaagaattctttgatataattaccaaagaataattcaaaggaggtgacgtaccatgaagcaaacagcggaagaacaaatcaaagaacttaaacaacaattagctatggccaatgaaaagattgctcaattaacagctattatcaaacttcaaaagaaccaaatatttgggaaaaaaactgaagtaatggagcccatcgttgatggacaacaatccttatttagtgagcaagaaatggatcaacttcaagatcctgatatttcagtcacggaagtgactgaaaagaaaataaagcaagtggtgcgtcaccggaaagcaaaacaatctggtcagcggaccacttttttagatggtttaccacaggttgaagaagttattccattaaaagatactaactgcccacactgtcatcaactaatgaaaaaagtgggtcaacatgtatatagtagagaagcacggttaaaaccggctgaattatattgtgtgaatttgattcaagaaacttataaatgtaatgagtgtattaattctaatggtagcgatgtacttgtcagtagtaagatgccacagagtcttttaccccatagttacttttcgagtactattttagctaaagtagcagagttgaagtttaatcttgctttaccgtttcatcgtcaaattaagttttggcaagtcgtcggcttacgagttgatgctcgattattggcgactaacatcattaaggttagtcaaacctaccttgaaccgttatatgattatttacaggaattaatcagaaaagaatcggtaattcatatggatgaaactccattcaaggtaattgatgagcctaatgaaactggctacttttgggtaacgcgatcaacaaaagaattcagtaagcatcaaattatcatgtttcattactataatacccgcgcgggtaaaaccattggtcaaattatcggtcatcaatatcgtggaattattatgtgtgacggttatggtggatatagtgatcgattatatccccaggcaaaatttgggtcatgtttagttcatattcgacgtgaattttatcacattacatgtttattgaataaggagcaattgaagaactccaaagcataccgagttttacagctaatgcgaccgatctttcatgaagagaaacaattaacatattccaatcataaggaaaaactagtgtaacgtcggttgcacgtgaagcctttgatggataagttatatacttatttagaaaatatcagttttcctcaaggacggttgaaagctgccattaataatgctttgaagctaagaaagcgagtatatcaaatatttgaagatggtcgagtgccgttaacgaataatccggttgaacaagcgattcgtccatcaactcttattcgaaagaatagcttatttgcgaaaagctctgctggagctcagtcaaataccattttctatactttggtggcaactgcaaaccagaaccatttaaatatctacaaatactttaagtatctttttgatcacttaccaaaccgcaaggacgcaggactttaggcttatttgccatggtcaaaagaaattcaagcaaaatgccataaataaaacggggtcatgaattaccattttcggtagctcatgatcccaattttttcaatccgtactgttattgactgcttacgatccaccacgctcaaggcgagaaataaaattaattgatagattgcttaactcagcaagttgttgttgggtcatatttaattcatggcgacggttagcaatattttttcctaattgttgttccatagttgattattccttgttttttattttaagggtaatatgattatatactaaagtcgctaaacggatcgaacaaaaagagaatatgatttattgaaacttaatctcagctaaaaatcagtacctaaccttcatgttattacattggttcaacaaaagtaagctgttaaaacttcttatgattaagtagagcagaaaataaacaaactcctacttgaaaatatttctagacaaattttaaattagcttgacgggtataaggatataatatataatgatatccgttgagttattccggcatagctcagttggtagagcacctgactgttaatcaggttgtcgtcagttcgagtctgactgccggagtcgataaagatgttagctgtttggctagcatctttttttataccttctaaacatctttttaatattctaaattgcatatctccagtttttaacgatagattattaatttttatatcaaaaaaattgtagaagttttaacatgagaatatactaaaactgtaactagtttcatatgtagtttaggagaatggaggtatttataatgcgatttagtaaagcaatccttgttgcaacaagcataattgcaattgggctatgtacaagtggctgtagtagttttagcacgagttccaacagtagcaagagcagtaagtctcatcagcaaaaaagaggagtcacatattgtgggctcgtatcgtgatgatgccgatggagctgctattacccttaattcagatggaactgggacatatgtaatggaaaatccgacgcagactgatatattcttgatcaattgacctggaaacaggaaaagaataattacatcattaatttaaatgatagtaattatgatacgccaattgatgcgcggctaaatgaagataatttgagccttgtaggtaacgatgaatggcctaatcagtcatttaaacgagttcatggggactttgacgttgataatttctcaaaagaacaacatgcgaaaactaacagttctacaactaaggatactcattctaaggaatcatcgactcatgcccgcgcagcacttaaaaatgggcgagtgaccaccacaaagacaccagcaagattgataatttgaaggctacgactgacctatctgagccagatgaaggttgggcctgatgataatggaactgaatgtgccattgttcgaaatggaaaagtttacccacgtccggttattgatggtgatacgtcatctaattaataatcttagcgacaaacttaataaaataaacaattatagctcatacatgcgtttgcgttctcatcaaaaacttatttttcaattgacgatgttttgaaacacgtttataatagtactattctgaattttattgttaaagttttttaatgtttagaatacgtattcaattaacattgtgctaattgaaaagtgaaattatttggaggaattgtatgagtaaacaaaagaatttggatacctccttctttggacaaccgcgtggattgtcgacattgttcttcactgaaatgtgggaacggtttagttactacggaatgcgggctatccttctattctatatgtactacgctgttaccaagggtggtttgggtatggaccaagctaccgcagcatcaattatgtcaatttatggttcattagtttacctggccagtgttgtcgggggatggttatctgaccgtgtatggggatcgcgtcgaacggtcttcatcggtggtgtccttattatgtttggacatatcgctctgtcattaccatttggtgtgtcagcactttatgtatcaatcgctttgattgttattggtaccgggttattgaagccaaatgtttcagaaatggttgggggcttatatagtcctgaagatcgtcgtcgagactctggttttagtatgttcgttttcgggattaacttaggggccgctgttgctccttgggctgtcccttgggctgctaatggctttggcttaaaccttttccatggtgaaatgaacttccacgctggtttctcactagctgctatcggaatgttctttgggttagtacaatatgtagttgacggccggaagtatctttcaaaagatagcttatatcctgatgatccgatcgataaggaaagtttacgtccagtaattatttggtcaattgttggtgttattgcattagtgatcattcttggattgcttgcggcaatgggtcaattaaacatcaataatatcattacaatcattacggttattgctattgctttaccaatctactactttgtaatgatgttgaattccaagaaggttacaaaggatgaaaagtcacgggttgttgcttacattccacttttcattgctgctgctatcttctgggcaattgaagaatcaggttcagttgttttagccctcttcgctgaacaacggactattttacacattggtggctggcactttgctgctgctaacttccagacattgaacccattattcattatgatcctaacaccatttttcgttgcactttgggatcactggaaaaaacaaccaagtgctcctggtaagtttgctgctgggttagtaattgcaggtctttcatatgtttggatggcacttccagcaatgattcacggtacaactgctggacgggttagcccattctggttagttggttcatggttcattgttgaaatcgccgaaatgttaatttcaccaattggtctttcagtaactactaaacttgcaccaaaagcatttaagtctcaaatgatgagtatgtggttcttggcggatgctgctggacaagcggttaacgcccaggttgttaagtactactcatcagctacagaagttccatacttcttaattatcggggcagtaagtatcgtcttcggattgatcctttgcttattcgttaagaagattcatggcttaatggatggtgtagactaaaaattatattaagagatcgagaataattcttggtctctttttttatgaggtgagttatgaaaatcgcagtaagcagtgaccttcatttagatttaaatcatgctgatgttgcagaaattattactcaacaggcgcattatttaacccgtcaagaaattgaccattacttttttgtgggggatgcctttaatgattttgcgcaaaccagcgtatattttgcggaactacaatcgcaattgcctatcacaaaggtccattatcttgccggtaaccacgatatgttagaaggagtcacttatgagcaattagaaaatttggatgatgatctatattttcataaccgatttatcgatattccccaaacaaactggcggattatcggtaacaatggttggtatgattattcgttttcaacgtatgaaagtaatgtaaaaggggtcgcaaaatggaagcgggcatattgggtggatcgtccaattatgcagccaatgaatgatccagaacgaatggcgattgttttacaccaagttgaagaaaacctaaaacaggctcgcaatcaacaaaaacaggttatctttatgacccacttcgcaccgattagagaagctctcccgcatccaattattgagtcagcacggcggcagcggatgtgggagatgacgacagcaatgttgggtagtagacacttaggagcattactcgctaaattcccggaagtaaaagcagttttctatgggcatcttcattatgctcaatcattaattactgttggaaatattgaataccgtaatcaagcagttggcgtaagacgcaaaaatagtgagaactggaaggggaaaagcctattagatcaatggattagctgcctttatactaaaaaaatctagttttttcaaaaaaataagaaaaaatacttgcaatgaggttggaaattaggtattataataaacgttgattgatacgaaatatttaatcaagcaacttcttggaggagtagcgaagtctggttaaacgcgacggtctgtaaaaccgttccttcgggttcggcggttcgaatccaccctcctccatctttattattgggctatagccaagcggtaaggcaacggtttttggtaccgtcatgcgctggttcgaatccagctagcccaactgttattgaaaggctaagaaaaacatctgtttttcttagccttttctagttcaaaattttattaagctatatgaaaaaaggaatgacagccaatgcctaaacaaggtcattttgcaaaaagcatgcgaactaaacaaataaatgattttaaagtgaaacgcaatgcgactggtgcgaccattgatgatgaacagttaacagatttcctagtggttcgctttgctttaacagctaagaagagggttcaatctggggctcgagaaactgctcaacggttcttgattgaaatttgtgattctttacaagaaaatgatggggatttacaggcgatcattccaaatttactagtgagtcttaatgcccgggtaccttggcaattctatccaaaaattctgggagagtgggatttgcttcaaaagtttttacaaaaagaacttcctgcagttccgttagaaaaacgtctacgaattaagcacccagtcacaacccaggaaatggagacgttaattgcaaaattattggtcagaaagattactgcaattacgtttattaatcagccgggagttgatccacataaaaaagatcagatggtgacaatgatgctgacaacgatctatcatgatcaaacgattgaatgggataaagtacggttgttactggcgccatttaagtttgaaattgcccctgaactagacgaagaaacgaaagactggttaaagaaattagcagaaaaataataacgttgactttcgttctgcttccttggtagaattaaatcgttattgcagagctgtggtggagtttttatcaccgtggctctttttattttgatttgaaggaggaagcgaaaagcaatggcagaaaaaaactattcacggatttatctcgcaattggttcccttgcattactaacgtttatcggaattttgaatgaaacatcgatgaacgtcacatatccagaactatctgctcagtttaatgtatcactcgatgttattcagtggattacaactggctatttattgatggtaacaattacgatggggacaactgcctatctattacgccaatatcaagcgcgttggttgcacttatttgcagtatcatttttcattattggtgacttgatgtgtgctttgactggtaattttcctattttgttaacggggagattgattcaagcgatggcaactgggttagcaaccccaatcatgttccatttaatttttacggagattccgcgtgaaagaattggcatgatgaccggaatggctgcaatggttatttcgtttgcaccagcactgggaccaacatatggtggggtcatttcagaaatgctgtcatggcggatgatcttttggattttactaccaattgttttgattagtcttgtatgtggtcaactttttattcgtaataaaccacttggaaatgataaagcatttagttatggaagcttgattacactggcaattgcccttattagtataattagtgcagtttcttcaattgggaaacaaggatttggcaagcagttttggcttttattattggtagcaattattttctttagcacctttatctatatcaataatcatggtaaatcagaattgtttgacttaaaggtgtttaagattttcccattgcggctatcaactgtcacttattttaatttacagtttattaatattggaatttcgcttgttattcctatttacgttcaatatgttttgcactcttcggcaattgtcgcgggtcttattttatttcccgggtcattaatcggtgcttttatctcgccatttgctggaactttggctgatcgttatggttttgctacgccagttatttccgggggattcttttggttattgggacaagttgcttcagtattttccaacgtcatttaacgccattactaataacgatcttctttgttattttgcgaattgggtttaactttgctttttctaatacaatttccaatgcttcaatgttggttcaaccgcaaaatgcccctgatgtaaactcaatttttaatatggtccaacaatttgccggctcactgggaactagtcttcttgcctccacaattgctttattccaaatgggcaacagcggttcactgatgggacgtacatatgctggaggacgatttgactttatcttattgggcgttttggcaatcattactttattaacaatggttactaactatcgcatgcaacaaaagaaggaaagtatttctcaataagtggttgaattagcctgacaagaatgtaataatgtggcttgattaatacaagttattacaggtttttaaagaaagtgactataagttaaaatgatacattctatcgttcactttatggtgagcaatcaggtttttacgctgtttatttgtcttgcaattggctttttgattggcaactataaaattgcgggtaaatttaatattggagcaacggtgggaacgttaattgtgaccctaatcgtggggcaaattgggagttttccccgggatgaaatgttgggaacgattttctttggcgccttcatgttctctgttggttatcggatcgggcctcagttattagttagtttgaaactatttgggattcgaattttaatcgctagtattttctggatggttgttgcattcttagttgggtggagtcttttttccgcctttaagattggaccagggatcgctgccggggttatttcgggagccctcacccagtcagctaccgttgccagttcgttgcaaacgattgggtcattgccagtcagtcaaagtgttagggcaacttatgaggctcaactcccagttgcctatgctttaacatatgtttttgggacattaggggtaattatctttttacgtgacctagcacctaaaattttggggatttcaattgctgaacagggtcctaaaatggctgaacattatcactttcatgctaaaaacccgaacccaacgtggcgacgaacatatcgcattgcaaatgattcaccgcttgtcggcaaaacgcttgaggaattaatcgacggtctaattaccggattattgggttagctgcttttcatgatggcaaaatgactgaccaccttgaatatcaattgcaggctggcgacttgctaactgttattggttacgctgttcatttcgatcggttgatgcgagtaccaggattaacagaagtattgacgccaaccaatgcgccgcgtgaacgagcttttgttctgggaaaaaactttaaaccgggtgaattagcccttctacggcaacatggggtttttgtgaacattcaagacccatcagtggaaaccaacaattgattaaccagttgcgaccaggggatgtgatttcattgactgggaatacatcacgaaccaaagcaatcttaaaaaagatgggacgctggaaagctgcagatacagcgatgaattattctttattctctttaggaatcggttgtgcttcccttttaggaattatcgggctaaaattaatagtattccgttgcaactaggaaatggaacggcggctttaattatgggactaatcctgagttcatggattgagcgtcaccgtccgtaaatcaatccctgtaacggtaactagctttcttcagagttttggactaacgctttttgtggggacagttggtttacaatcagctcaagcatttacaagtgcaattaagtcgttagggatcggggtcttatttattggggcgatgatttcaataatgccacatttgctaacgctgttctttggacgctatatattgaagatggaacctcttgctttaattggtgcgttgactggttcaggaacgattgcagcggcaatgaatgagatttcgcaaaaagcagggccggaaggtggcgcatattatgcggctgcctttactccggcgtttgtagttggtaatattggaattacattactagggccgatttttgtggcgctactatcataatttatcgcttagaaagggcgtgcaaaattataatgcaacaattttttacaattttaggtggaatggggacgctggcaacagagagttatgtacgtctgttagataaaagaacgccaattcatcgtgatcaagattacttaaactatttagttgttaaccatgcaaccgttcctgatcgtactacatggattctcgatcatagtcaaccagatcctaatgaggccctgattgaagatattaaacagcaaagtcttttgaatcctgcattctttgttttaatttgtaatacagcccattactcttttgataagttacaggcagcaacggagattccaattctcaatatgctgcaagaaacggttaacgagatcaagaagattaagccggatgcaaagcgggttggtctattagccactaagggaactttggcagctaacctatatgatccttatattgagaaggctgggtacgaacttatcaagccaactcctgagattgccgatatgacagaagacctgatttaccatgatatcaaagaggctggtcattccgatggcaagaagtatcatgagctagtacggaaaatgattgaagaacaaggagcagatgtagtagttttgggttgtactgaattatcttttgcagaagagatggatcctgaaactaagtaccctgttgccgattcacaatcaattattgttgatcgctcccttgaacgagcattgaaattacgacaaaataataaaaattaaaaattagagaccagaaaggtaataattccaacggtctctaatttttattaattttttgccgatattttaagaaattggtctagatttttgggaatggtgtaaaatatacacatgcgcaatgtttagcaaacaatggcgtaaggaggaaagaaaatgagttcacctgtttatattcaaattcataatcggttaagacaaaacattgaagatggtgagtggaaagttggcgataaaattcccgctgaacgcgaactcgctaatgattttggcgtcagtcgaatgactttgcggcaagcaattcaagcattagttgatgaaggaattcttgaacgaagagttggctctggaacttttgtcgctaatcgcaaagtccaagaaaagatgtcaggaataacgagctttactgaattaatgcacgcgacagggaagaaagctgctagtaagacaatttcttaccacttgacgatcccttcgcaaacagaggttgaaaagctaaagttagccccagatgaacaggttttacgaatggaacgggttcgttatggaaatgatgtgccaatttgttatgaaatcgcaactgttcctgctaacctcgttcaaaaatttagcaaagaagaaattaccacgtctttttatcggacgctagaaaaaaaggcgaacctctatcctggtcatgcaacccagcatatttcagcaacgaaggcgacggaaaagattgctaattacttgcagattaagcgtggagatgctctcttgcgaatgacccaactatcttacttgcaagatggtcgtccttttgaatatgtccacactcaatatgttggatcacggtttgaatttgtctttgaaaagtaatcaagacaaatccatgttacaatactgattaacgatattacttttgagaggaattatactaatgaaatttgattatccggatgatagccttaccctgcatactgatgcgtatgaattgagtatgatgcagacctactggaaaaaaggaatgggtaaccgccgtgctgtctttgaggccttcttccgtaaaatgccatttaataatgggtacgctgtttttgccgggttagatcacattattcgctatgtaaaacaattacattttactgatagcgacattgaatacttaaagtctacgaatcaatttgatgatgactttctagaatatttacgtaactttaaatttacgggttcaatcaacagctttgaagaaggagatctggtatttaaccatgagcctattattcaagttgatgcgccgattattgagggccaattgattgaaacggcaatcttaaatattcttaattatcagattatgattgcgacaaaggcttcacggattaagtcaattgttggtaaccaaactgtaatggaatttggctcacgtcgggcacaagaattggatgcagctttgtggggaacgcgagcagcatatattggtggcttcgatgcaacaagtaatgtccgtgcaggtaaattatttggtatcccgatttcaggaacccatgcccatgctcttgtgcaggtatacatgaatgattatgacgcatttaaagcatatgcagaaactcatcataattgtgtctttcttgtggatacttttgataccttaaagagtggggttcctaacgcaattaaggttgctaaggaatttggcgataaaattaactttatcggtgtccgcattgacagtggtgatatggcctacctatctaaaaaagtacgcaaaatgttggatgatgctggtttcccagacgcaaaaatcatcgcatctaatggcttagatgaaaagacaattcaaaacttgcaaatgcaaggggcgaagattgatacatggggaatcgggactaagctaattactgcctatgaccaaccaactttaggggccgtatacaaattagtcgctattgaagatgaagatggccaacttgttgatacgattaagatctctaataatgttggtaaaatgtcaactcccggcaaaaaacaagtatggcggattaacgatcgtggagacggcaagagtgaaggggattatattacattagttgatgaggatcctcgtaatgaaaagtcactcaatatgttcaatcctaacttcccactccagcaaaaagacgtggaagattttactgcccggccaatgctaaagccaatctggcaagatggtaagtatgtttatgatgaaccgaccttagaggagagtcgtcaacaccgtttcgatagcttaaatgctttatgggatgaatataaacgcgatttaaacccagaagtatacccagtcgatttatcacagaaatgctatgataacaaacttaaattaattcaccaagttcatgaatatgttaaatcattgaataagtagaggtaatctgtagtgcgaaagtatcaagaagaaataattaatgcattaggcgttaactcgcaaattgatccccaagcagaagtaactaaacgtatccagttcatctgtgattttctccaaaccactaagatgaaggccctggtattaggaatttctggcggtcaagattcaagtttggcggggcggctttcacaattggcagtcgaaaaactgcgggaagagactggcgacaatgaataccaatttatcgcagtccggttgccatatggtgagcaagctgatgagtcagatgcaatgtttgcaattaatgacttcattaaacctgataaaataatgcgggttaatattaaggcggctactgatgcgatggtagtatccttaaacgaagccggtacgccaattagcgattttaataagggaaacattaaagcccgggaacgaatgattgttcaatatgctattggcggagaaaacaaaggagccgtagtgggaacagaccacgccgctgaagcagtaactggtttttatactaagtttggggatggtggtgcagatattacgccactttctggattggataagcgacaaggaaaagccttattacaatacttaggagcaccagcaaaactttatgataaaacaccaaccgcagacttggaagaagacaaaccaatgcgtcccgatgaagaagcgcttggtgttcgctatgatgaaatcgacgactacttagaaggtcgtgaagtttcgccagcagctgctgaaaaaattgaaggctggtatcgtcgaacccaacataagcgccacttgccgattgctccatatgatacttggtggaagtaaattgataataaaatgggaggctgggaatcaactcagtctctttactagttttaaggagaatgataatggaagaggaaacacttcagcttgttagcaaacaattgccagatattcgccctcaacaaattaaagcggccctcggattaatggatgagggaaatacgattccttttattgcccgttaccgtaaggaaatgacgggcacgcttgatgaagttcaattgcaagcgatccgggatgaatatcaccgggtaacgacattacgggaacgtcaagcaacagttatcaataaaattaaagagctcggtaagctaacaccggcgctcgaaaagcaaattaacagtgcaactgaattgcaagaagtagaagacctttacttgccatataagcaaaagcggcagacaaaggcccaacaagctcgtgaacatggcttggcaccgttagcaaattggctgctatcttatcccgatgatgatttaagtgcgaaggcgcaagagtttattaacgatgatgttcctgatgctgaaagtgcattaacaggcgcccatgaaattttggctgaagcaattagtgaaatggccacggtacgaagctggttgcgaaattatactgctcaacatggtcaattagagacaagcgtaaaacgtgatggtgaagaaaaggatgaactggggacttacaagcagtactatgagttcactagtccagttcagaaattgaattcttatcaaatcttggcttttaaccgcggagaaaaagaagggattattaacgtcaaaatcactttagctgaagaaccagtgatgaattaccttcgttttcgtttgattaaaactagcaagaaaaatgatgcgactgcctttattgaggaagcttacaaggatgcttacaagcgtttcttgggtccagcaattgaacgggaactgcggcgacaattaacagagggcgctgatgaacaagcgattaaggtctttggtgaaaatctctatcatttattgatgcaagcaccaatcaagggaaaagttgtattgggcttcgatcctgcctaccgaacaggctgtaaattggcggttcttgatgaaaatgggaagttcttaaccaaagcggttatttatccgcataagccagcgccagaaaagcaacgagccgcagcggaaggcgaatttattgatttgctagagaagtatcatgttgaaatgattgcgatcggtaacgggacagctagccgggaatcagaacaatttgttgcggaagctcttaaaaagatcaaacggccaatctattatgtcatcgtaaatgaagctggtgcctctgtttactctgcaagtaaggaagcgcgtgatgaatttcctgacttgcatgttgaacagcgaagtgcaattagtatcggtcgtcgtttgcaagatccacttgccgaattagtcaagattgatcctcaagcggttggggttggacaataccagcatgatttgccgaagaaagaattgagtggggaactggaaacgattgttgaacgggcggtaaaccgggttggcgttaacctcaatacagctagttaccaattgttgacgcggatttccgggcttaataaaacaattgctaaaaacattgttacctatcgagatgaaaatggccgctacacaaaccggacacagttaaagaaagtgccacggttaggacctaaagcttatcaacaatctgttggtttcttacggattattggtggcgaaaatccattagataacaccgatgttcacccagaaagttatcaggtggcggaaaagattattcaagcggcaggaattaatgtcgatgagttaggaacgccaagtgctgatgataagttaaagaaaattgatgttaagcagttcacggatgatcaagtcgggactgaaaccgttactgatattatttcttccttgcaaaagccaggccgtgacctgcgtgattcaatgcctgctccattattacgccatgatgtaatgacgattgaagaccttaagccggggatgaaacttcaaggaactgtccggaacgttgttgactttggagcctttgttgatatcggtgtcaaacatgatgggttagttcatgtttcaaagatgagtaagcagttcattcgtgatccgcgggcaatggtagccgttggtgatattgtggacgtgtggattgatgatgtcgacttgaagcgtcagcggattcaattaacgatgcttgaaccggagacagtcacaaatgactaatgcagaattacaacaattgaccgaacagtggtcgaaagaatactttgggcgcgaatttacgcacaaggtattttttaataagcggttaaaaacaactggtggacgctatcatttaagtgaccatcatattgatatcaacccgttaatgtatactgagtttgatcttcataatctgcgccaagtggtccttcatgaattgtgtcattatcatttacatctgttaggaatggattatcaccatcgcagtagagaatttaagactttactagcacaggtgggaggatcaagatatgcgccaccgactagtaaaagaaagataaattccaagaaaaaatggcattatatctgtactggttgtggtgttgaattcgcacgacaacggcgttttaacacccaaagatatatttgtcgacgatgtggtcacaaatttattttaaaaaattgaaaaaagttgttgccaacgaataggtatcttgctataataatattcgttggttgatatgcggccgtggcggaactggcagacgcgtaagattaaggatcttatggtcgattatgaccgtggaggttcaagtcctctcggccgcactacttaaaaggcactgagcaatatttgctcagtgccttttttgttttaaaatttttgttcaataaaatttacgtaaattttacctctcctcttgctatcccaatcatgaaagcgctatactttagatgttgtagatagtaatgaggagggatttattcatggatgcagatatcaaatggcttgatgaaccggaaacattccgggttaatcaattacctgcgcatagtgaccattattactacggcaactatgatgaatggcgtcataataatagtcgttttgcgcaaaacttggatggtcaatggcaatttaactttgctgaaaacccgcgtgaacgtgaagaagatttttataagacagattatgatagtagtagttttggaacaatcgaagtccctagtgagattgaactaaataattacgcccaaaataattacattaacactttgattccgtgggaaggtaagatttaccgtcgtcctgcatatgcccttagtcctgatgatgcgcaagagagatcatttagtgatggggatgataatactgttggcgaatacttaaaacgttttgaccttgatccttccttacggggaaagcaggttcgcatccggtttgacggtgtcgagcgtgctatgtatgtttggcttaatggtcactttattggttacgctgaagacagttttaccccctctgaatttgacctgactccttacattcaagatgaaggtaatgttttggctgtggaagttttcaagcatagtaccgcctcatggattgaagatcaagatatgttccgtttttctggaattttccggagtgtaaacctattagcccaaccacttgttcatgttgaagaccttaatattcggccaattgttactgataattatcaggacggtatttttaatgttgaccttcaacttcacggtgaaaagaccgggaacgttaatgtgcgggttatcgacaatgatggtaatacgctcgtcaatgaaacacaccctgttgactccacggtagaagttcgggatcaatttttagaaaatgttcacttatgggataaccatgatccttacctctatcaattgttgattgaaattcgtgatgacgaaggtaatttggtcgaactcgttccataccactttggttttcgtcgaattgaaattaataaagatcatgttgtcttattgaatggtcaacggctaattatcaatggtgttaaccgtcacgaatgggatgctaaacgtggccgtgcgatcacgatggatgatatgacgagtgatattcaaacctttaaggaaaataatattaatgccgttcggacgtgtcactatccagaccaaattccgtggtattacctttgtgatgataacggaatttacatgatggccgaaaataatctggaatcccacgctacctggcagaagatgggagcaattgaaccatcatataacgtccctggttcagttcctcaatggcgtgatgtagtagtagatcgggcacggactaactatgaaacatttaagaaccacccgtcgattttattctggtctttaggtaatgaatcatatgctggcgataatattgtcaaaatgaatgaattctataagaagcatgatgacagtcggcttgttcactatgagggtgtttgtcatactcctgaataccgtgatcggatctcagacgttgaaagctggatgtacttaccacctaaagaagttgaagagtacttgaagaacaatccagacaagccatttatggaatgtgagtacatgcatgatatggggaactctgatggtggaatgggttcgtacatttctttacttgataaatacccacaatactttggtggcttcatttgggactttattgatcaagccctccttgttaaggatccggtaagtgggcaagaagtgatgcgctatggtggtgatttcgatgatcgtcactcagattacgaattctcgggagatggcttgatgtttgctgatcggacaccaaagccagcaatgcaggaggtaagatactactatggcttacacaaataaattacgcgtgatatatggtgatgcgacattaggacttagtggtgacggctttcattatatttttagctatgagcgtggtggactagaatcgcttaagctaaacggtaaagaatggctatatcgtgaaccaatgccgacgttttggcgggcaaccactgataatgaccgaggaagcggctttaatattcggtctgctcagtggttagcagcggacacttttcataagtgtgttgcgattgacctgacagttgataatcaacactttgccgaattacctattgcgccgataaccaatgaatttagtgatccggtatctgctgagaatgtcaagattaagtatacttttgagacgctaacagttccggctacgcaagtcactgtaacttatgaggttaacggacaaggtgagattaaagtgacaatgcactactacggtcataaagacttacctggtctgccagtagtaggaatgcgttttatcatgccaaccgttgctaccggctttgactatcaaggattatccggtgaaacttacccggaccggatggcaggagcgactgagggtaccttccatgttgacggcttaccagttactaagtatctagtccctcaggaaaatggaatgcacatggatactcatgcattaacaattacccgcgattccacccaaaataatgctgatcattctcgggaaccatttagcttaactattaaacaagacgagcaaccatttgccttcagttgtttaccatatacagcggaggaattagaaaatgcaacacacatcgaagagctcccactcgcacgacgaactgttctcgttattgcgggaccgttcgaggtgttgggggaattgatagctggggagcagatgttgaagaacagtatcatattcctgccgaccgtgatgttgagttttcgtttgtattgaatacaaaataagaggttggattatattccatgccgctatgttcgtaaaaagttgtataacaaaggtctctaacacccggtaaatccgaacgttagagacctttttgttttaattaatttgtccagctgcaatcccttggaagtatttcttaatatgagtacagaaataataaaggccataaattgcaagtatgctaagaccaactaatgagatcactaataaggcggtgaaccatttagcttgcttaaagtagagggtaacggtatttttccctttacgttgctgaacgtaaggggcaccaaccgaggatcgctgatagtggcgaagtagatgagcattagccgttaattgtgattcatgatacgtaataattggcaaccgaacttttcccgcttttcctgcttcccatgataattgcaatcctccatgcggcaagacagtatgagtatatttatgggcttcattaataatttgcccttcgtaagcgtaagaacgaacatatttttgattcatgtacttcttagggatcggcaaatagtcaggacttctcttctcaaccatcgttaacaattgaccagggtaaagatcatgaacggaatgtcgcagtgcggccttattttcacttacgcgggtaatcgcgctaaaactattaagaacaatttctgagtcatagcgggctgcacgtttataaacatcaattgttgtaggagtaaagaccagaaaaaccattagcaagaggataccggtgattaattgatttcgtaagtcaatctcttgcgcttttttatcaagggttgtagcgctgatcccaactcctgcgagtaagaggggaaaggcaatgattgtcaatcggttaggaaactgtaaagtgtgtccaagtgcagggaccacatcttggaaaaaggaccaaggagtaagggaagaactaagcaggaggaccaaagaaccaagtaacgtcaggactgtattagtaagcgattttttgaaggtgaataatacgtaaatgagttgaaggataaagagaagccacattgcgtagattagataatcgcgtgtactgctaaacattgaaggcagtagcacattatcggcgaggctaaaatcggcaggatgggcaatattattatggaggttaagcattaataaggctccccaaacattagccgttaaaataatagttccgccgactgccttcagcgtttcgatccacattttcttacggttagtcgttataattaacccaataataaagaacggtgttagtgtaatcacaaaaaataaagaacttagcatatggatctgaatgataatcgtcatcagggtcatcaattgtagccagttgactggtcgttggtgatcctgaatcatacgtacgccgcaaattaccatataaggagccagagcagctccccaggcattcatgttctgtgctaattcccatcgtggaagccacccaatgttcatatagattagggcacagataattgcaaatgtccgtttactatgaacgcggatgctaagttgatacataccgattccacctaatagatagacgataaaggtagtgacgatctgatattgataccaagttcctactacgccgagaatagccccatttaaatatgcaaagagggggccataaacggcattgatgatgcgaccactttgttgaaaactataattactttgaaaatagctaaaattaagctgttgaatttgcttagctgcatcgtaaaaacggttaaagtgaaaaatggagtccgtccctaaaataactccatgtgatacaaactgggggaacatgattaaataggccattgcagcgatggcacagtatggaagcccccaattaattagattagcaattttagatttcataaaattgagaattaaaccaaatcagtttaatttttcctttcctcaaatacttaccttaataattatacggcagaaaagtcgactgtaaaataaccttctgcagctagtttaattgttaagcactagtaaaatgcgctattataagcatagtggcaaaggggagtgaaaaaatggcagaattagtaattgtacgtcatgggcaaagtcaagctaaccgtgataatatttttactggctggactgatgttccgttgactcctaaaggaattgaacagggtgaattagtcggcaaggaattgctaagactgggtatccaatttagtgatgcgtatacgtcttacatggaacgggcaatcatgacgactaatattatcctagaagaaattaatcagttatatattcctgtccataaaacgtggcgactaaacgaacgtcattatggagcattgagtggccggaacaaagatgaagtgaagaaagagattggtgcagaacagcttcataaatggcggcgtggttttaaagatttaccaccacaattaaaagaacgtcagcatgatcaccgctatgatcgcttaggagttaagattccgcttagtgagagtttagaaatgacgctccaacgactcctcccatattggcaagaccatattgcgcctcgtttgattgatggacataatcagttaattgttgcccatggtagttctttgcgggcactaattaaatatttagatggtatttcagataacgatattgataaagtggaagttccaaatggcaagccaattttatatcgctttggtgatcaccttaatgtcattaaaaagacttttataacaatggatggtgaaattgatgacaatacacgaattagcaaataacccaacgttaagcggccaagtacgcttgattgaaaatattgtttatggtgcgatggatggtgaggcattacatatgtcgatcttagcaccgtggacgcaacgtttcccaaaacaatatcaaactgaacctcggccattgattgtctttgttcaaggaagctcgtggcgaaccccaaaaatgggagaagaaattccacaactggttcaatttgttcaggccggttatattgtagcgactgttcaacaccgtagttcaattgatggtcactcatttcctgcgtttttgcaagatgttaagacagccattcgtttcttacgggccaatgcgcaaaaatatgcaattgatccgcaacaggttgcaatttggggtacttcctctggagccaatgcggcaatgctagtcggcttaacgggtgatgatccgcgctataaagttgacctttatcaagacgaatcggatgcagtagatgcggtggttagttgttttgcaccaatggacgtggagaagacgtttgagtatgatgctaatgttccaggaaataagttactgcaatattgcttattggggcctgatgtatcaaagtggccagaaattgaaaagcaaatgagtcccctatatcaagtcaaagatgggcaaaactatccaccatttttattgttccacggagatgctgataaagttgttccatatgaacaaatggaaaaaatgtatatgcggttgaaggataatggaaattctgttgaagcgtaccgggttaagggtgcgaaccatgaacgagatttctggagtccaacaatttataacattgtgcagaagtttcttgacgatcaatttaaataaatttcaataattgtattgacaacttattttttataagttatgattttgacatactaagttaggaggaacacgtcatgtttaacaaacaattaattagcgctactgtttgttgttgtggatcgcgtcttatgcgacccacagtttggcgtgcttacttttagttgagtaactgctaacgtaatcgggaataaatgcataaggcgcaaattcaagtgagaagttcttgagtttgtgccttttttgtattcgtttttgcattctaaaggagatagatattatgaaattcaacacacaattaattcatggcggtaatagtgaagatccaaccactggtgcggtctcaacaccgatttaccgttcatcaacattccatcaacatgttcttggcggtgaacctaaatgggaatattctcgaacaggaaatccaacacgtgcatctcttgaaaaattaatcgcagagcttgaacatgggacagccggctttgcatttgcttctggatctgctgctattcatgctactttttctttattctctcaaggcgatcattttgtagttggtagtgatgtatacgggggaacattccggttaatcaacaaggtattaaaacgctttggccttgaatttactgttgttgacatgcaagaccttgaagcagtcgaaaatgcaattcaagataataccgttgcagtttattttgaaacgccaactaatccgctcttgcaaatcgctgatattaaagcaattgctgatatcgcaaaaaagcatggaataaagacaattgttgataatacctttgctaccccttataaccaacaaccgttaactcttggggcagatattgttgttcactccgcaaccaaatatttaggcggtcatagtgatgttgttgccggattagcagttactaacgatgatgaaattgctgaacaattagcgttcctgcaaaactcaatcggtagtacgcttggtcctgatgatagttggctattacaacggggaatgaaaactctcggtgcccggatgcgagctcaccaagaaaatgcgaatgaagttattaatttcctccaaaacgatgaccatattggaaaaatttattatccaggcttaaaagattttcctggtcatgagattgcggctaagcaaatgcggaactttggagcaatgatctcctttgaacttaaggatggtttagatgcgaaaaagtttgttgaaagtctacaattaattgatcttgccgaaagcttggggggaattgaaagtttgattgaagttccagctgtcatgactcatggatctattccccgggaaatacgattagaaaacggaattaaagatgagttgattcgtctttcagtgggaattgaggaccctgaagatattattgttgacttgcaacaagcacttaaaaaattagattaattatagaagaagggaaactgtgacttatgtgggaaattatcaagacatctttaccacaactcttagcagcgggatttaaatatacgattccgttagcgattatttcatttttctttggactgattattgcactagtaacagctttaattcgtctctctcgtcaacgtggcgcattcatgattcttaaatggattgctagtttttatgtttggctttttcggtcaacaccgctactggttcaattatttattgtattctttggactgccatatctgagaattaagggactcctgccgcatggaataaaattagaaccatttacagccggcattattacattttcacttaatactggtgcttatgcttcagaaacaattcgggcagcgatcagttcagttccaactgggcaatgggaagcaggcgcagctatcggaatgacgcggttgcaaatcttatggcgaattattttaccacaagccttaagagtagctttaccgcccttatcaaacagttttataagtttggtcaaggacacctcattggctgcttcaattacaattatggaaatgtttgctgttagtcaacagattgcggccgaaaactatcaaccattgcttatgtatactttggtagctatggtttatgcggtctttacgacaatcttatcttatttccaaggatatcttgagcgggtagtagaccgtcaagtaaatgcaaataataggtgagaaaaatgaaattaacaaatattaataaaagttttggtaataaaaatgtcttgaaaaataccacgttagagtttcctgaaggtaaaacaacagtaatggttggtccatctggatctggtaaatcaacaattctccgctcacttaacttactggtaatgccagagagcggccagtatgattttgatgatcatcatttggattttagtcaaaaagtaagcaataaagataagttggcaattcgtcaagaaacagggatggttttccaagactacaatctttttcctaataaaactgtccttggtaacattattgagggaccaacacaggttttgaaacagacaaaaaaggaagcaattgcaaatgcgaataatttacttgctaaagtgggcttagcagattacggggaagcctatccgaatgaattatctggtggacaggcacagcgggtagcgattgctcgggcattggcaatgtcaccaaagtatatcttacttgatgaaccaacttctgcccttgatccagaattagaacttagtgtgttgaaggttctattgcaattagctgaagaaaaacaatcaatggtaattgttactcataacatggcctttgcgaaacatgttgcggataagattatttttgtcgagaacggcgaaattttatataatggtactccggatgagttttttgctccagataatccaaataaacgaattaagaactttatcgcctcaatgacaatggaaaatttaaaataaaggaagtttagaataatgaaattttggaagaaagcactattaacaattgcagtcttaatggtcggtacctctgcaggaatcacaagtgtttcggctgcttcatcagctgttaattcagaattagttcataagggagaattgacaattggtcttgagggaacatactccccgtactcttaccgtaaaaataacaaattaactggctttgaagtagaccttggtaaagcagttgctaaaaagatgggcttaaaagctaactttgtaccaactaaatgggattcactaattgccggtcttggttcaggtaagtttgatgtagtaatgaacaatattacacagacaccagaacgagccaagcaatataatttctctactccatatatcaagtcacggtttgcattaattgttcctactgatagtaatatcaagagcttgaaggatattaaaggcaagaagattattgctggtacgggaactaataatgcgaatgtggttaaaaaatataaaggcagccttacaccaaatggcgattttgctagttccttagatatgatcaagcaaggtcgggctaccgggacggttaactcccgtgaagcttggtacgcttacagcaagaagaacagtactaagggtctcaagatgattgatgtttctagtgaacaagatccagctaagatttcagcactttttaacaagaaagatactgctattcaatcttcctacaacaaggcacttaaggaacttcaacaagatggaacagtcaagaagctatctgaaaagtacttcggtgcagatattactgaataattaaaaaagatctccaacgtctgtgtgttacagtgttagagatcttttttgaagggactgtgacataagttaggttacttccataaaatacgaacagcgcagtacaacaatggccttcagcgtccggcaaagtcgaacgctgaaggcctattgttgcttgcgggggctcgaaaacgaagtcacaagtgacttctgtcttgctcccttttcacaaattaatgttaaattattatgctaaagttcccattggatcccaaggcttaagaacgactgggctcttagcgtaatcacgtttaagatcttcgctaaggtacttcttattaataacgacttggtagcagtacttgtccatccaatcgtcactcataacgaagtaacctttatggccgaccttgttaccccatgagttttcaactttccacttggttggcttaccatctacaaggtcaacaccagtgataaccattgcgtgatccatcatgctttcaccataatcaagtgcttcagctttggtcatttcaagatcaacgtcaaatagtttgtcgtagtcataggtgttaagggccataatcccaagtttagtttctgaatatttaataacatctgaaccaaaccaaacactttcgccattctttaattgttcaatcgcaagctgcttgaattcatccattggtaggtttaagtgcttgatttcgcggccaccaacgacattaccaagcatatcgatggtgtaagtttggtggtacttcttatcagcagttggtgcttggatgattgaaatataatcatcaagattccagccaacatacttcttgaagaattcttgtggggtaaggttagtatcgcggtggaattcgttgtccttctttgtccgatattcgaagtcaaagtgactaaccggttcaccaaatgtgtaagcaagcatccggtaattctcgttcaacatcttccggcgcgtttcgttaattgcttcttcatttgcatgatcttcgttaatcatttttcgcaaaataacggcatcgtgacgaagcttgttgtttaagacttcatcaattccccgtgagttagaagagttaaatgattcgggcattgcggcttttggcataaccccatacttgctgataagggcgcaaagcatatcccattggccaccatcgttttgtggttcgttcattaaccatgaaacttttcggctgtcggtaggctttttagcagtcttaattacgttttggtagaagtaattagatttttcaaacttatcccagaagaactggtaggcttgggaaagttcaaaattatcaggtaagttaaatttttgctgcatatcatgacgcattgtgttcagtgctgcaaacatccaacaacgaccggattgtttttgatcagcaacgtcccccgtcttgaggtcaatagagaaatgaggagtattatcagcaattgaatgccaattaaagcttgcattccgtaccccgtttttggtaacagtattttctaagacactgctgttagggtgatgacggtagtttttatgaaaactagcgatatcttctttgttaattgaaaagctcatttgcaatatctcctttgaatagattgaattaacgggcgtgcaatacctttggaccttctggagtaccaacaattacgtcgttaactcgatttaagaataaaccagtttcgacaatcccaaccatgtggatcaattcatcggctaaggccttcggatcgtcaatttcgccaaggtgaaggtcaataatatagttattttcatcagtacggaactttttatctccgtccatccgccaagttggcttgtagcctttcttttcaagaaggtcaaagacatgttgggaaccaaatgggattacttcaaccggaagagggaaagcaccaagtttatggacgagtttgctttcgtcgacaatccacattactttatttgaggcattggcaacgatcttttcccaaagaagggcaccaccgccacctttgataccttggaagtcatcactgatttcatcggccccgtcaatagttaaatcgatgtggtcaacgtcatcaatatctttaattgtaattccgaggtcgcgtgcttgcttagcagttcggtttgaagtcgttacaccgatgatatctttgattttaccttcttggacttgcttaccaagctcatcaaccatatatttaacggttgatccagttccaagaccgacaatcatcccagatttaatgtacttaactgattccttacctgtttgttcttttaatgcattttgatccattaatattccccctaattaaagcgatctgcaactggcaatagttgctgatattctggatgtagtttgaattgcgctaccgcatatggacacatgagcttgacaatgtattgttcttttgttgcataatccacaaattgacgtactaattcagctgcaattccttgcccacggtaagttggttgcacaaaaacgcgttcaacgacaacgtgatcatttgtatctggaacttttggaaaactgatctcgccaactaaaggttcttgatcgtcaaaagcaatgatccgctgaccatcaactcgatattgcatataaacacatcctttcataataattttcgataaactgcttttaaaagtcaagttatcaaagcgataccattaatttattatctagcatataatagtatactggaattattaagaataaaacactatgaggtgaacgtaatgaaacgtggatttaagattgtttctagtaagaaaggccaagatatacatttaccccaacggcaaacaactcgggcggccggatatgattttgaggcatcagaagattttattctgccatcaatttggaaaggcaatttcttgaaggcgctatggcaaatccatcaacaaaaaaagctaattgatgaagaatttaaggctgctgattcctgcttaaagccatacttagtacccaccggcatcaaagcctatatgcaacctgatgaatttcttttattagctaaccgatcaagtggtccttttaaacgccgcttgattctaccaaatggaatcggcattgtggatgcagattattatgataatgatagtaatgaaggtgaaatcttcttccaacttattaactatgggctgcgggattatcatataaaaaagggagaacggatcggtcaggggatttttatgccatatttaatcgctgatggtgaagaacaaccaaccgctaaacggactggtggattcggttcaacaaaagaataaataaacttagagaggaattaaagcgatggcaaaaattcgaacacaatatgtttgccaaaactgtggttacaactcaccacgctacttaggccggtgtccaaattgtggtgagtggaatactttagtggaagaacaggtagagaccagttctgcaccaaccaaaaaagcaactaccaccttaaccggcttagttgccaaaccacagaaaattaatgagattgatagtacagagactccccgtgttaaaacaaaattgaatgagttaaatcgcgttttaggtggaggaatcgttcccggatcactaattctaattggtggggatcctggaatcgggaaatccaccctccttttacaagtttctggacaattaagtgatgagcatcaccgggttttatatgtgtctggagaagaaagtgggacacaaattaaaatgcgggcggaacggttgaaagttgctggggatgacttttatgtatatccagaaacgaatatggatagtattcgggatactattcgtgacctcaagccagagtatgtcgtgattgactcggtacaaacgatgcaggcgactgatgtaagttcagcaattggtagtgtatcgcaaattcgtgaagttaccgcccagttaatgcagattgctaaaagtaataacattacgatttttgtcgttggacatgtgacaaagggcggtgcaatcgctggtccaaagatcttggagcacatggttgatacagtcttgtattttgaaggagacctgcaccatacatatcgtattttgcgatcagtgaaaaatcgatttggttcaactaacgagcttggtatttttgaaatgcatacaaatgggctgacggaagtaaaaaatccatcagaaatctttttagaggaacgattacatgatgcaaccggttcagcggtggttgtttcattagaaggaacgcgaccaattttggttgaaattcaagcgctggtaacaccgaccgtttatgggaatgcacagcgaactgctaccggtttgagccgaaaccgagtatcattgataatggcggtattagagaaacgtgctaacctaatgcttcaaaatcaagatgcttacttaaaagcagctgggggcgttaagttagatgagccagcaattgatttggcaattgcagtaagtattgcctccaattatcgggataaaggaaccaagcccaccgatgcatttgtcggtgaagtaggtttgactggggaaattcgccgggtaaaccgcattgaacagcgggttgctgaagcagaaaaacttggctttaaacgaatctttattcccaaaaataatttaaagggttggaaaccatcaactaatattcaagtagtcggtgtctcaacgcttaaagaggcgttatatttagcgctggggtaaaataaataattgaaaggatgaagcaaatgcggcgtagaatgattactctcatttatattctagttggcgcggcagtgggattttactatttgccattattatgggggattttgaacatcgctcttaatccggcattattagtatttatcgacattattattggtgcacttattttctggctattatccctcccattggttagcggcactgaaaagttgatccagcgaatcgaaaaagaactaaccaagcgtagtcctgtataccttttctttgggactttattaacgattattggcttagttttagcagttcttatttcgattccattgtggagaacgaggattccggtaattaataatattctgccgatccttctaatgattgtctttagttattttggttttcgaattggtacgacgcggttagatgattggcgtaaagcatttacccatgccaaaagtagtaaaaccgatggtggtaatgtgattgaacggcaagatgataattatcaccattataaaatcctagatacaaatattctgattgatggacgcatttatgatttagtcaaaacgggttttctagagggaacattactggttcctaactttgttttatatgaattgcaatatatcgctgattctggcgaaagtattaagcgtgttcgtgggcgccgtggccttgatattttaaacaagttacggaaagaaaaaattgttccaatcgaaatgtatgatggagactttgaagatattccagaggttgatagtaaattaattgccctcgctaaagaagtcaatggggtaattgtgacaaatgattataaccttaataaagtaattcaattccaaaatgttcaagtattgaatattaataacttagcgaaatcattacgaccacgagttattccgggcgaaacgatgacggttgttgttgtgaaaaaaggaactgaacgacaacagggtgttgcttatcttgacgatggaacgatggtggttgttgaagatgggcgttactttatggataaacaaattgaagttgaagtaactagtgctcttcaaacagacgctggtcgaatgatctttgctcgtccgcttcattcacaacgaggaattgacgagcatacggatacggaacataaagaaaaccgaaataataaagataagaaaaaataacaaagaatggctgtgaagaagaaatagagttttcttgcttccggctattttttaaaataaaaaaagaagcagctcgggaaaaagctgcttcttagggagtattacgataatcttgggggagatttcgtaaaaaagaaaatatttttttcggttactattgggaggagtaattgaaaaataataggtttcattgatgtagtaaagttcatctttactacgatatatataatagcagtagaatgtgaagaaagtatgaccaaatgttaaataattttttggatacaaattaatattatcagaaatgctattctaatacggaatgtggtaagattaactgtacaaattaattctttattaatgatttttaaggagcggatagacatgctaacaatttacaatacgttaacaagaaaaaaagaagaatttaagccattgcatccaggcgttgttaacatgtatgtctgtggtccgacggtttataattacattcatattggaaatgcgcgcagtgcgattgcctttgatacagtccgacgttaccttgaattcaaagggtataaagtaaattatgtttctaactttacagacgttgacgataaaatgattaaggcggctgccgagcaagggattaccgttccacaattagcagagaagtatatcaatgcttttatggaagataccgcagcaattaatattgagccggctactcttcatccccgggcaacggaaaacattaccgagatcattaagttcgtgcaaggattagtagaaaaaggatatgcctaccctaaagatggggatgtttattatcgcgcacgaaagtttaaccactatggacagctttctggacaatcacttgatgatcttgaagttggggcaagtgaacatgttagtgcagatgaggttaataagaaggaagatccacttgattttgctttatggaaagcagctaagcccggcgaaattagttgggattcaccatggggaaaaggtcgtccaggatggcatatcgaatgttcagtgatgtctactaagtacttgggcaagacaattgatattcatgcagggggacaagaccttgaattccctcaccatgaaaatgagattgctcaaagtgaagcagaaacaggccaaaaatttgttcgttactggatgcataatggtttcgtaacaattggaaaagacaacgagaagatgagtaagtctctccataatttcattactgttcatgaaattatcaaggaagtagatcctcgggttttacgtttctttatggcgactactcaataccgacgtccaattcaatatagtcaggcaaacttaactgatgcgcaaaataatcttaatcatattcaaacagcctttgataacttgacttatcgtgaacaagatgccgataagggagaggttcaagaagtcactgatcggcttgatcaatttcatcaccaatttattacagcgatggatgatgacatcaatgtccaaaatgggattgctacagtctatgaattagttaaatatgcaaatgtttatgctcaacaagacagtgtgagcttaggtgctcttcatgcaatcaaaaaagaacttgttgaattgatgagtatttttggcgttaagcttgaagcaagtgacaatcaaattaatgatgaaaagatcaagcaattgattgaagaacgaaatgtagcacggaagaataaagattttgcgcgaagtgatgaaattcgagacaaccttaagaaacaaggaattattcttgaagatactcctcaaggaacgcgttacaaaaaggaatagaaaggatccttatggtacaagcagattatcgacaacttaatggaattgctttggcttatttaggggatgcagcttatgaggtttacattcgtcagcatcttttaaccaagggaattagtaagccaacgaaactacaacatattgctacccactatgtttcggcaaaagcacaggcggctcttattgacttgatgaaagaagacgagttactgtctgatgaagaatggtcgtattttaaacgtgggcgaaatgctaacagtcatactcacgctaagaatacatcagttatgacttatcggatttctaccggatttgaagcggtaatgggttacctcaaattagctggtaaagaagagcgattggctgaattagcgcaatggtgtatcgaacaagtagaagcggggcgaacagcacatgaaaaatgagaatacggattttattattggccgacatccagctgtgatggcactaaaatctgaccaagagatcaataaagtttttattcagtcggggttaaaggccgatgctatttcccagattgttaaattagcgaaggaacgccacttagtagtatcgaatgttcctaagaataaattggacttgatgactgaccgacaaaatcaccagggggttgtgttagctgtagcagcataccaatatgcaactattgatgacctctttgataacgcggctaagcatgacgaagatccatttttccttattcttgatgaactagaggatccgcataatttaggttcaatcatgcgaactgctgatgccgctggtgttcatggtattattattccacgccggcgagcagtaggattaacttcagtggttgccaaaacatctacgggagcaattgaacatgtaccagttgcccgagtaacaaacctggttcaaactgctaaagaattgcaagaacgcggtgtttggctgtttggtactgatatgaaaggaaaagattaccgaacatgggatgcgcatggtgccgtcgctttggttatcggcaatgaaggtaaaggaatttcatccttgctaaagaaaacttgtgatgaaatgctaacaattccaatggttgggcatgttcaaagtttaaatgcgagtgtggcggcaagtttgttgatctaccaaggctttaactctcgtcatcctttaaaataattttgattttattgcttttaaaccttgattcgtgctaacctaagtactgtgtggaggtgataagtatgtcccagaaaaaagtagcattggaatgtacaaagtgcggtgcgcgtaattatacgattaccgctaaccctcaacgacaagaacgattagaattacgtaagttctgtaaacattgcggtgagtatactattcatcgtgaaagcagatagtggaggaaaatatgcacttaattcgatttattaagagtgttaaccacgaaatgaagctagttgtatggccaacagctaaagagaatcgtcgtgatacgactattgttgtttcattgactctgttcttcgtactattctttgctctgtttgattggttaattcaattaatgatgaaactctttgtttaacattagtagtcaaatagaaattagtttgttatactaaatctaagggaacttcgtagctattacgaagttttttattttactgaaaaatgatttgaattatgataggaggattcatcgtggaatcacatgaaaaacgttggtatgtgctccatacctactctggttacgaaaaccgggttaaaagtaacttggaatcacgggctcaatcaatgggaatggaagactacatttttcgcgtagttgttcctgaagaagaagttcgccaggttaaggacggtcaagcaaaagaaacaattgaaaagacattcccaggctatgttttggttgaaatggtaatgactgaccaagcttggtacattgctcgtaatactcccggcgtaactggtttcttaggatctcacggtggtggttccaaaccaaccccattgcttcctgaagaagttgatcggattatgaaacggatgggaaccgaaacaactgttagtgacattgatgttaaggaaggcgatactgtaaaagttattgcgggatcctttgcaaatatgactgccaaggttgtagaagttgatcacgaaaagcaaaagattaaggcgactgttgaaatgttcggtcgtgaaacggctgctgaattaggctttgatcagattgatacattttagttaatttaatattttgaaaattgttgaaataaattgagaattgtggtatgttttctaagtatgctattaacatactgtgggagaggtaaaacttactgcctcatcatgaccacaacacggactaaggaggttttgtctcgtggcaaagaaagtagctaacattgtcaagttgcaaattcctgccggtgccgctacaccagctccaccagtaggtcctgcacttggacaagcaggtattaatattatgggcttcactaaggaattcaacgcacggactgcagaccaaaagggtatgttgatcccagttgtaattactgtatatgaggaccgttcattcgacttcattactaagacgccacctgctgctgtcttactaaagaaggccgctggtgttgaacatggttccggtgaacctaacacaaaaaaggttgcttcagtaacgaaggaccaagttaaggaaatcgctgaaactaagatgcaagatctaaacgcagctgacgtagaagcagctatgcgcatgattgaaggtactgctcgtagcatgggcttcactgttgaagactaattactagcagtcgggatgcgctatgaaaatagtgcacccacgtgggaggtataactccgttagaccacatttgcaaggaggaaaacacaagatggctaaaaaacgtggtaagaagtaccaagacgcgctcaagaaagttgacagcaagaaagaatacgctgttaaagacgctgtccaattagtaaaagatattgcctacgctaacttcgactctactatcgaagtagcatttaacttaaacgttgatacaaagcaagctgaccaacaattacgtggtgccgttgttttaccaaacggtactggtaaggatcaaacagttattgttttcgctaatggtgaaaatgctaaggctgctcaagaagctggtgctgactttgttggcgacgatgatttagtagaaaagattcaagacggttggcttgactttgatgttgcaatcgcaacaccagacatgatgcctaaagtaggtcgtttaggacgtgtccttggacctaagggcttaatgccaaaccctaagactggtactgttacgatggatgtagccaaggctgtttctgatgccaaggctggtcaagtaacttaccggactgaccgtgatggtaacgttgctgtaccattcggtaaggtttcatttgatactgacaagttagttgaaaacttggctactttagaagacattgtagctaaggctcgtccagcttcagtacgtggaacatacatcaagcacgcttccatttcttcaacatttggaccaagtgttacgcttgatttaactacattttaatttaaattagttaaaatgaaaaaagactttgagatttttgctcaaagtctttttttgtttcaatttttacttcacaatagagatttgttgtgctatattattaatcaatgataaaaagattaaaaaataattagattttatcatttgagtttaaaattaattaaggagtgacgacaatgacacaatttaaatattcaaagcgtgttccagcagatggtacggatgcggttggtgcaattttacaagcagcggcggatcctaagattatttcatttgctgggggattgccggcacccgaattgtttcctgttaaagaaatgaaagcagctgttgataaggtttttgaagaacacggtcaagaagcgatgcagtatggggcagcgaagggagttacagctttacgtgaagttatccaacaacatgtaaagaaaaaagaaaatgtggattccgaattagacaatgttttagtaacaacgggatcagaacaagccttagatttagtgggcaaggcatttgttgacccgggtgatactgtattagttgaacagccaacgtacctctgtgctttagatgtttttcgttcttacggtgctaattttgcgagtgttgagatggacgaagatgggatgaagatggatgctttagaagaagcactaaaggctaatccaaatactaagctcatctatactgtgccaaacttccaaaatccaactggacgaacaatgactgaagaacgacgaaagcagttagctgaattagcagaaaaatacgatgtatatgtactagaagataatccatatggtgaaattcgttttgctggtcaacatgtaccagcagttaagtcatttgataaatcaggtcatgtcctttacatgagtacattctcaaagacgttagccccaggatttcgtctaggatggttggttgctgataaaaatgtagttaataaattgacggttcttaagcaatcagctgatctccatacagataacttagctcaattcgcggttgcccaattctttgccgataacgatgtggatgcccacgttaaagaaattagtgctttatacggcaaacgtaaagatttgatgcttgagggaattaaaaagtatttcccagaaggagttaaatatacggatcctgaaggtggcatgttcttgtgggtagaagttcctggtgttgatgatacagtagagttatttaaggaatgtcttgaacatgatgtagcctttgttccaggtgatccgttctttgccgatggagttcaacctggtgctttccgtttgaactattcaaatatgaaagaagaccagatcgaagttggtttgaaacgtttaggagcggccttaacagctgcagttaataagtaattatttcagccattaataaatacaatcctaataaaatttcgaatttaaatacttaagggagcgaggcagaagagctctcgtaaacaataataggcctctatcgcttgaaattaccaggcgttagaggcctttatattgcactatttgtcttatgtggacgtaatctgacatatgtccattccttttttagtcattaaaatgtagtaggttaatatactccctctgtactttgagttaattgtgattataattatattaattgctgaaaagttttaaatattcgggtttcttgctatctaattgggatagtaataagcattatcaaaaatttttaagggaaaaggagtttttgatagtgtcaatgatagatttcactaatacagaaatggcagtagccgttatctttactttaataataatgtttgtaatatcctttgcagttagttttttattttggttgatttaccaccaaaatatgaaaaaaggataattagagatgataattataatttttacgcttatttgggggatcgcgctgtttatatttttagtttattcattgattagtctgctatttcggatgatttcgtatcctcgggactttcattacttcgcgggaaaccaacaaccagctaaaattgactacaatttacaatattataatattatgttattgttccatgttttaatgaggcagcagttattcaacgaacaatcaaatgtttgttgcgatttaagcaatttgaaatagtggtagtagacgatgctagtagtgacaattcagttagtcagattactaactcgcatatccaccttttgcgacggcatcttcctaatgcccatacaggcaagggggatgtattgaattttgccctagattatatttgtcagatcactatccgacagagggtttcttttgaaaaggttattattggcgtagtggatgcggatgcccaattagttgataatgccctacagcgattaaatgcctatttttcctcaccaaggacgaatattacccaaatgcgagttaaaatgtatccacattttaaaaattggttgcagattttacaagatattgagttttttagtattaactatatggcccaaattatgcgaatgtatactaaaacagttggtttaagtgggaatggccagttctttcgacttaaaccaactattgataaaattagtgcgcatccatggggtaatgcgctcttagatgattacgaactaacgataaaaatgatgctgaaaaaattgcatgttgattatatgacagatacatatgtttaccaggaagcgttaacgtcccctaaaagatttgttcgacaacgaagccggtgggtacaaggcgatttaaattgtcttaagtatcttcccgagattattaaaagccgcattttaagcaggacacagaaacttggtatatattatttcctgcttcaaccatggcttgattttcttgcagacgttgcgattattattttaacgacgattgcccttactcattggtacaatttttatggccacttgactcttttgactttttcattagtgatggccggcttggtagtcttttcgttattttggagaataatatttggaatattttactatcgtgacttagctcactatcacgaacctcctttaaaaaaaacaccaattggccttattaccgcttggaatttcctatatgtatgttatcttatttttagtattataatggcttattggcggtggagttttcgccaaaattcgtggataaaaacggaacatggaaaaatgtttcttgaatagcggggagatatgatgagaaagattaaagtaatgacggtatttggaactcggccagagggaatcaaaatgaggccagtagtcaaggccttggagcaggatgatcgcttttcatcggtagttgtttcgaccggtcagcatgctgaaatgcttcaacaggttttagctgtttttaaaataacacctgattatgatttgaaaataatgcgtcctggacaaactttaacggaaattacaattgaaacgatgacgaagcttgaaccgattattcaaaaagagcaaccagatattgtgctagttcatggcgatactagttcagcctatgcatcagctttggttgccttttataatcgggttgctattggtcatgtcgaagctggtttgcgaacctgggataaatattcgccttatccagaagagatgaaccggcaaatgattgatgatcttgctgatttatattttgctcccacccaaacaagtgctaacaatctcaaaatgggaaatcatcagcatgggattatagtgacgggaaatactgccattgatgctttgcagtatacgattgaccattcgtatcatcaccaagtattagacgaaattgatcccgacaagaagattattttacttactatgcatcggcgagaaaattggggtaaaccgatggaagaaacctttaaggcgattaaagagattgtggatcaacggaatgatattgacgttatttacccggttcatctgaatcctaaagttcaagcggttgctaataaaatttttggaaacgataatcattttcatttgatttccccattagatgttgttgattttcataatattatgagtaagtctttacttgtgatgagtgattcgggtggggttcaagaggaagcaccagcacttcataaaccagttctagttttgcgtgatactacagagcggccggaaggagtaactgctggaactcttaagttaatcggtacgcaacttaataatgtaatgaaagagttatcgtccctattaaatagtcctgaagaatataataagatgagtgaggcacagaatccttatggggatgggcatgcaagcgaacgaattatagatgctattgctaaatgggcagcaactcaaaaagaattataaaaagtccctttacagaacttcagagaatatgttaaactgtaacagttgattaaatatgactctgcctaagactcaggtggcgaaagccttaatcaaatgcctgccgaggaagaaatgaaagttccttctctatgtctgcggtcatagggatttttttataaatccgatcaaaaaaacattgcaggaggtgaaaattcatgagtgaagcagctattgctaagaaagctgaaatcgttaagcaaactactgatatgcttaacgcagctcaaagtgctatcgttgtagattaccgtggtttaactgttgcggaagttactgacttacgtaagcaacttcgtgatgctggtatccaaatgtcagttatcaagaacaagattcttgatcgtgctgttgaaggtactgactacgaagatcttcgttctacttttgttggaccaactgctgttgccttctctgacgaagacccaattgctccagctaagatcttgaagaagttcgctgatgaccacgacgctcttgaaatcaagggtggtttcatcgaaaagagtgttaagactcttgacgaaatcaacgaatacgcaaatatgccaggtcgcgaagaactgttgtcaatgcttgcatctgcattgcaagatccaatgcggaagattgctcgcgcagtcaaggctattgccgacaaggaagacaaagccgcataattgccgtatatcaatacaatataaaattaaaattaattacctaaatattggaggaaataaacatggcttttgataaggatgctatcattgcttcattaaaggaagcatcaatctctgaccttaacgacttagttaaggctatcgaagaagaattcgacgtttctgctgctgctccagttgcagttgcaggtgctgctggtggcgacgctgctgctaaggacagcttcactgtagaattaactgaaccaggttcagctaaggttaaggttattaaggctgttaaggacattactggtcttggtcttaaggacgctaaggaccttgttgatggtgctccatcagctatcaaggaagacgttaaggaagacgaagctaacgacatcaaggaaaagcttgaagccgccggtgctactgttacccttaagtagtcttaaattattaaataaaaaagagttacgaaaatattgttttcgtaactcttttttatttcagggataccatatgaggtgttcttttgtaatacgaaaatagctcccaccatttattctaaataaggagctattttatgatgtgtgcaaaattttagaagaacaggaaagttaaaagtaaataaatctactttgcaggatgagtagtactatcattgcttgtgcggtaaccaaagtagaattgaatagcagcaatagcgatgttaacccagttcatagcaataaaccaaccgttaattgcgcttgcatcatgagatacaccataataaacccaaaaaccgataacaattgcacaaatattgatccaagcgaaagtcttttgtagaatttgattattaagttggaaccacatccaaatgacattaatgacaaaacaaattgccaagatccaaaaaataacattaaataacataagatatccctccttagggcctcgataaacattaataaacgcgtattgaactgatgaatagcaacattcgaaaaaagtattacgcggtgtggttagcagttgaagttatttacaatgattggtaatactttactaattttgggaaagttgttgcttagcatcttcatacccgtcaacatagtcacgaagagcatgcatcttacctttaataaacttattggtgacattaataattcgttgtggatacttcctgaaaggttctagagccttataatccttaactacttgatcataacctttttggtatgcatttgttgcaccattttggctatttgacgtaggacaatttttttgaacatctttatcacctcttttgttgtcctaccatgatagtaacaagtatacaaactcaattccaatgatatggtataaaaattaaaatattatgcattaataaaaatactggttagaaacttttaaccagcatttttattaatctttattctttttcagaagttcagtaatttctttgaggtacataacttcttcgctaggagtatcttttttgttatcttcttttttgcggaatgtattgattgcttttaccattaagaaaacaacaaaggagataatcaggaagttaatgactgcatttaggaaacttccgtatttaaactgagcatcgccgaccgtcaaaacaagattagataggtcaattcgaccaatgaataaaccaataagggggttaataaggttattaactaatgattttacgattgaggtaaaagctgcaccaacaattatcccaactgccatgtcaataacgttaccacgagcaatgaatgttttgaattcttttaacataaaatagacctccttctagctctagaggggaacaacttcaattatgattatatcaaacagaattaaatgcttagggcttttatgagatgacataaggagatttaatttatttttaaataataattgcatattatatcaaaccattatattatatgacatataatattacagctaaaaaggagggatagaatgaagattcaaattacagctgacttactcgatgggatggtcttagcaattcttgaacacaaagattactatgggtatgccttaactcagcgaatgcaatcagctattaccatttccgaatcaacaatgtatcccgttttacgccggttaaaaaaagacggttatttaataacttatgatcagccttaccaggggcgaaatcgccgttattatcaaattacggaagccggcaaggagcatttacaacgtattcgtaagttatggactgattataaaaatagtttagatggtattttttatgggttaggtgagggagaagataaagatgaatgaacgtcaaaaatacattaatgatttatcaatatatttaagacaattaactgatgaggaacgaaatgatgccttagaattttatgatgaatatattgccgatgctgggctggagacccgaacagcgattgaagaaaggttaggaacgccacgacagttaagtcataagatattagccgattattccattaaagctaataatgagtcgatcaaagaaggacaccctgcttcgcctcattctagttggcgtgtcttttggtgggtgctagtagcaattattacttccccaataacgtttgggctaggaattgccgtattggcactattgttggcagcagggggagtcgccttaagtttgattgttggaatagttgctttaatttttggggttgctgccatagcgatcgtatctatttatattggaattggtttaattgcaacaaacctgtttagcggactattttattttggcttaggattgacactgatcggcttattccttgtttgtttacctttaatttactggttaatcagagttattgttcaagggattgcgaactttgctaagttcatttatgcaaaagtgcaggcaaggaggaaaaagtaaatgaaaaaagtatttaaggtgggagtaattgttttaatcttaggagtaatcctcctcggaataggcttctttaataatggtaacaaggctgtttattttgagaacaatcgtccagcaatttttcattctcacactaaaacaataagtactaataaagcttttgaacggattgatatctcagcatcgacagctaatgtaatagttcgtgaaggcaaaaaatatcaaattacttattctggtataagcaagcattctccggccgtaactgttcataataacgttgcttcaattcgccaaactggtggctttccgcttgtctttaactttaatgattatcagccccaccaagatttaatcattgtgactatcccacatgatcaagccatagctggtcgtattcatttagagagtggtgatctaacagtttctcaagttaaaatggacaatattgatgttaacagtgatgcaggcgaggttgaataccgtcaagttacattacgtggaggaagtacaaaactctcgtcaggtaacttcacaggacatgatttaacagttcaaggacaatatactgttaataatcaatctggtgataatacggtcacaaacacaactgttgatggctacttcctaaagactgatgcaggtgataatgaacttaatggtgaagataagggtgaagaacccttacatcagaatgatgatgcagaaaatgtgctccgcttgataacgcaatctggtgataatgaagtgaattaaggtaactaagattaataaaagcccctcgatatctagaaattagatgtcgaggggctttttaataggagaaaagtcttaatttttaattatgcgctggattatttttcttcaacgccagtaccatcgtagcaacgttcaagtaattccttgagttggctaacaagtggttcaactgggttagtagtagtacattgatcttcgtaagctaagcgagcaagatcgtcaactactttatcaaattcttcacgtgtaacgccattgtccttaagactaagcttaacaccacattcgtgagcaagttcgataactttcttagcatatgcttcagctaattcttcatcagtgttgcctttcaaaccaatgaaccgtgcaatgtcagcgtagtccttagttgcatggtaagtctcatagtgaggccagagagcaagcttttgtggacgttttgcgttaaagcgaattacttgtggcattgcaatagcgataagcaaaccgtgaggaagaccgaatgctccacccatcttgtgggcaagagagtggttaattcctaagaaggcttgaccaaatgccataccggccattgttgagaagtcgtgcatcttacgacgagctaacttgtcaccttgaactgacttaggaaggttttccataacacccttgatggtttgtagtgaccaaccacgagtgtaatcagttgccataacagaaacatatgattcagtagcgtgacataaaacatctagtccagtccatgcagtagtttttgctgggacagtttcaacgaattgtgagtcaacaatcgcaatgtttggagttaaggcgtagtcagcaagtgggtacttaacatgagtttctgaatcggtaataaccgcaaatggagtaacctctgaaccagtacctgatgtagtaggaatcccaataagttgagacttagtaggcttcttgatttggtaagcacgcttccgaatatcaagatacttttgcataaccccataccatgaagtttctgggtgctcatagaacatccacatagccttggcagcatccattggtgaaccaccaccaagagcaataattgtatcaggtttgaagtcgttcatcatggcaacacctttttcaacagtgtttgttgatggatcttcttcaacgtcatcaaatactaagaaagcagtgttgttttgacgttgacgcaattgatcgataacacgttgaacgtaaccacgcttgctcattccaggaccagtaacgataaatgctcggttaatgtttggaatatcttgcaattcttttagtgagttgcgttgaaagtatacttttgggggaatcttaacccattgacggttttcacgccgctttgcaattgttttgatgtttaagagatcccaatcagtaacgttgtgagaaattgagttaccaccgtatgaaccggtacctaaagtaagtgatggtgtcatgttgttgtaaatgttaccaataccaccgataccagatggagagttaacaatgatccgtgaagcacgcatttcaagaccgtacttagttgctaaatcatcatcaagggtatgaatagcagcagtgtgaccttcaccaccatagtgtaataattgagcacaaatatcaaaggcattttcatgtgaagtagccttgtacattgttaatactggtgaaagcttttcagctgaaagtgggtacttgtcaccaaccccttcatattcagcgatgataaccttagtgttttcaggaactttaattccacacatattagcgatggcgttagctgaacgaccagcaattggtccacgaacttggtgacgcttaggatcaatgaagccttcagtgaacttatcaatttcatttggcttcaagaagtaacagttccatttttggaattcttcttttaccttgtcgtagatttcttcatcaacaacaactgagttttcagtagcacagatcattccgttatcaaaagtcttagaaagaacgatatcgtaaacagaacgttcaatattagcagtcttttcaatgtaagctggaccgttaccaggaccaacaccaagagcagggttacctgaactgtaggcagccttaactaatgaaggaccaccagttgctaaaatagtagcagtcttagggtgttgtaacaatgcacttgtattttcgcggctactttcaggaagccactgaatcatgttctttggtgcaccggccttttccgcagcttcttgtaaaatcttagctgttttaatggaagatttcatggcttgacggtggaatgagaagataattgtattccgcgtcttagcactaatgattgatttgaagatcgttgttgaagtagggttagtaactggaacgatacctgcaataataccaagcggatcagcaatagtgatggtttggttttcatcgttgtcttcgatgattccgacagtcttatcatgacggatgttgttccaaatgtattcacttgcgtagatgttcttgatagccttatcttcggcaaccccacgaccagtttcttcagctgcatcaatagctaagtccatgtggtgttcttcagcagctaaggccatggcttgacaaattttatcaacttgttcttgtgagtagtaacgtaattgttcaaaagctgcttcacttttggcaattatgtcattaactaatttttgcgcattttgctttttttcttcttcagttaatacgtttttttcaacttgttttttgttgttagcaggcataattgaaatctcctttttcaattcttttctttgttaacatttgaacatgtataatattactacatttttttgctttgtaaatacccttgtgaacatttaaacaatggttgctttgtatgaattcgcttacaatattgtcttcataatacttgtatagcaacaaaaaacattggtattatttttgagattaagagatgatagatttgtatactgttattaattgaagtctgtttcacaaatagaatataaaagcgaatatattaatttaactcggctagttattaagttaactaatcattaacagattattattgggaataataaaaaagccaccattcagaaatggtagcttttttattaatcgcgggcattaatgtcttttcccgcgtttggatctttaacgtcataatcactatcattcattgcttcaacggcacccatgcgatacccattgccgacttggctaaaaaaatcatggttagaagttgaagtagaaattccattcataacaactgggttaacatcagaagcggtatcagggaatagtggatcttgaccaaggttcatcaatgccttattagcgttgtaacggatgaaggttaaaacatcatctgtccaaccaacttgatcataaagaagatgagtgtatttttcttcattatcgtatagttcataaaggaaattgtacatccaatctttcatatcttgttgttgcttttctgttcgatcacgtaagccgacttggaacttgtatccaatatatgtcccgtgaactgattcgtcccgtaaaattagcttgataatttcagccacgttatttaatttattgtggccaaggtaataaaggggagtgtagaaaccagaatagaataagaaagtttcaaggaaaacattggctactttctttttgagcggatcttgacttggatcaaggtacatatttgcaattttgacagctttattttgcaaatattcttctgtatcggaccattcaaagatttctttgatttggtctggggtattaagagtagagaaaatagttgagtaactcttagcatgaactgattccataaattggatattattaagaactgctgtttcatgaggagttttaacatcttctttaagggcagttaatcctgcttctgattgaacagtatcaagaagggttaaaccaccaaaaacatgtccgacagtccattgatgatcgtcatctaattcacgccaatcatccatatcattggcaactgggatccgcgtatcaagccagaactgttctgttagcttttcccatgtagctttatcgatcatgtcggaaacttcattccaattaattgctttatattgatttacaggtttaaattcttccagtttcattgattgagctcctccaaatacgttgcttttaataaatcgagatgccaaaagccatttgtatacataatatcaagtttaccagtgcccaacgtttaaatcaaattctgattaggcttagataacacagctttcacattggtttgcaccaatttcatcgctatcgtcagtaaacgttcgaatgtagtaaattgacttaataccacgtttataggcatagtgccgtaagatgtttaaatcacgagtcgtcattttatctgttcgtccatttttccattcgtaaaggcctgctgggattgttgaccgcataaagagggtcattgaaagagactgatcgatgtgctgttgtgcagcggcgtaagtgtcaataacctttcgcatgtccatatcgtaagctgaacgatagtaaggcatcgtgtcgtttgaaagatatggggcagggtaataaattttaccgatcatcttttcttgacgctcttcaacacgattaatgattggatgtagactagcagtcgaatcgttaatgtaggaagttgaaccgtttggcgctacagcaagacggtattgattgtaaagaccatcttgcattacattttctttcaacttcttccaatcttcaattccagggataaaaataccttcaaaaagacctttaacaacatctgattgtggtccccaatccttagtgacatatttgttaaagtaggaaccatcagcatatttactgttctcaaaatcgtggaaagtttcctgccgctctttggcaatttcatttgatgccactaatgaccaataatttaagagcataaagtaaacacctgtgaattcaatcgcaaccgggcttccgtattgaatatggtgcttagcgaggtagctatgcaatcccattgcacccaaaccaactgaatgggcaagccgatttccgttttgaatagttgggacaacatctaggtcttctacgtcactgattcgggttaatccccgcatcattgccttaatcgatttaccaaagtcagggctttccatcatattagcaatattggttgacccaagattacaactgatatcaattcccatttcagaatatgattgatcatcatttacttgcgctggtacttgtacttgagcaatctctgaacataaattactcatcacaatttttccattaatcggattatcccggttttctgtatcaatattgataatgtaaggataacctgattcttgttgaagtttactgatttcgtcctccaagtcccgggcattaactttcttcttgcgaatatcatcgtttgctactaaattgtcgtattcttttgtgatatcgacgtaggagaatggcattccgtatactcgttcaacatcatagggactaaacaagtacatatcagcattttgctctactaattcgtaaaacttatcaggaaccgtaattccgagagagagggtctttaagcgaatcttttcatcagcgttttccttttttgctcctaagaattcaataatatcaggatggaaaacactaaggtaaacgactccagctccctgtcgctgtcccagttgattggaataggaaaaactatcttctaacaacttcattacaggaacaactccactagcagcaccttgtattttcttgattggggcaccagcttcacgaaggttgcttaaattaatcccaacaccaccaccaattttagaaagttggagggcagaattgattgttcgaccaatggtattcatgtcgtccgttgtttgaatcgcaaagcaagaaacaaattctccccggcgtttacgcccaacgttaaggaatgttggagttgcgggttgataacgttgatggatgatttcatcagcgagctgcattgctaactcttcatcaccattagcgaggtaaagagcattcattgcgactcgatcaatatagttttcaaggtagtactctttatcatttgttcgtaaggcatattgagcataaaacttataagctgccataaaagaatggaagtggaagttttgggcttttaaataatcgtaaagcttttcaatgaatgcttcactatatttattcataaattcctcttcaatataatcattttcttttaaccattgaaaacgttcttttaatgaagaaaagcttttggtattcggttctacattatttttgataaagtcttctaaggccaatttatctttatctagttgaatttgtccgttttttgggatatttacttcgttgttataatcgtaatatttaactttggtcatatcgatatcggataacgccatattaataactcactttctgaattaatttgattatgtcaataaagaagccagtacaccaatagcgaattgatgcctggcaaaatattagtttatttaaacttaggcaagttggtttaattgatcaggacgaaagccagaaaaagcttgaccgttaggaagttttacaactggagtcgccataaaaccttcagacttaagttgagatatgtattctggttgttcatcgatgttgtgttcaataaatgaaattttgtgttgctcaaggaaacgttttgtcatcttgcattggatacaattattttttgaaaatacagttaccatcttcacgaggcctcctaaacgattagtcgatgttttctagtataacgatgaattagaaaaaatcaattaaaaaagcactatatttcgtacttgaaaaatagtgaaacacaacatatagtgcttgaactagtggttaacacctgtgaaactttttttgatagaatacttaagcaggtgcttaataaaattaatttgaaaaactaatctattattatacactgaacaacaggggaattttaagtgcttggagaaaaagaatgaaaaaaatcaattcatcattatctgaacaacaaaaatttatgaagatggcaattgcagaagcaaaacaagccagaattttagatgaagtaccaattggtgcgattgttgtccacgagggacaggtaattgggcgtggtcataatatgcgtgaaaagtttcaagatgttacctatcacgcagaaatgcttgcgattatggaagcatgcacgaatttaggaagttggcgtttagaggactgtgacttatatgttacgttagaaccgtgtatcatgtgtagcggtgccattatcaacgcacgaataaaaaatgtttattatggtgctgctgatccgaaagccggggcggttgatagcttataccatttactaaatgattcccgtttaaatcatcaagttaatgtccattctggtattttaggggatgagtgtagtcaaatgttaaaaaactttttccgtaaaattcgtcgccgccggaaagaggctcgacgaaaaaataaggctaacccctagtaatttaaagaaaaatagtgtattatactatttgccgtaaggccttagagcaagggtatgcttacgaaccgtgtcaggtctggaaggaagcagcactaagtatgatataccttgtgctctaagttttattgataattaagctgacccgtaatggtttattgcgggtcttttttatttttaaattttaattaaaatgtattttacctactttatgtgattaattccttgtataatattttatagtattttaaattcagaaagggagtctggcgatgagttatcaggcattatatcgtgtctggcgaccacagcgattcgatgatcttgtcggtcaacagattgttacaagaaccctaaaaaacgccattatcactcaccagataagccatgcatacttgttcgctggtccacgtggtactggtaaaacctcagcagcaaaaatttttgctaaagcggttaattgtcatcattccaaggatggcgaaccttgtaatgagtgtgagatttgtaaagcaattacaaacgggcaattaaatgatgtaattgaaatcgatgcggcttctaataatggggttgaagagattcgtgatattcgggataaggcaaaatatgctcctacccaagcggactacaaagtttatataattgatgaagttcacatgctttcaacaggggcttttaacgcactgctaaaaacgcttgaagaaccaccagccaatgtgatttttattcttgcaactacagaaccgcataaaattcctttaacaattatttcgcgggttcaacgatttgattttcgacgaatttcagcagaagatgcatttaatcgaatgaaatatattcttgatcaaaaggaagttacttatgatgaaaaagcattatgggtaattgcaaatgccgctgaaggaggaatgcgggatgcgttgagtatccttgaccaggttctttctttcagtgataatgaggtaaagttggatgatgctttactagttacaggaagtgttactaaacaattattaaaaaagtactttttggagattagtaagcatgaaggggcgactgctcttgacaccatgaaagatattttggatgaaggaaaagatggtcagcggttcattgaggacttgatttcctttattcgtgatattctgttataccaagaatcaccaagcttgattagtgttgaaagtacgggactaaagcaggaagactttgaagaaatagtccaacttgcttcttcagcgaccttataccaaatgatcgatgaactaaataatattcaagaagagatgcgttttacgacccatccggatgtgtatttggaagttcttacaataaaacttgcacaaatcgaaccacaaaagaatattcaatcggcaccagcggtttcttcggatacaaatactgaagctactaagacgattgaaaaattacaacaagagatacagcaattgcaacaaacagtaaaacagttgcagaatgcgccggcaaaggctagtcgaccatcacctcggcaacaaaatgagcaaccacgagtacaacaaaagaaagtgcaggttaatctcaataagatttacccagtgttagaaaatgcgactcgtcaagatttaataaatgttcgtgagctatggggagatatgttgaatctattgtcggtgccgcaacggtccttacttcacgtttcacaaccggttgccgctagtgccgtgggaataattgttgcttttgattatccgttcttattccaacaagcagctgatgatacaacgttgttagagaatatggaaagtgctctgcaacgtttaactggaaatgaacggcaagttgtttttgtacctaaggataaatggccaaaaattcggcaagactttatcaaggatcatggttttggtaagaatcagcaaaagtcgcaacctattaaacaaaagccgcaaactactgaagaaagcggacaaactcctgcagctacaccagcaccgatggaggaaccaccgctaccaccagaagatgagacactaactgaagaaaagtcacctcaagaagataaccaagtagcaacagcacagaagttatttggtagtgatattgttaaagtagaagataattaagaaaaaggatggatgatattatgatgcgtggaatgaatatgcaacaaatgatgaagcaggctaaggcaatgcaaaagaaaatgatggctgaacatgaagaacttgctaaacaggaatttgttggaaaagcaccggatgatatggtaactgctacgtttagcggggataatcaattaattgacttaaagattaagccagaagcagttgatccagatgatattgatatgcttcaagacttggtaattgctgctgtgaaagacggaatgaaacaagtcaatgatgctactcaacaaaagcttggtaaatatacgcaaggtatggggttgtaaaaagtgatccaatatccagaaccattagcaaaattaattgaaagctatactaagttgccaggaattgggcaaaagactgcaactcgcctggcgttctatactttgagtatgcaagaagatgatgtaacgaactttgctaaatctctcctatctgctaaaagagaccttcataactgtagtatttgtggcaatattactgaagatgatccttgtccgatttgtcgcgataagacccgtgatcattcgcaaattctagttgttgagcagttacaagacgttatggcaatggaacggatgcatgaatatcatggtttataccatgtccttcatggagttatttccccagttgcaggaacaggcccggaagatattaatattacaagtttacttaaacggttaaagaaagataatgaagtaaaggaaattattattgcaactaatgcttcatcagatggtgagttaacggctgggtacctcgctaagctaattaagcctgcgggaattaaggttactcggttggcgcatgggttatcagttggcgcagatattgactatgctgatgagatgacattattcaaagcagttcaagggcgaacggagatgtaagaaaatgttttttaagcggcctactaaagaagtggaacgtgaacggaatcagcgcctgttagaagcggtatattctacgaaggccagttgggatcatgcacgtgaaactgaacgagcagtatatgaagcaaacgttaatagtgaacttcattaccgttcccggattcaagaacaaaaatttttatacctatataaaattgctcgtaagtttaaagttcacgggacgttaaatgatggagtaattgatcgctaggagagagaaatggacggtaaatttatatcatttgagggaccagatggagctggcaagacaagtgtaatccaacagattcaacaacaattggaagatcagcttggcacagaaaaagttatgtatactcgtgaaccgggtggtaataagatttctgagcaaattcgccaggtactctttgatggtcaaaataccgatatggatgggcggacagaagcattgctttttgctgctgctcgtcggcaacacattgtttcagaaataattccggggttgaaagcaggcaaagttattctgtgtgatcgatttgtagatagttccatcgcttatcagggagctggtcgtggccttggtgaaaaagagatttggcaaattaatcagtttgcgattgatgggttaatgccgtcgttgacaatttaccttgatattgaatcggaaattggcttaagacggattgctgagcatcgttctaatcaaattaatcgattagacaaggaaaagcttgctttccatcaaaccgttcgtcaatcttacttgaaactttacaaaaattatccagaacggataaagttaattgatgcaagtcagccactggaaaaagtgattgaggatgtaaaagcaacaattcatgaccgtttttcagatttgttttaataaaaaagggtgattaataatgaaaatgattattgcaattgttcaatcaaaagatagcaatcgtttacgaaaagcatttaataaagctgatattcacgttactcaattatcaacaactggtggtttccttcgtgaaggaaatgcgacatttttaattggaattgaagatgaacgagttcaagaagtattatcagtaattaaaaagaatgctgagtcacgtgaacaatacgttacatcgcaaatgcatatggatgttgaaggaggttcagcatttcctgtcaacgtaaagattggtggggcaactgtttttgtcttaccagtagaagacttcattaaattttaagtaggtgaagatggttggctgaacagggacaaacacgtgcagaaaaattacaaccagcaataattactcgttttcaaaaaatattattaaataaagaacttgctcatgcctatctgtttgttgggccaggcggttcaggaaagatgtcaattgctcaatggttatcgttacggttattttgtcttcatccccaagacaataaaccagacttaacttgtgccgagtgtcagcgaatcctgtctgggaaccatcctgatattgtctatgctgctccagaaggtcgccaaataaaggttgatgagattcgtcacttaaaagcagaattttctaagagtgcggtagaaggcaataagaaaatttttattattaaagatgctgataaaatgacaaatggtgcagcaaatagtcttcttaagtttattgaagaaccggggactggcgtttatatttttatgctaacgactaataaaagtgctgtcttaccaacaatccgatcacgaacacaggtgattgaactgccaccattaaaacgagatgcgttgttaacagttttaactgaacataatattccatcatctcagcaacagattgctgttgggattacagattccgtcgcaatgattgaacagtggcaagaagataattggtttgagagtgcgatcaaaggagtcattcagtggtatcaagatacgacacgaaatgggatgttaggcttcgttgatgttcagacaattctacaaaaagtagctaccgaccgggataaacaacaagtgattttggacctaattaccttaatctggcgtgatacgctaatggtaaattccggaattacagttgccaaccgccttcactttaataatattttaggagaaatgggagaagtagttagaaaatactctcctcaacaattgttagcggctagtcagttaactttggaaactcgtcacatgttagaacaaaatattagctttcaaaatattgttgaacaattgacgattcggcttgtgcaggttttaagcattagttaggagcgaaaagatgagtgaagaatatagttcagataatctttatgaacaatttgcgcaggtgatgaaccagacccaggatttagttaataaaatggagcagttgcaggcaaaaattattgctatttctgaggaaaatgttgaactttcaattgaaaataagcatttgcgtcagatgattaaagaaaagcaatcacatcatagtgaaaaccaattatctggatcacggcaaaatttaaaagagctttaccaacagggttttcatgtttgcagtgagtattatggtaaacgtcttgagcctaatgaatcttgtactttttgtttagatgcaatattcggacatgaacaaggaatgacaaaataggagatagtatgcagcaaattagtagttttaatgatcaccaatcaggaagtttatacttagttccaaccccaattggaaatttagatgatatgacttttcgtgcaattaaaaccttaaaagaagtggatctgattgctgctgaagatacgcgtcatactcagcaactattaaaccattttgatatattaacccgtcaaattagctttcatgagcataatgctgaacaacgtgttccggaattgattgagaaattaaaagctggttattcgattgctcaatgcagtgatgcagggatgccttcgatttctgaccccggcaaggaattggtagcggcggcagttagagaagggttgccagtaatcccgcttccaggagctaatgcaggattgacggctcttatcgcttcggggttagttccccagccattttacttctttggctttttagggcgtaagcatcagcaacaggtagcggcgttggagcaattaaaagagcgtgaagaaacgatgatcttttatgaagctccacaccgcttaaaaaagactttagctacgatggcggaagttttcggtaatgaacggcgagttgttttagcacgggaactcactaaacgctatgaagagtttacgcggggaacgcttgctgaaacaactgcctggtttgaagatcatcaaccacgaggagaattcgttattctagtagctgggaatgaacacccgacagaggagacagataatgatattgaattaccattaacagaacaggttgataaggaaatcttaaatggtctttccactaatgctgcgattaagctggtggcaaagaaaaataatataaaacgccaggaattatataaacaatatcatcaattgtaggagaaaaatatggagttaaagcaagaagcacaaacatttgaaatgccgcacttactaacatattatgagtgtgatgaaacaagtcatccaagcctaagcatgatattaagtatgatttccatggtatccgatgagcatagtatgtctttaggaatgggaaccgaagaaatacaatctactggcggtacatgggtagtaagcggctatgaaggatatctttccgcaaatcaaccttcttttggcgaaacagttattttaggaaccaaagctgtttcctataaccgcttttttgctgttcgtgatttttggataacggataaagaacaccagattgaatatgcacgaattaggtcaatttttgtgtttatgaatctaaagacacggcgaatgcaatcaattccactaggtttaattgaaccatttaatgctcctgttgcgaaaagaattcctcgtctaaagcgacctcaaaaattggatgaaaatggttcgataataaagaaaaattatcaagttcgttattttgaccttgatgctaatcaccatgttaataatgcgcgttactttgattggcttcttgatcctcttggccgtgattttttacgagagaatcagataaaaagatttaatttgcagtatcttcaagaggtacgcaatggggaaattgtggaaagcaaagttaataagctccaaataaatgatggaacggtaacttaccaccagattggcgttgataagcaagttgatgcaattgctgagatagaatggtattaaaaattaatcaatgaataatagcgactggtttctaggcaggaaattagttgctattttattttagtcctaaatattagacgaaaagatcttaaatggtttaatgtagagacatttaaaggaagatggtattctatgaatagtagtaattatgaggagtgagttgacgtgaaaagatctttaacggcgattatttacctcgaacccgatcaggttaatttacggatcattgagatacctactttaaaagtgataaataatgttcgatcgggccttctaaatatcggaaacgctaaagttgctaattattcggaaaatatgactgcaattgttaataatattgaaggatttaagcagattattaatgactaccaggcaacaccagttaaattttatggcgatttagaagaccttgacccagttgcaactaggtatgtggccgaccagttagaagttcggacaggattacagattgaatggttaaacaataaccagctaatggcacagtcgatgagttaccttttaaccttgctaccagattttgaaaaacttagtaaacacaatatgtatcttctaagtatcggtcttagctcgactaccttagcttattttcaccatggaagctttgaacgggcatgggatattgatcttggtaatgcaaaaatcagtcagttggtggggcgtctccgaaaaactgctaccaatccaactgaaattatccaagattatatcagtagtaaattagaatacttaacaccagaactgacaaagaaaaagcatacagtaatgatggtgcaaaatgccctctcactcaataaattatttttgccaaatgatcagcaaatcgcggaagttcccctaaataaatttcatgatgattaccaaaagattttatcgccagtaaaagatggcttaatgaaaaatattcagattgatgaccaacaatttgaattattattaccaaattatttagtaacggcgcgaacagtgcgcttaattcaaccagcaggcctttacgtaactgatatttcaacgatggatgggatttcccatggaattggggttgataatcctaaaacgagacggcaaattaatgaaatgatcagaacagctgccgacaatatttcttcacgatacggtgttgattcagctcatcgggattttgtaacgcgcttttcactccaactctttgatcaattgcgcccaattcatcgtcttggtcagcatgagcgattattattagaaattgctagtagaattgatgacattggtaattttattaatcaacggggacactaccgccactctgcttatattatggaggctaatcctctaattgggctttcagataaagataatcggattattgctgaagtggcgagatatcatagtgcagagtctccagatattagtcaagctcattaccgccatctcgatgatgagatccagatgccagtagcaaaattagctgctattttacgattggtggatgcattagatgattcgcggctgcaaaaaatttcaagtattagattgaagctggtaggagatagccgcttaatcattaaagcaatagccaatgatgaccttgttcttgaaaagtggtcttttagtaaaaaatcacaactatttaaggatgtatacggaattgaaccggtcttaactgagaggagcgatcattaagatgtataaggagttttataagccgcagaattatgttaatcgagaattgagttggattgactttaatggccgagtactgggagaggcaactgatactgctaatcctttgttagaacgtgctaacttcttgggaattactcaaagcaatgttgatgaattttttatggtgcgggttgcatcgcttcataagcttgctgctgccaatgttactactactgatgcgtctggtctgactccagaagagcagttggatgcagtaaatgaaaaagaacaccggatggttaagcaacggtatgaagtttataatcagcaaatcatcccgaaccttgctaaaaataatattcatattctccatgtccccaaacttgacgagaagcaatatgaatttattcgtcggtactttaatgatgagctgatgccagttttgactcccatggcagatgatgcctcacgtccttttccttttatctccaataattctttaaatattgctgttcagctacggcgtcaaatccgttcaacaagtgaaccagttgcagaggaaattctagagggagatcaagaagttcatcgtccacaaatggaaccacatgatgatcgtcaagaagcagatatcaaatttgcaacagtccgtgttccagaaatttataagcggttagttcggttaccagaagaaaatagcttcattttgattgatgaaatcattactgaatttctgagcgcgctttttccaggatacgagatcttagctacagcgtcatatcgagttatgcgggatatggacttagatgtggctgaagaagatacgtctgatttgctccgggcagtcaaacggcaattgcgggaacgagagcatggacaggtgatgcgcctagaagttcctgcttctatcgatgaatggttaaaagatcaattaattgataatctgcatgtaagtgaacggtcactgtatgaagtagatggtcccgtcgatttaactttcttaaaaaaattatcggggatggttgatggtcatgatgacttgcgctatccaccatataagccatacctcaacccagcgttagatatggatcataatattttttcttcaattcgccaaaaggattacctaatgcagcatccttatgataattttcaagccgtggtcaactttattcatcaagcagccattgatccagatgttttggcaatcaagatgactctttatcgggtctctggtaattcaccgattattaagtatctcggaatggccgcgcaacagggtaagcaagtaacggttttagttgaagttaaagcgcggtttgatgaacaaaataacgttcggtgggcacaacggcttgaacagatggggtgccacgttatttacggtttagttggccttaaaacgcactgtaaagttgctttggttatccgtcgcgatgaagatgggctgcggcgttatatgcacctaggaactgggaactataatgatgtaacagctcatttttacactgatatgggattatttacttgtgaccatgagctgggcatcgatatgacaaacctgtttaatatgctgtcaggatttgcacgaccagcttatttcaatgaattacgggtatctcctgatgggattcggacatttattaatgccaaaattgatgagcaaattgaaaatgccaaaaatggtaatcctacgttaattcggatgaagatgaattccttgtctgacaagcaaatcattgcccgcctatacgctgctgctgctagtggagttaaggttgagttattaattcgaggcattacctgtttaaggaacgatttgccagaattgcatgggaatattgaggttcattcgattattgggcgtttccttgaacactcccggatctactactttaagagtaatggtcatgaggaagtctacctcgcaagtgccgatatgatgacgagaaatcttaatcgacgagttgaagaattgtatcccgttacccagccagacacaaaagctcatgcaattcatatttttgacgttatgtggaaagataatgtcaaggctcgacggttagtaggagatcattacgaacggattgatcgtggtgatgtcgcaccattcagttcacaagaatactttgttaaacaagcaatgaaattgaatgcgcgtgagaaaaaggagaagaaagcaaaaaaacatttttcttctgtttttgaaactttaactcgccatgttcccaatcttcatttagatgagcgaaaggatgagtaatttatgagcaatgagcagtaccttgcaattcttgatttaggttcaaattcagttcggcttaaaataacaaaaattcaagataacgggagctttgaaacggttcaatatgaaaaaagatatgttcgcctcgcttctaatatggggccagaaaaaatgttgaagtcagctcctgtaaagcggactattgatgccctaaaagaatttcgaacaatttgtgatcgataccgtaataagaaattgacaattattgcggtggcgactgctgcggttcgtcaagcacaaaatcaactgcaatttcttgaaaaggtcaagcaagaaacgggctttgaaattcatgtaattagtggagaacgagaagcatatcttgactatgttggtgttaatcagactcttccaattgataagggaataattgttgatactggaggagcaagtatggaattaatctcggtgaataatggggaagcagaagaagcgattagtattccgatcggttcagttagcatttcgcaaacctaccatcttgaagatcaaattaatccagctgatttatttgatgccatgattaaaattgatgaagttctttctcaacaattatggctaaatcggatgcgggagacaaaaattgtggcactcgggggatgtaaccgtgcattagcaaaggtatatcggtggcaacaagctcttaatcctaatgaagccagaccagttcatgggctaacaatgcgttcagaagaagcctttttgattatgcggcagctattagaaacggatcgccagacgcgggcaggaatccgtggaattacgaaagtgcgagcggatgtaattgttggaggacttctcccccttatctctcttgtccggcaattgtcaattaatgagatttgctttagtaatagtggattaagagaaggtttattatttaagtaccttgagcagcaaattaattttgatcaattaaaatcctcgctataaaattatccactaaaatttttgcttatttttactaaattttactaattagaaacagtaaaattgtgctacaatcactatgaaagctttagttggagcaaggaggaaacaagatgtcaattttagttgctggtggtgccggatatatcggttcccatatggtaaaagatcttattgaaaatggtgaagatgtagtagtggctgataacttatcgacgggtcaccgggatgcgattaatcccaaggctaagttttatgagggtgacattcgtgatcgtcaattcttagataagatttttgacaatgaagatattactgcagttgttcactttgctgctttctcaattgtacctgaatcaatgagtaagccattgaagtactttgataacaatactggcggaatgattactttgcttgaagcaatgcatgatcatgatattaagtatattgtcttcagttcaaccgctgctacttatggggttccagaacacatgccaattaaggaaacggacccacaaaacccaattaacccatatggcttgagtaagttaatgatggaagaaatgatggcttgggctgataaagcttacggtattaagtttgttgcccttcgttactttaatgttgccggggctgccactgatggtacgatcggtgaagatcacggtccagaaacgcacttagttccaatcattcttcaagttgcgcaaggcaagcgtgatgaattgagtatctttggggatgactacaacacaccagatggtaccaatgttcgtgactatgtccatgttatggatttagcagatgctcatattcttgctattaagtaccttaaggaaggtaacaagagtaatgcctttaaccttggttcatccactggcttctctaacaagcaaatgctagaagcagctcgagaagttactggtaaacctattccagctaaaatggcaccacgccgtccaggagatccagattcattagttgctgctagtgataaggctcgtaatgttcttggatggagtcctaagtatgatgatgttcacgacattattgcaactgcttggaagtggcattcaactcatccaaagggttatgatgatcgcgactaataatcggctttaaaataacaaacaggctctcagtaaaacttttgctggggcctgttttgtcgtaaataaacaaaagaaattaaaagagaagtcaaagcggatccagtgtgataagatgtaagatgattgaaaggattgataaaagatgaagattctagccgtcgatacatccaaccacccaatgagcgtagcgttggttgaagatgagcaattgttggcaacgacaacccttaatatggttcgcaatcatagtatttatttaatgccggcaattagtaagttatttaagttagttcagtggcagccaacagatattgatcgggtagtggttgcacagggaccaggatcttatacaggagtacgaattgcagttacaaccgctaaagtattggctgatacagaaaagattgacttaattggcgtatcaagtttagcagtattagcacgtaatgtagttccaacatcatcagcaattattgttcctttctttgatgcacgacgaggaaatgtatttgctggtgcttaccagtgggaaaatggcgagttagtaaataaaatagaagatcaacatctagggattgatgttttgcttaatcaacttgcaaaattagatcaacaagttgttttggtaggtcatatgactgataaaattcaagccaaatatgatcaattaccagctaatgtgacccttttgccacgatcttatagtattccgtcaacttatcaattagctcttgcaggtaaaatgaaggaaccagttaaagagattgacccttttgttccgcattatttacgaattactgaagcagaggctaattggcaaaaacttcatcctggagaaaaaagaaaaaattatgttcgagaagtttaaagaatggtttatcaatacgaccaatcctactaaacgaccgatccttgaatttacacgacgaatagtaatgatatctggtcatcaatacatggtccggatggcaaaggaacaagatattcaaaccttggtagaaattgaagaaagaatctatggaaaagcaccatggagttatgctgctttccgcattgaactccaacggccgtgtgatcgactatatttagttgttgaggatgaccagcagattgttggctttatgggaacagccattgattggtaccattatgatttgcatattacgaatattggcattacaccaagttaccaaaataaaggaattggaacgtatcttatttcaactgccaaaaactatgcccggcacttaaaattacattcgctgagtttagaagtacgagtgtataacgtatcagctcgtcgcttatatgaaagtttaggctttcgtaatcagcatattaaaccacgttattacttagataatcacgaagatgccgtggatatgcaagcaaacttacttaggtagaggtgaaagtattttattatgacagaacgcacattaaccttagcgtttgaatcaagctgtgatgaaacaagtgttgccgtaattgaaaatggaactaaaatcctttccaatattgttgcaacgcaaatcgatagccatcaacgttttggtggagtagtaccagaagtagctagtcgacatcatattgaacaaattaccaagtgtacaaatgaagctttagagcaagcggctgtaggctatgatgacctagatgctgttgcagtaacatacggtccaggattagtcgggtcattattaattggtgtgacagcagcaaaggccatcgcatgggctcataaccttccgttaattccggttaaccacatggcaggtcatatctatgctgcacgctatgttggggaattcaaatatccacaaatggcattgttagtttccggtggacatacggaattagtttatatgccatctgaacatgaataccaaattatcggtgaaacacgtgatgatgctgccggtgaagcttatgataaaattggtcgcgtgttgggagtcaattacccggcaggaaaaacgattgatgaatgggcggctaagggtaaggacacttttaatttcccacgagcaatggaaaaagaagataattatgactttagctttagtgggctgaagagcgccttcatcaatacagttcataatgcagaccaacgtggagaaaaattagataaatatgatcttgcagccagtttccaacaaagtgtcattgacgtgcttgccgaaaaaacaatgcgggcgttagatgattacccagtaaagcaactgattttagctggtggggtcgctgcaaatcatggtctccgtgctcgtttagatcatgacatgaagaaatctcatcctgatgtaccgatgctgcaagcaccgttgaaattatgtggtgataatgctgcaatgattggggctgctggttatgttaactacaagcatggcgaccgtgcaggattagatttgaatgcagtaccgggattaatgttcgatcgaattcagaataaataattataaacataactctcataagcaatgatggcctccagtgttcggtaaaaccggacgctggaggccattattgtactgcgctgtatggatgtaaccgcggtctttttttgcgtttatgattcaccatttgctttgtcaacggcatccatcatggcgtaacggaaaccatttttctccaatgcttccacgcctttgattgttgtacctgctggtgatgttacttgatcacgtaataatgctggagcaagcttgctatcataggctagtgtccccgtaccttttaccatactagcaataacttcatatgcagtttgacgatcgaggccatgcttgacggcggcatcgctcattgcgtccatcatcacatcaacaaatgcagggccacagccgccgataacaccaattatatctagttgtcgttctggaactttgatgacatcaccaagactatctaaaacagtcattacttttgaaattgcttcagcagaaattccggttggcaaggcaagaccaattgtgccggcattaacttcaactggtgtgttgggaataatattaacaatttctttattcggaagcactttggctaagtcttcgtgagtaattccagcagcggcagagataaaaatagtgtgatcgttaaggacggctaattctttagcgactacggttgtaataggggccggggtagtcaaaattacgatatcgggtgtaaggttaactacttcactgtttgtattaacgagtttaaacccgagcttcttagcaaggcttgtaacacgtgaattaacagggttcatcgcactgagggtaaaattttgcgtacgacttaatcccttcataattgcgcttcccatatttccgacaccaataattgtaattttcatctaaaaaacctcctaaattatttccgaacttgcccattaccggtaatttcatatttgattgttgttaattgttgtaatcccattggtccccgggcgtggagtttttgggtactgataccaatttcagcgccaaagccaaattctcccccatcagtaaaccgcgtagaggcattaacataaacacaggcagaattaatggcttgttggaagtagcgtccccgggtaatgttgtttgtaataattgattctgaatggtgagtactatggtgattaatatggttaattgcatcatcaagggaatcaacaatttttacggccataattaaatcattatattctgtctcccaatcttcctcagtaacgggacggatagttgatactaattggcacgccatttcatcaccgcgtaattggacgccatgttccattaaagctttggcaataacaggaagaaattcagcggcaatatcgcggtggataagtaatttttcagcggcattgcatacagaaggccgttgtacttttgcatttacagtaatattggtcgccattgttaggtcagcatccttatcaatataaatgtggcaattacccgcaccagtttcgataactggaaccgtagctgttgttacaacccgctgaataagggcctggccgcctcgtggaatcaagacatcaatgtagtcagtgagattcatcatttcatcagcaatcgcatgactagtgtcggtaataagctgaaccgcatcgaccggtaaatgttgactttgtaatgattcacgaagaatttttactaaggcagtattagtctggatagcttcttttccgccccgtagaataactgcattgccactcttgaatgtgaggccggtcgcgtctacagctacgtttggtcgtgcttcaaagataatgccaattacccctaatggtacgcgccgttgaaggatttgcaacccatctttggtaatccatcccttatcgatttgggaagtgggatcgttcaagtcggcgattgttcggagaccattagccatgtctgcgatacgttgggaattgaccattaaacgatctgtaaatttagttggcatctgggtagcggcgaccaagtcttgttggttggcagcgataatttggtttttatttttgattaaatcatctgccaattgaagcaatgccttatttttggtggcagtgttcattaaagctagtttgtttgcagcgatttgggctctttttccaattgtaattaaatcttggttcattatcatcactcctattttccaaaatgagtaccaatagtatgaccatcaaaaatatcaaaaagaattttagggtcacgaccattgcataaaatcatttgtttacctgcttgcatcattgtggcagctgcccgtaatttagttaccattcctcctgttccaaacctagtgctgctaccgcttgcgacgttctctatttccgtcgttaggaatggaacttctttaatgatttgtgcgtcaggaaatttatgcggatctttgtcataaagggcatcgatatccgaaagaatgattaactcgtcagcgtcaatggcaatagctacctgggaagagagttcatcattgtcactgaaagtagtgtaatgatcaagctcatcaactgacacggggtcattttcgttaacgattggaatcacattttgctgaagtaaagcattaattgtattaagcgtatgctggcgactgacgggataagtgagcacatcacgggtaaggagaagttgggcgacgtgcgtttgatagtctaaaaatcgttgcgaatagattcgcattaaagcagcctgaccgatagatgctaaggcttgctgttgtgctatttcggcgggacgatctgttaatcccaaacttgcaagaccaacgccaattgctcccgaggaaacaagaataagttggtatccttgattgtttaatgtcgcaaggacaaatgaaagttggtcgattgttcgtaaattaatttttccattaggaagaacaaggctactcgtaccaatcttaacaactactttttgtattttatgagtcatagaaaatcctttcagaaaacaaaaagcgcccttaaccgagacaccaattatggcggtaccattctcgtttaaagacgcactttacacttttaaattattttattattagaatatattaaagttgtagcagggcttcggtactggcgatagcttgcagtcgatggctatcgttcctggactgacctacttttatctacaattaaaattttaattggaagactaagcttttgtcaagactaattatttttgagattcaattaaaaatgaattgacaaataattaaaaataaattagaatacgagcaacaattaaatattagtcgtttaagaagagtaaaagcaatgtagtattaagagagttttcgggtggtggaagaaaattacaaattgctttgaagatggtcttaaaaaatacaacaagtgtgaggaaaaaactaagcacttgtcggctgatatccgttatcaagtatcgaagtttattatgaacttcctgaggctattcatgtgagtggatagtaaattaaggtggcaccacgaaaatactcgtccttatttaagttaaggacgggtattttttatggaggtgaaagtgatgaaacgcaaaattgcattagctcaacttgatattcaattaggaaatcctgccgaaaattatcaaaaagctaaacaagcgattgaagaagctgctagtcaccatgcagatatcgttgtcttgccggagatgtggaatgctggctatgccttagatcaattagcagaattggcagatgaaaacggtcaaaagacacaaaaatttcttagtgagttagcgttagaaaatcaaattaacattgtcggtggttcagtagcggtgagatgtggacaatcttttttcaatacaacctatgtttatgatcaaaagggaaatctaattagcagttacgagaaggtgcatttatttggactaatgaatgaagaccgatatctaaaagccgggcaaaaagaaaatcactttgaattagctggggttccgagtgcaagttttatttgttatgatttgcgattccctgaatggattagaacagtcactcgttatggaactgatatcttatatttttcggcagaatggccaagcaaacggattaaacaatggaaaataatgcttcagtcacgggcaattgaaaatcaagcctttgtagtcgcggtcaatcgtgttgggacggatttagagaatagctttaatggtcattcgttagtaatagatccgcttgggcagattatccatgatgcaggagaagttgaacaagtaagttatgcagaaattgacttagcgcagttagcacaggttcggggccgattccggtgtttaaggatcgccgaccaagtctttatcattaaggggatggaaaagatgaattttgcacaatcaaaattattagacactttaccgaaacaattttttgccaatttagttgccaaggttaataaaaaaataagtgaaggggtcgatgttattaatcttggtcaagggaatcccgataagccaacgccagattatattgttaagagcacgcaaaaatgggtagcggatccgcaaactcataagtattcactatttcggggattgccagcatttaaagaagcagcggcaaaattttattctgaaaaatatggagctgactttgacccagaaaaagaagttgcaattttgggtggttccaagattgggcttgtagaattgccatgggcattgatgaatcccggcgacacttttctgcttcctgatcctggctatccagattacttatcaggagcagcattaggagaagttaattttgaaacagtaccattattagcagaaaataatttcttgccagacttagaggcaattcctgaagaggtggcgcaacgtgctaaattcttctatcttaactatcctaataatccaacgggtgctgtagctactcccgagttttatcgaaaattagttgcgtgggccaaaaagtaccatgtgggcattattagtgactttgcctatggcgcaattggctttgacggtcaagctccagttagctttatggaaacaccaggcgctaaagatgtggggattgaattttataccttttctaagacgttcaacatggcagggtggcgaatcgcatttgcggttggtaatgcagatattattgaagccttaaacttaattcaagatcacctattcgttagtctttttcctgccttacaggaagctgctattgatgctttaacgctgccacaacgtgatgatgcaattgccgaaattgtaggtcgttatgaagaaagacggaatgcttttattaatgcggccgaaaaaattggctggcatgcatttactcccagggtactttctatgcttggatgccggttccaaaggattataccagtgaaagctttgcagatttgttattggacaaagctggcgtggcagtagcaccaggcaatggctttggcaagcacggtgaaggttatgtgcggattggccttttgattgagccagcacgactgacggaggccgttgagcggattgctaaattgaatttatttagttaaggaggaaaaattatggctttgaaatatacggttttaggtgcaggggcaatgggactacgatttgggtattgcttcaagaattagcaggtgcgaaggttgattttgttgataactgggcttcccaagttgaaactattaaacaacagggtggggtttacgtttctcgagaccatgagaatcgacatcttgtaccaattaatatttactcaccagaagaatatgatggtgatccagatgtgtttatcgtttttgccaaacagatgacgcttagtgatttgttacaacgcagtgctcatttcttccgtcctgaccatcaatatgtcttttccgggatgaatggcatgggacatattgaaaaaattaaccaatattttcctaaagaacatgtcgtggccggaacttgtttaattggcacggtccttaataaggcggggaatgtggattttattggtaaacctggtgctggttcgatcaacttagctccccaagtcggcgaaccagatgagcgggtaaaacaaattgttgaggactttaccacggcgaatattaatccccaccttaatgataatttttatggtaccctcctaacaaaagtagtttttaattctgttattaacacgatctgcacgctttttgagattcaaatggggcaatttatcgattacgatggtgcagaaaagcttggcaaacagttaattaatgaagcattcgatgttgccgaacgggctggtattcagctcttaagcactcgtgaggaggagtggcaaacgattaaatatgttagtgaagttaccagcccgcttcattatccatcaatgtaccaagatatgagtaaaaatcgaccaacagaagtagattacattaatggatatatttatgatttaggtaagaagtataactatgaggcatctactcacgacttcttgcgtaatttagttcaccttgcagaaaatactcgtaaattccgacaaaactaaaagaagaagcggacctgtccgcttcttcttttagttttcttgatcaaattcttccagtttttctgctgcttctgtccatgcaagttcaaattcttcagatttagctgataattcatcaagttctttttgaagatcggttaattttccaatatccgtagcgatctctggttgactcatttgttcttggattgcggtttgtttttcttctaattccgccatctgttgttctagctcatcgacttgtcgctgaatttttcggcgagcgcgctgctgttctttgctttgctgataagattgtttaccagctggtgctttagtaatggtggtggaattatgtgaagcagcttcagatgaactttctttttccttagcaattaggtagtcatcataattgccttcgtaatgtttaattccgtcgtgttccattgctaagatatcggttgcaacctgattaataaagtaacggtcgtgagaaataaagagaacggttccgctaaattcgttaattgcgttttcaagcacttctcgactatcgatatctaagtggttagtcggttcatcaaggataagaaaattaatcggtttaaatgagagcttagttaactccaatcgtgctttttcaccaccagataggtcatgaacaactttataaacatcatcaccaacgaataagaaactacctaataatgagcgaatatctttttcaggtacttctggatggtcatcccatacttcttctaaaactgttttatttggatgtaattgttgctgttcctggtcatagtaaccgatatcgaggttagcaccgagtttgattgttccactaattaacggaattttatggagaatagatttaagtaaagttgattttccgattccatttggtccgataatcccaacacgctgcggcttgcggacattaaatgaaagcggcccagcaaggatctgttcatcgtagccaacttttgcctgctccacatcaagaacttcatttccgctatctttttcagaatggaattgaaaatggattgatttatcatcagtttctggacgctcaagccgctccattttttctaattgctttcgccgcgcctgagcacgtttagttgttgaggcacgaacaatatttcggttaacaaagtcttctaacttagcaatctttttttgttgttggtcatagtgtttccactctgcttctaatcgttcttgcttgtgtttaacaaattgcgtgtagttaccagtatagtgggtgagtgttttattatcgagatcataaacatcgttgacaacacgatctaagaagtaacggtcgtgagagacgataagcaatgcaccttgataacttttaagataatcttctaaccatgaaagaacgttcatgtcgaggtggttagtcggttcatctagaatcaaaagccccggtgcttgcagaaggatctttgctaaggcgagtttagttttttgccctcctgaaagggaattaattggcgtatcataactatcttcgccaaaaccaaatccatgtagaattccccgcatacgtgattcgtattcgaaaccaccctgtttcttaaaggcagcttgtaaattatcgtatgttgaaagaatttgttgataattgctatcggaactatcaaggtcagcgaactgttgttcaagatcgtggatttgcgtttccattttgtggagaggagcaaagacagtatctagttcagtccaaatgctattttgactatcgagtccttgatcctgggccaagtaaccaattgtcaaatctttaaccttcgtaattgttccttcatctggttcggtgattccagcgatcatttttaacaaggtcgttttaccagcaccattacgcccaacaagcgcagtacggccatgctcttggatttgcatgttcatattgtgaaataaaacgtccgcgccaaatcgacgcacaacgtcatttgtctgtaaaagtaacatattgaaacctcatttaattcgttgatttaatatggttttattttagcagatttttaattttaaataaaaatttgaaaatatttttgtattttagttcacaaaaaagggtttaattgctagaatatactcagacttaaatttcacaaagtaaaaattagtaacattatccttgtcaaaaacttagtaattagttggcaaactaggttgagaagggcttgttttaggaggaacaaaagtagaatggctaataaaaagattccacgcgcgactgcgaaacggttaccaatatatttccgttatttaaatgtattgaaagacgcaaataagcaacgggtatcatcaactgaactttcggaggctgtgcaagttgattcggcaacgattcgtcgtgacttttcatattttggtgaattaggtaagcggggatacggttatgacgttgaaagtctattaaagttttttaaaggaatcttacaccaagactcattagttagtgttgccttagttggagttggtagtttgggaagtgccttgttaaactttaatttccaccaagataccaatttacggatcagtgcggcatttgatactaagccagaatatgccaatacagtcaaaagcggtattccaatttacccatccgaggatatggtaaagcagttaaaagagcaacagattgatgttgttattctaaccgttccaggaatcaaggcccaacatgttgcggaccaattagttgaagctggtgtgaagggaattcttaactttactcctgttcgtttatctgtgccaaaaaatgttcaagttcaaaacattgacttaacaaacgaacttcaaacattaatttacttcattaaaaattatactgaagattcaattgaataaattaggagagcattggtttgatgaaagcgtccaaccaatgctttttgtttactaaattattaataaaagtcatggattgtaggtatgatctcttaagttttaaaaaatggtcaaaaaaagtcaaagtatttttgttgcattttaaagagaacatgttatatttaaacatgtggttagcactcgaagagtttgagtgctaaaaataaaatttattaacaagatggagggattaacgtgttaaaaccattaggagatcgcgttgttctaaaagctgaaactgaagaagaaaagacagttggtggaattgtccttgcttccaatgtgaaggaaaagccaactactggaaaggttattgccgttggagaaggtcgtactttagaaaacggacaaaagcttgctccagctgttaaggaaggcgaccgcgtattatttgataagtacgcaggcaacgaagtagaatacaacggtgaaaagttcttagttgttcatgctaaagacttagtagcaatcgttgaatagttaaataagcgaattaagagcaggagacagaaagaatgaaattccttcaccgtctcttttaaataatgaatttaattttgaggtgacataaatggcaaaagaaattaagttttctgaagatgcacggagcgctatgctcagtggtgttgataaattagctgatactgttaagacaacaatgggtccaaagggacggaatgttgttttggaacaaagctacggcacaccaactattactaatgatggtgtaactattgctaagagtattgaacttgaaaaccaatttgaaaatatgggtgcaaagttagtagccgaggttgcttcaaagactaacgatattgccggtgatggtactacaactgctactgttttaacccaagcaattgttaatgctggtatgaagaacgttacctctggtgcaaacccagttggtattcgtcgtggtattgacaaggctaccgaagttgctgttgaagctttgaagaagatgtcacacgatgtaaagaccaaggatgatatcgaacaaattgcttctatttcagctgctaatccagaagttggtaagctaattgctgatgcaatggaaaaggttggccatgatggtgtaattactatcgaagattctcgtggtgttgacactagcgttgatgttgttgaaggaatgagctttgaccgtggttacatgtcacaatacatggtaactgataacgacaagatggaagcggaccttgacaatccatatattttgattactgacaagaagattagtaatatccaagacattttgccattgcttcaatcagttgttcaagaaggccgtgctctcttgatcattgctgatgatattactggtgaagcattaccaactcttgtattgaacaagattcgtggtacctttaatgttgttgctgttaaggctcctggctttggtgaccgtcgtaaggctcaacttcaagatattgctgttttgactggcggtactgttatttctgacgaccttgggatgagtcttaaggacgctactgttgatcaattaggtcaagcaaacaaggttacagttacaaaggatactactactatcgttgatggtgctggttcaaaggaagctatccaagaacgtgttgaccaaattaagcaagaaattgctaagtcaacttccgactttgacaaggaaaagcttcaagaacgtcttgcaaagctttcgggtggggttgccgttgttaaggttggtgccgcaactgaaactgaattgaaggaaaagaagtaccggattgaagatgccttgaacgctactcgtgctgctgttcaagaaggatttgttcctggtggtggaactgctttaattaacgtaattcctgctcttgacaagattgaagccgatggtgatgaattaactggtatcaatattgttaaggctgcccttgaagcaccagttcgtcaaattgctgaaaacgctggtgttgaaggctctgttattgttaatgaattaaagaacgaaaaagaaggtattggttacaacgctgcagatggcaagtttgaagatatgatcaaggctggtattgttgacccaacaatggttacccgttctgctcttcaaaacgctgcttccgtatcagcattgcttcttactactgaagcggttgttgctgataagccagatccaaatgctaataaccaagctcctgctgctccacaaggcggcatgggcggtatgatgtaataccatttgactaaaatttaattttgtgggcagaaaagattctaatgtttgttttttcaaatgttgggatctttttttattggaggaaaatcaatgacgaaaaatgcaaccagtgtctataactatttagacaacgaaaaaataaactatcaaattgttactcatcccccagtctatacagcggaacaagcagacaagtatgttcaagaatatcaatttgcccgtacgaaaaccctttttctaaaaaataaagctggctattatttagttacaatcttagaaaataagcgtctcaatatgaaaaaattgaaagagaatctatcgactagtcggttttcatttgcccacccagaagaattagctatgaagttaggaataacaagtggggctgtttcaccctttaacttgtttaatgataaacaacatcaggttacctttattattgatgctgatatctttaagaacgaggagttaatagggtgtcacccaaatattaatacggccacagtgattttgagaacaaaagatttgcttcaaataataaagttgaatggtaattcagttaaggcggttcaactataaagttaatctaaaaatcttaaattgtggtaaagtaaattagtattaatttttaaccaaactataactgaaaggaactaagaaatggaaaaaatgaaattccagaagataacgctattttctggtgtaatgcttgccttaaattccttaattggttcagggtggttgtttggtgccggaactgctgcaaaggttgccggaccagctgctattttgtcatggatcttaggagcaataatcattattagcattgcccttacttatgttgaattaggggcaatgtttccagaaagcgggggaatgagtcgttatgctcagtatagccacggtccgtttttaggctttattgctgcatgggcaaattggatttcattaatcactttagtcccaatggaagcagtggcctcggttcaatatatgagctcgtggccgtgggcatgggcaaattggactcaccactttatgaaaaacggtaatattacgactcctggattgttagttgtatttggctttatgctggtttttactttgatcaatttctggtcggtaaaattgatgactcgctttactaacttaatatcaatttttaagattttattaccgacactaacaattgtgatgcttattgcggcgggttttcatcctagtaattttggtcatagcgtaactacttttataccatatggtagccggtcaatctttgaagcagctgctatttctggaattattatgtcttatgatgcctttcaaacggtaatcaacatgggaggagaaatgattaatcctcataaaaatatcgtgcgaggcgtattgatttcaatgattattaccgctgtgatctatgtcatgttacaagttgcctttattggagcgattgatccgaatttattagcgcaaaaaggatggcatgggattaactatacgtctccatttgctgatattgcgatcctgctggggatgaattggcttgcaattttgctatatatggatgcttttgtttcaccatttgggacaggggttgcgttcgtggcgactgcctcacgagcattggcagcaatgactcatactggacatttgcctcaatggttgggacggctagaacggcgctacatgattccgcggcttgcaatggttgtggatctaattttagcggtggtaatggttagtctcttcagaaattggagtttgttagccactgtaattaccggttcaaccttaattgcttatcttaccgggccagttactgtaatgtcgcttcgcaaaatggatgctaatttaaagcggccgtttcatccgcattttatgtcctggttggcgccatttgcatttgtcttgacgagcctttcaatttattggacaatgtggccgacgactgttcaggtaattggggttatcttattaggcttaccaatttatctttattatgaagttaagtatcgtcacgcatcagggctacgtgacttacgcaatagttattggatgttggtttatcttgtttttatctcaatagtttcttacattgggagtgaaggatttggcggcaaggactggttgaagtacccatgggattttgttgttattatcatctgctcgctaggattttaccggtgggctgtggctagccggatgaaaaaagtcgatcctgcggcagaaaaggttaatgccaaggtaaagatgccaggaaaagatcaatagatatatttgtaggttgcaaaattaaagaataaattgtaatattgtcacctacttaaaaagtgtaaaaatcaaaggagaaatagtatgtggcgctatttgaaacgtgttttaatcgggaaaccgttaaaaacccttgatgaagggcaaacacacttaactaaatttaaagcattagccatgctttcttctgacgcaatatcgtcagtagcatatggaccagagcaaattacaactgttctggtaactttatccgcagcagcaatctggtattcaatcccgattgcggcagttgtgttggtccttttgttagctatcacgttatcataccaacaaatcattcatgcctatcctagtggtggtggtgcttatgtcgttgccacacggaattgggggagtaatgggggattatttgctggaggatcattactagttgactatatgttaacggtggctgtttcaacgacatctggagttgaagcgattacttcggcagttcctgctttatataaattttcaattccaatcggaatcgttattgtccttttaatcatgtttatgaatttacggggaatgagtgaaagtgcaaacttccttacaattccggtatatttctttgttattatgatgattgtgatggtagtgtggggtggctataatattgccactggtcatattcattaccgggcaattgttgattatggaacaccggtatcgggaatgtcatttgttttgcttattcggtcattctcagctggttcgtcatccttaactggggtggaagccgtaagtaatgctgttcctaactttaataagcctaaagaaaagaatgcatcaactaccctggcaattatgagtgctattttagcgttcttctttattgccattatcttctttagtttttatctgggggtagttcctaattcacggacaacaatcctctcccaaatggccgcacaaatctttggtgggcatgggctaggcttttacctcttgcaactttcaactgcaatgattttagcggtcgctgctaatactggtttctcagcctttccaattcttgcctttaatatggccaaagataaatatatgccgcacgcgttcatggatcgtggggatcggttaggttactctaacgggattatttccttggcgattggagcaattattttgatcttgatcttccatggtcagactaatatgttaattccgctttatgcagtaggggtatttgttccatttactttatcgcaatctgggatgattattcactggtttagagaacgggaaggtttctggttagggaaagcctttattaacctagtaggagccttgatttcatttgttcttgtcatttgtttgttctggcaacactttgcaaatgtttggccatacttaattatcatgccgctgcttttatggatgttccattcgattcaccggcactatgtaaaagtagccgctcagttgcgggttactgaaaagacgaaagttcaattacatgattacgatggtgcaacggtgattgttttagttggtaatgtaacccgggtaactcgtggtgcaattaattacgctcggtcgattggtgattatgttattgccatgcatgtttcgtttgatgaaaatccaggcaaagagcataaaacagcaaatgaatttaaagctgaatatccagatgtccgttttgttgatattcactcttcgtaccgttcaatcgcaaaaccaacgttacgttttgttgatgtgattgcaaaacgagcagaagcaagaaattattcgacgactgttcttgttccgcaatttattcctaaacatccatggcaattggccttacataatcagaccagtgttcgtttacgggcgttattgaattcccgagagaatattattgttgctagttataactatcatcttcaagaatagtttatttagagagaaagtattgatttaatgaataaaaagcaactattatgggggcttttgtttgcagttggccttttcatggcggcaagttataccattgataatcgtggctttcattctggaatatacggtatcattggctgtgctttgatcttaatcgcgtatgcgggaatgaattgggaaaaactgcaatcaaaagatcaacatacgagaaaaattttagtgcttttgagcagtattttagggattatcattgtccttgatattgctgaaatgattttaggataattaaataaagcttattgagggagcgagacagaagtcacttgtgacttcgtttttcgacgcgaagctagcctctgggagcccccgcaagcaacagtaggcctccaatgttcggttttgtcggacgttggaggccattgttgtactgcgtatttgctttttatgaaagtaacttaacttatgtcacagtcctttttatattaactaataagctaaatcatattatcctttttgctagtcggctaacaaaaaggagagatgaaaattgctaataggtcgtctagtaaaacaagctaacaatgcgatgaatcaagaaatgaatgcatttgcgcagcagtatggattgacaggaacgcaaatgtcgattattgattttttaacgcatttcccgggaaatagttgtgatcaacaccagattgaaaatgaatttggaataaagagatcaaccactactgtattacttcaacgaatggcaaagaaaaatttaattgaatgttatccgtcaccagaagatcgccgtcaaaaaatcgttacgcttactgcagaaggccaaaaattatcttcagatgtaagtgcgtatattacacaatacgaagagaaattaaaagcagattttagtgaacaggacatttcgaaaataagacgattcttatcaacgatgatagaggagaaataatgagtacgaatactgaaaaaatttcggcaaaagttgttgcagcgattgtggcaaccggattgatgtcattttgtggggtaattgtagagacagcgatgaatgtgacttttccgatcctgatgcgtgaattttcgattactactaatcaggcccaatggatgacttccatttatttgctcttggttgcaatcgttgttcccttatcggcaattttgaaaagctcttaccgaacaaagatgctttttacagttgcaaacttgctttttatcagtggaataattattgatgcactggcgccattatttggggtgcttttagttggtcgtacaattcaaggaataggaactgggattgcattaccattgatgtttaatattattatggagcaagttccaacaagcagaattggctttatgatggggagtggaaatcttattactggagttgccccagcgattggtcctacttttggtggaatcgttgccagcaagcttaattggcggtgggtattttattcattaattccgcttttaattatttcgtttgtgcttggtgaatggggaattacccaaaaatcaccgattaaaaagcaacaaattgatctttttagtatattaatgattgtattcatgttctgtggttttgtaacagaatttagtaacctgggaagccaagccttcatgaccttttcagttggtagtgcattgttaatcgggatcttaggaatgggactttttgctcggcgttcattaaccctaaaagaaccaattttacaattacgattatttagaaataaaaaattttctgggcatattcttggtttctttttaacccaacttatttcgttaggctttgcatttcttttaccaaactatattcaattggtaaatggtaatagtgcaatgacagctggcttgattgtccttccggctggttttgtgggtgcgatatttgccccattgggaggaggattttagataaatttggcgctcgcaagcctattttgattgggacttcattatgtctaattgcgcttattgcttttacaatctatggatagcatttaacaaatatatttattgcgcttgtttatattctctatatgggtggaatgggaatgtgcatgggttgcgtaatgacaagtgcattaactgttgttggtaaagcaaagcaatcacaaggaaatgcgatccttaatactttgcagcaatttgccggggcaattgggacctcattagtagcgatgattgttgcagccagtcagagtcatctccacacgactagacgtatctctacggcaattggtactcaagaagcttttggcatgttaacgattttttgtattataatttggataagttactatcgaagtgtgaaaaaataaaatatggtggattatagaatgaagttagccacccagttggtggtaaataaaaaacgccattcggcgtgacatcaggtatcatattaagtgaaccaaacctatatgaaaggatgtccgtcaaatgacgcacttaaatgataccatgtctactagtttattgactactcataaaaagaatgctcatcttactaaagaagaacgtgtgatgattgcgactttaaagtcgcaaggactttccaatcgcgcaattggtcgccaattaggagttaattatcaaacaattaataacgagctcaaccgtggtacggtccgccagcttcgtcgtcaaaaatctaatggtaagatttacgaatattcttactacatctatagttatgaagctggtcaggccacatatcttgaacatcaccgccattctggtcgtcgttgcttatgttattcttcaaagcaatttttacgattagctgatcagctaatgcttggtgagtttgacgaccaacattactccccacaagcggttatttataaggctcaagatttaatgaatgatggcaccctgatcccaaagtcggttgtaactttatatcaatggattaatgagggtgtgcttcgtacgtctaatttagacctctttgaaaaacctaaacgtaagcatcgtcgaactcatccgcaagctaaaaggtgcttagggcctaatattgctcaacgacctcaaactgcggaccaacggtccgaaattggccattgggaactagatacagttcagggacagaaaaacggtaatgacagtgttgtactagtaatgactgatcgcctttcacgagttaatatcacgagtaaaattgctggtaaaactgcgcatgcagtaaatcaattctttataaatttacgccagaaaatgggcacagatgcttactatcgcatctttaagacaataacctctgacaacggttcagaatttagtgagttaacacaagttcacgatcatgttttctatgctgatccgtattccccttgggaacgtgaatccaatgagatcaataaccggtttctccgcaaggagattaccaaaggtgaagctataaataactatagtagtgctcagatcatagcgactaatgattggatgaatcactatccacgagctatgtttaatggacattcgtcaatggatatctatcgtaaggccttctaccaagagatatcacagctccatcaaccaataatcaattggtcagtattatttatttgagtccagtggctaacttattcttgaaatttaggaaaaataaaatattaaaaaattcaggctagaaaattctaacctgaattttttaatatggaatttcgttaaatcgctgatcgccctcagttatttgaagctggtcgttaaaacgattaatgagcttttctttgacatcttttaagtccgtttcgtttacataaatacttgtttcaacattaaccccgtactcctcactagcaacctcaagattgttctccttgaggtagtaaagaaggagatcgtgaagagcataggtaacagtgatttttagaatttcttgcttgatccgttggacgagaccagcctggtggattgcttcagtagttgtattgctatatgcccggatgagaccacctgcgcctagcttaatcccgccgaaataacgggtaaccactgctacgacattgtggatctttgcaagtttaagcgattcaaggatcggaattcccgcagttccgcttggctcgccattatcactttctcgctggatctggtcgttgtcaccaatcatgtatgcaaaacaattgtgagtagcttttttattagctgcttgaatactggcaataaactgttgagcttcttcatctgaggagacacgggcaatggagcaaataaatcgtgattttttaattatttgctcataagtagtgtttttggcaattgttaaatatggttctgtcatttttaaacttccttcgtgctattttaattagtttacgtatatataaagtaggaggtgaataatggatctagaaaattattatgggagacgagtcttggcttcgcgtcatgaggtgaaacaatcaggaattcaagaactgccaacaatcagaattgacgctggtaatatcagatgctatcgctgcaatcatgtcacggcaaaatcgctgggcgctttgccacaaggcgagttctattgtccgcattgtattaatcttggacgcgtttcaacgttaaataaattttatcatgttccagagccaaatcaatttacggttaccgaaccggtattaacctggaaagggaaattgtcgcctcttcagcaacaagcttcagaaaaaatttcccggggaatggctgaccatgtccaacaattattatgggcagttacaggtgctggaaagactgagatgatgtttgcaggtattgcggcagctattgaacgtggtgagagaattggaatagcttctccacgagtagatgtttgtttagaattatttccccgtttaaaagctgcctttgctaattgtgatattgctcttttgcatggtcgacaagaattaccttatcattatgcccaactgactatttgcacaacccatcaattgcttcgtttctatcatgcttttgataatttaattattgatgaagtagatgcctttccgtatgctgctaatgcttcgttattatatgcgactaagcaagcaataaaagagaacggagggtgtctttacttaactgcgaccccaggtgatgctttgctgcgagaaattaaaagtaaacgattagttgttaattatttgcctcttcgttatcatgggcatttacttccacaaataaaagttagactagcttttggatggcggcgacgattagaacgtcagcaattacccccgcaagttattcaacagttgcaggaaacgctaaaggaaggccatcactttttgctatttgttcctcatattgcagatttagcattggttgaagctgcattacggcattcttttacaactttccgctttgctactgttcatgcaagtgatctagaacgattagaaaaagtccaaaaaatgcgtgatggtgattacgactttttagttacgacttctattcttgaacggggagtcacttttccagaaattgatgtctatgttttgggtgccgatgatccagttttttcctcctcggcattagtgcaaattgctggtcgagctggacgttcgcaaagtcgaccaactgggcgggttattttttggatcaattgtaattgtcgacaagttaatcaagctgtttcccaggtgaagtacttgaatcggaaaggtcaaaggttaatagatggagtgtcttttgtgcaataaagggatatctttccaactaactttgaaagatatttttagctttcgcgaaattatcacgccagtagtctgcactaaatgcaaagaaagttttgtgcgctgggatgatcacggatgtgcaggatgcggtaaagaaaatgttaataaaaatggtttcttatgtgcagactgtcagacttggaagaaactttatggttggtacttgcatcatcgaggattatatcggtataacgaggcgatgaaagaatatatgcaacgttataaatttaatggcgattatcgtttatgcgtggtatttcagcgtgaacttagcaaagtggttaatgaacagaaagcagatttaattgtcccgattccagtaacgtcgacaacgatgcaaacgcgtggctttaatcaggttattggtctattatgcgaagtaccttaccaatcgatcttacgaactaagataagttcaaaagtggcacaatcaagcaagacaaaggaagagcgacttgcaactaaacagccattcatacttgatgcaccagaaaaagtaattaataaaaaggttcttttagttgatgatgtttatactacaggaaggacactgtatcatgcggcaaacctttttaagcaagctggctgtaaagagattggtagcgtttcactagcacgttaaattcttcttaaaatgtattaataaaatttgttaattaacacaaactaatctataataaaaataggatatgagaagagtggtccttctgatatcagatcaagcaattgcttggctgaaaggagagaagtacaatgttaaagttcaatattcgtggtgaaaatgtcgaagttactgagtcaattcgtgattacgttgtaaagcgaattagcaagcttcaaaagttctttgaagatagtgttgaagctaccgcccacgtgaacttaaaagtttatccaaaccggacgtataaggttgaagtaacaattccacttccatacctaacgttgcgggcagaagagacttctaatgatatgtatggaagtattgacttagttactgataagcttgaacggcaaatccggaagtacaagacgaaggttaaccgtaagtcacgtgaaaagggcttaaagaaccttgaattcatcccatctgataatgatggaacagatggacaagatgatgaattaaagattgtacggacgaagcaagtttcattaaagccaatggatcctgaagaagctgtccttcaaatggatatgcttggacacaatttctttatcttccaagatgctgaaactaatggtacaagcattgtttaccgtcgtaatgatggtcgttatggcttgattgaagctgaatagtcaatgccaatatgaagagcgcggatgagaaatcattggcgctttttgtatcttataacttatagccaccttgtaatatccatactaataatttttatttatactatgaacgtggtaaaatattatggttagagtaaaaaacataattggcttgagtagtacttttttattgattttggacttaagccagaaagtaggaaggacgcttttatggccaatattctaaaaaaatggattgaaagcgatcgtcgtgaattacggcgaattaacaaaatagcaaataaagtcgagagttatgctaaacaaatgtctgaactaactgatgaacagcttcaggcaaaaactgatgaatttcgggaacgttataaaaagggtgaatccttggatcatatgttgccagaagcattcgcagtttctcgtgaaggggctaagcgggtcctaggactttacccattccatgtccaaatcatgggagggattgttctccacgaaggtaatattgcagaaatgcggactggtgaaggtaagacattaactgccacaatgccggtttaccttaatgcaatctcgggaaaaggtgttcatgttattactgttaatgaatacttgtcaaagcgtgatgctactgaaatgggacagctttataattggcttggatgttctgttggtattaacaactcagagatgagccctgatcaaaaacgagaagcatataaagctgatattatgtattccactaatagtgaaattggatttgattaccttcgtgataacatggctgtttacaaagaagaccaagtccaacgtggtttaaactatgctttagttgatgaagtggattcaattttaattgatgaagcgcggacaccattaatcatttcaggtccaggaacgggcacttctaagttgtacaagcaaactgatcggtttgttaagcaattaaagaaagatgttgattataagattgatcttgaatcgaagacagtttcattaactgatgaaggaattaaaaaagctgaaaaatacttcaacttaaagaacctatatgatccagaaaatactgcgctgacccaccacttggatcaagcgttgcgtgctaactacatcatgcttttggataaagattatgtggttcaagatggtgaagtattaattgttgattcctttactggacgtgtaatggaaggtcgacgtttctctgatggtcttcaccaagctattgaagccaaagaaggcgtagagattcaagaagaaaacaagacaatggctaacattacataccagaacttatttcggatgtataacaaactggcggggatgactggtactgctaaaactgaacaagaagaatttcgtgaaatttacaacatggaaactattactatcccaactaaccgtccagttcagcgaaaagatgagcccgatttgctttacccaacgttacaaagtaagtttgtagctgttgtcgatcggattaaaaaacttcatgctaaagggcaaccaatcctagttgggacagtcgccgttgaaacctctgaatacttatcccaactgcttgataaagagaatattccgcatgttgtcttaaacgctaagaatcacgctaaggaagcggaaattgttaaaaatgccggtcaaaagggtgcagtaactatcgctaccaacatggcgggacggggaacagatattaagttaggccctggcgttcgtgaaattggcggactagcagttattggtactgaacgacatgaatcacggcggattgataatcagcttcgtggacgttctggacgacagggtgatccgggattatcacaattctacctatcgcttgaagatgatttaatgaagcgatttggtggagaccggatcaaagccttcttggagcggatgaaagttaatgatgaagatgctgtcattaaaagtcgtttcttgactcaccaggttgaatcagcacaaaagcgagttgaaggtaacaactacgattcacggaagaatgttcttcaatatgatgatgttatgcgtgaacagcgtgaaatcatttataaagagcgacaacaaattatcactgaagataagtcgctgaagtgggttcttatgccaatgtttagacggacaatccagcgtgaagttgatcaacatactcttggtgacaagaaggattgggatttacaaggaattgttgactttgcagaagaagtcttaatcaagcctgataccatcacagttaaggatctagaaggtaaatcacctcaagaaatggtagattacttgatgacatttgcccagggagtttataaggaaaagcaaaaacaactttatgatccagcacaaatgcttgaatttgaaaaggttgttattttgcgggtggttgactcacactggactgatcacattgatatcatggaccaattccggcagtcagttggtttacgtggatatggacaattaaatccattggttgaataccaaactgctggttatcacatgtttgaacaaatgattgctgatattgagtatgaaactactcgactcttcatgaagtcagaaattcggcaaaatgtaacacgttaattgttaattactactaggtacggcagtaaggtaacccatggcggtaccgctgccgtattgttgtataacggaggttcgattgtggaattaaatgaagcaaaaaaacaagtagaatcaatgcaaaaagaagttacgcacttcgggaggtctctttgacttagatgcactagatgagcgcattgcagaaattgaacaagagatggctcaaccagacttttggaatgataatgagcaggcacagaaggtcattgcggaaaataatattttaaaagaaaaacgggatacttttgtgaatttacgtgatcagattagcgatcttgaaacgtcgcttgaattgctcgcggttgaaccggacgatgatttacaaaaagatttcgaagcatcatttacaaatacacaaaaggctttagaacagtatcgcttaacgcaacttcttgatggggagtatgacgctaagaatgctatcttagaaattcatccgggagcaggtggtactgaagcccaagattggggtgaaatgcttctgcggatgtatattcgttggggtgaacagcatgctttctccgttgaaacagcgagttatgaagccggtgatgaagcgggtatcaagagtgttacgctgctaattaaagggcataatgcgtttggttatcttcgtagtgaaaagggagtccatcggcttgttcgtatttccccatttgatgcggctggtcggcgtcatacatcatttgcttcggttgacgtaatgccggagttggatgatagtgttgaggttgatattgatccatcagatttacgagttgatactttccggtctagtggtgctggtggtcaacatattaataaaacagaatctgctgttcggattacgcatattccaaccgggattgtaacctcttctcaagctgaacgatcccaacttcaaaaccgagttactgcaatgaatatgttaaaatcaaagttgtatgaactagaagaagaaaagaaagctaaaaagcgggcggaaattgagggcgaacaacttgatatcggttggggttctcaaattcgttcatatgtttttcatccatacactctagtcaaagataatcgaacaggttatgaaacccataatggacaagctgtaatggacggggaccttgatccatttattgatgctttcctacagtggaaacttagtcaaaagaatcctcaataagttatttagtttggaaggaagtgagtaaagtgcgcgaaagtcaacataaaagattaactcgctcaggatcagatcgaatgatagctggtgtatttggtggaattggccagtactttaagattcagccaaatattttacgtactttatatgtcttactgactatttttaccggttttgttccaggcattattatctatattattttgataataataatgcctgctgatccgcaaaatcccgatttactaggatttttaaagtctttcagtgaatcacaaaaaacatctcaacagcctcaccaacgttctcggcggactttaacgaatgtcgaggaaaaagacattaaaagaaatggaagatcatgatggaattttggaaaagagtattgattgatacaatcctttttattgcccttgctggtttatttgccggaacagggatgttttatattacaagtgcttggattgcaccattggcaagctttgttttagcaattttgaacgttgctattaagccaattttagtaattttatcgttgccgattaatattttgaccctgggcctttttagtgttgtaattaatggaattatgctacaactaacatcgatgcttgtcgggtcggcaaactttcatttttcgtcatttggttctgcaatgttgattgcgattattatggcaattttcaatgcagttattacaagtcacgaggatagattgtaaaggagtggagaaaatgccaaacaatgtaacggtgcaagaattagttgataaggtccggttgaaagtcttacaaggagaagattacctccaacgtaagataacaactagtgacatttcacggccagcacttgaatttgcgggatattttaagcattaccccgcagcacggattcagctgttaggaatcaccgaaacctcatttgctaaagacttaactcatgagcaacgtgaagagtacatgacaaaaatgtgtatgccacaaacaccatgttttgttatctcaactaatctgccaattcctaaggagctaaagaaggcggcggaagatgcaaaaattccaatcttaggaacgcatttaacctcttcccaaatattaagtaacatgacttcttacttgcttgaacgtttggcaccacgaaaatctctccacggtgtattagttgatatcagtggggttggagtactcattactggtgattcgggagtgggtaagagtgagaccgcgttggaacttgttcgtcgtgggcaccgactgattgctgatgatcgggtagaagtttacgctcgtgacgaacagaccttggtagggactgctccgcaaattttaaaacacttaatggaaattcgtgggattgggattattgatgtctctacgctttatggaacaggagcaattatgccttctgatcaaatcagtttaattgtacatcttgaaacgtggactccagatgtacagtttgatcgtcttggtgatcgtggagatactcaaataattcaaggcgttattgtgcctaaagtttctgtcccggttaaaactggtcgtaatttagcgattattattgaatcagctgcaatgaattatcgggccgagacaatgggctatgatgcgactgaaacatttgatcgaaaccttaaccagttgattaagcagaattcagaacgtgatagtaaaaataacaaggggtcggcaaactagatgattaatccaggaataaaagccgctttaaacccaattgctttccaagctggtccatttactattcactggtatggcgtcattattgctagcggggtagttttggctctcttgttagccgttcgcgaaggaaagcgagaaggaatttctgaagatgatttttatgattatcttttatgggcgctcccaattgcgataatttgcgcacgaatttactatgtagtatttcagtggagctattattctcagcatccaagtgagattattgctatctgggatggtggaattgcgatatatggagcgattttaggaggctttattgttttacttgtcttttgccattaccgtcatttatctagttggctgatgatggacatcattgccccaacccttattatggctcaaggaattggccggtggggtaactttatgaatcaagaggcatttggtgatattacgacacgggcgcatttaatggctcagcatattccaaattggataataaaccaaatgtatattggtggtcactatcgaattccaacgttcttatatgagtcactatgggatttaactggctttgcattactaatgttacttcgtcatcgcaaacatttatttcgtcgtggtgaaattttcttaacctatgtaatgtggtatgcatttggacgtttctttattgaaggtatgcggactgatagtttaatgctcggaaatattcgcatttcacagttactttctgtagtgttttttgttagtgcattagtaatactaatagttcaacgtcataaaaacattccgtggtatgataacggaataaacaaaaattaattgaattggataaggagaaagaattatggcagaaaaaattgctgttttaggtgctggttcatggggcagtgttttagcaaacatgcttacagaaaatggtcacgatgttacattatggtctcgtaatgaggaacaagttaagcaattaaatactgaacatacaaatcctcgctatatgaaagattttgtttattctactaaattaacagcaacaacagacatgaaaaaatctgttaagggtgccagcgtgatactgattgtgattccaacaaagggtcttcgtgaggttgctaagaaattaaacacaattttgactgaattacaccaaaaaccgttaattattcacgcaacaaaaggcctagaacaaaatacatataagcggccatcagaaatgcttagtgaagatatttctcctgaaaatcgtcaggcaattgttgttttatcaggtccgagtcatgctgaagatgtggcaattaaagatatgacagctgtaactgcagcttgtgaggacctaactagtgctaaaaaggcgcagaagttatttagtaattcttatttccgtgtttatactaacgacgatgtaattggtgcggaatttggagcagccttaaagaatattattgcaattggtgctggagctatccaaggccttggctaccatgataatgcacgagcagctttgattactcgtgggcttgcagaaattcgtcggctgggggttgcttttggtgctaacccaatgacttttattggtctttctggtgttggtgaccttgttgttactgctaccagtaaaaattctcgaaattggcgtgctggctatcaattgggacaaggaaaaaagcttcaagatgtaattgataatatgggaatggttatcgagggggtctataccactaaggccgcttatgaattaagtcgtaaacggcaagtacagatgccaattaccgaagctctttaccgtgttttgtatgaaggtgaagatatcaaaactgcaatttctcagttaatggaccgagatcttacttcagaaaacgaataaatatggtaaaatactagaggatggatattgagagaaattgaaacatggaaagggttttacaagtatgaaacgtgttagaaaagccattattcctgctgctggtttaggaactcgttttcttcctgcaacaaaggcattggcaaaggaaatgttaccaattgttgataagccaacaattcaatttattgttgaagaagcgcgcaaatcaggaattgaagatattgttgttgttgatggaaagaataagcggtctattgaagaccactttgactctaatccagagctggaagataatcttcgttcaaagcacaaggacgagatgttaaagatggttgaagaaacaactgatgttaatatttacttcattcgtcaatctcacccacgtggtttaggggacgctgttttaactgctcgtgattttatcggggatgaaccgtttgttgttatgcttggggatgaccttaataacattaacaacaagaatgaagctttaacgaagcaattaattgaaagttataaccaaactggcgcatctactcttgcagttatgcgggttccacatgaagatactgcaaagtatggtgtaattaaccctagcaaggaagttacgccagggctttataacgtaactagcttcgttgaaaaaccagctcctaaagacgcaccaagtgatttagcaattattggtcggtatgtctttactccagaaatctttgatgtattagcaaagactaagccaggtaagggcggcgaaattcaattaactgatgcaattgatactttgaaccaaactcaacgggtattcgctcgtgaatacaagggtgaccgttacgatgttggtaataagttcggctgggttaagacaaacattgaatatggtttggaacacccacaagttaaagaagaattgcgtgaatacattaaggaattaggcgcaaagcttgctgctgaagataagcaaaataattctaagaagtaagactagcattggcctgtaaaaaataaaccttcaagattcgttatagggatcttgaaggtttattttttacatatcttcaacaactacatattccatatcaagtgggccgtgaacaccaacgattaacaccatttcaatatcaccagaattggatgggccggtaataaagttgatgtttgatgtttgtaaactaccatcctgaattgccttttgataataatccattgcttgccgtgaacgtggtaaaattttgctttttggcacaatagctaggtaatgagttggaagaaaatgaaacatccgtccttgttgtgggtaggtcgcaactgttacggtccctgactcagctaatagaaagtccgcaaagccaattgctccatcactgttatttgcatttacaatgttttgccgcccaaattcaggttcccaatagtaaataggatctactcgtaaattatcttgccatttccccaatgaataatcttgccatttttcttcatcaaaggagggaagcattaaacttttaatctccttttcttggataaaatcattaagagtgtggccaagatcggctgatttaacaacatggaaatcaacatgaacttcttcgctatttttgcgtgcaagttcaagaagttcatcttggctttttccagcaagggtagtttctggaagattattaacggggacaaatggattttcaccaagcgtatggcgaggacgattggcagcctttgcaattcgatttaagaagtcttcttgatttttagcggtgtttgcttcttgtaagtaatcagtcattttcttgctcctcctcttcttcgtaatgacgataccaatgccggaagttttggtggtactttggtggaacagcaagatcacgaacatctacccagccatgagctagtttaggagcaattgcgggaaggtggttaattttaccatctggataaaggttcttaatgtctttaggagttgtcttcttgccaaatggctcaagagcaatatgagcaaatcgcattgcatcattaaaaagcgtaggggagctcgtacctttaccaactgccttcaaaagagcattcgaaggactgtgatctaaatgaagttcatccatttctacataacggtgatgacggattaactcatgaaggggaattttaacaggacaagtttccgtgcaagcagcacataaactacatgcatatggcaattccttgaattcttgataaccgcctaaaatcggcgaaagaacttcacccattggtccaggataaatcgatccatatccctttccaccgacttgccggtaaacggggcaaacgtttaagcaagaaccacaacgaatacattgcagcattggttcaaagtcagtgttaagcatcttagaacgaccattatcgactattacaacatagaagtcatctggtccatctgcttcatccgcttctttaccttttgagaaagtacagtaactagttagtttttgaccaactgcacttcgacataaaacattgtcaaggacttctgcttctttcaaacttggcacaattcgttccatccccatgactacaacctgggttttaggaatggccatactaatatcggcatttccttcgttggtaacaaggttaatcattccattatcagcaatcgcaaagttacagccagtaatgccaaagtctgcttgcataaagtaattacggagatagtgacggacaaacctagccatatgttcaggatcattgtcaccgtcataaccaagcttttcaaatactttttgaatttgattgcggtttttatgcagcgtggggaaaacaatatgtgttggttcatcccaattatcttcttgcaaaataaattcagctaaatctgtttccattaatgaaagtccggggattgtgagtaattctttatccaatccaatttcagtagtcaccattgacttagatttaacaacatgatgaacgtttttcttgattgccaattgtttgataaaggcacttgcttcgttaccatccttggcaaagaaaacatgaccaccatttttttgaacattatcgctgaattcttcaaggtaatccgggagatgcttaatgacgtgttgacgaatttcagcagaaagatcacgccagccttcccagtgtcctaattgacgccgtgcttcagttcgtttttgaaattgagcgtcttgtgctttagcaaccgatgcccgcataaatttatcggcttctgcgtctttaattcgttcagtaaaaggcttatcgcttgtggctattcccatctaaaacaccccgtttccgtttgctggtaccattacatgatccgtatctttgacataagtgattcggctagtatcaacgttatgattaaggacctcagcaatgtgcataattgtaatatgagagccatcacggcgacggttaattcgtccaccaatattcattaaacatgtttgctcgcaagcaataagaatatgtgctttcgtcttcaaaacattatttgctttatcatcaaccatcgcttcagagagaaggggttctttagcagagaatgttccaccaaagccacaacataattgaatgttatgaaggggaataagctcaagtcctttaacatgttcaagtagaacgatgggggctgtccgttcaccaagaagacgggtcatgtggcaagaacggtgaaaggttgctgtatcatctagttctgcaccacaatcaagaataccgagaacccggtaaataaattgcgttagttcaaaagatttatcataaaggatttgcgctttcttcgaatactctggatcatctttgaaaatgttcttgtattcatgaagcatggcaacacatgatccagaaggcccaacaatataatcggcgtcaatacttaaaagggcatcgagttgatttttaaatgtagtaattgtttcacgatcataaccgctattataagttggttgtccgcagcaaatttgtttatcggggaaaaatgtttcgcagccaaaacgttggagaagttcaaccgttgcctttccgacatctggataaagcagatcaacaatacaagtagaaaaaatacagactttcatacatgcgtgcattaattggatgcacttcgcctccttaaaaatcgaaaaaatataattgcttatcataataagtataactcaaatatgataatattagagttgaaaacgatttaattatttgaaactaatatataaaatcataatattgattatagttcgacaagaatattactattaaaaagtaagcaaaatgatagacaaaaagatccaaagtctgtatgatatggatagtaaaaaaattgttcgaggaggaagagagaaatggctgaaaataagcaatatgatgttgtaatcatcggtgctgggccaggtggaatgaccgcagcgatgtatgcatcacgagcaaacctatctgtcttgatgcttgatcgtggaatttacggcggaaacttgaataatactgctgaaattgaaaattacacaggattcaagagtgtgaagggtcctgaacttgcccaacaaatgtatgaaggtgcaactcagtttggcgcagaatatgcttatggaacagtaactaaagtagaacttgatggtgacttaaagaagatcactactgacatggatgaaacatatactgcaaaggcggttgttatcgctactggctctgatcagcgccacctcaatgttccaggagaagaagaatttggtggccgtggtgtttcatactgtgcggtttgtgatggagccttctttaagggaaagcatttaatcgttgttggcggtggtgatgcagctgttgaagagggagtttacttaacgcaattagcctccaaagtaacagtgcttgttcgtcgtgatgagctccgggctgaaccaattattcaagcagaagcgatgaataatgacaagattgagtttgtttataacactagtgtgactgaaattgttggggatgatattaaagtaacaggtgttaaaactcataataataagactggtgaagatggtgaaatggctgcagatggtgtcttcatttatgttggtaatttcccaaagaccgctgcttttaagaatttagatattcttgatgatcaaggctgggtaaagactgatgagcgaatgcggacagcagtaccaggtatttttgccattggggacgttcgtgaaacaccattacgacaggttgcaacagctgttggtgatggagcgattgctggccagcaagtttatcaatacattaaatcgatggattaataaaaaggtgttagagaaaagctctagcatctttttttatttagtggtatagttttgattaaaatttagttagaaaaggagggcgattaccattggaaaatgatgaaaaaataaaactattacagaagttaattcagattgatacagtaaatggtaacgaaaaggacgaagcaagttatattaaaaggaccttagaagatcatcatatttcctgtgaattagttccttttgcacccaaccgcaccaatttaattgcggagattggtgatgaaaaggggccggtactcgctctttctggacatttagatacggtagctgcaggtgatttccaaaaatggacatatccaccatttgctggccaattagtagacggtaaaatctatggtcggggagcagttgatatgaagtcgggattggcagccatggtgggtgctttaattgagcttaaagaagcaggtttgccaaaacatggaaaggttcgcttgattgccactgttgatgaagaagttggtggtcaaggttctcttgaaatgactgataaagggtacgttcatgatgttgatgtgatggtaattggggaagcaactactggccaaattgaatatgctcactgtggctcttttgattatattgttgagtcttatggaaaattggctcatagttcgcaaccagaattgggaattaatgctgttacaaatctagtgaaatttatcaataaagaatcacgggcgtttgacgatgcagcagtaagtcccaccctaggaaaattaattcatagtgtgactgtctttcatggtggagagcagttaaattcaattcctgattacgcatatttgaaggggaatgttcgcacgattccagaatgtgataatcgggaaacaggaaaaagactacaatcaatcattgatgagttaaacaaggagacaggggttgaattaaaactaaagatagttgctagttttatgccagtggttacaaataagcaagatcgcttcattgcacttgctcaaacggcaattaaaaaggttagcggcaggcaaccggatgtagtgatttctcatggggcaacggatgcatcccgctatgttttagacaatcacaattttccaataattgaatacggaccagggattgaaaagttatcacaccaaattgatgaacgtattgcgcttgatgattatttaacggctcagcaagcttacgttgaaattgctaaacaatatttgaataatactaaagacgatgaacaggctagtagttaagcatgaccgtacagagactccagctggtggaaaaggagcttttatgctaatgaatcacacctgggagtaaagattttttgactgaaagaagaatccgggagtcacccgttatcacaaagagtttcgtcgcaaatgactgaacttaatgaggcagttgctgtgaggtagctgtgaaaaaaggtggcaccacgcatactaaatacgtcctttgaagatttattcttcagagggcgtttttttgataaaggagaagatacgtatgaagaaaaagataattaatttcggattagttttaatattgcttttacctttaattgtttttgcaagtggctttaagattcaaaatgagaattaccgggcaaaccacacagatacgtgggaaagaataaagaagcggggaacattacttatcggggttgatgatacctttgttccgatggattttcgaaaaaagaacggtcaattggttggttatgatgttgatttatctcgcgcagttgcgaaagttttaggattaaaagctgattttcagtcaattgattggtcaatgaaggaaaccgaattaaaaaatggcacaattgattgtatttggaacggttatacagctactccttcccgacaaaaacgaattgcatttagcagagtttatgagctatctggccaatcattggtggtacgaaaagatagtaaaattaaaaatttcgcggatatgaaaggaaagacgttgggaattcaagaaagctcaactgctcaaactgattttgacaaatatccccaagtattgaagaaactagttaaaggacagaagccaattctttatcaagataactcgagtgctttcatggatctgcaagcaggccgcacacaaggagtacttgccgggactgtctatgccggctattatgcgacccacattgcaaataataataattataaattgatttcagcatctgcttatcctgcagaccgggttgcgattggaatgaggaagggggaccggacgcttattaataaaattaactatgctcttggggttcttcaaaaagatggtaccttacgacggattaataaaaaatggctaggaattaatagtaattatctgggaccggttgctgaatttcaaaaatccaacaataatcgttaatgatttgttaaaattttatataacaaggactaaggaggttttttaatgggtgcaatcaaatgtaatgatacattagcggtgtcaattcatcggattcgtaattcagatttaaacgaacacgggacagtatacgggggacgaatcttggaattaattgatggtcaagcctcggtagcagcaatgcgagtagctcgaacaacagttgcaacagtatcaatggatgagatccaatttctgcgaccatttgaccttcaagattcaatgtgtatggaggcatacgttaccggctttgggaagcgatcaattgaagtatttacaaaagtaattggtgagcacttgatgaccggtgaacgtttcctcggcttttattgttttatgacttttgtaattcttgatcctgaaaaacaaacggcatttaataaattaattccggaaactgaagagcaaaagacgttaatggcaacatattctcaacgtgttaagcaacggcaaatccagcggcaaaaacagcaagaatttctgcctcatatttcaatttccaagccgtggtaaaactttagtaaatttttaagtaaaaagcgacagatagcattttatgcggtatactaaaaagcagagtatgacataaaggagacattattgtgagctggaaagatacttataaggtttggcaagaacgaacagatcttgaatcagacttaaagcaagaattagctgcaatgagcgacgataaagaaattgaagatgccttttacggtccattatcattcggaactgcaggaatgcggggactaatgggaccaggaattaaccggatgaatgtttacactgtccgtcaagcaactgaaggtttggcaactttaatggattcattgggtgatgatattaaaaaacgaggagtcgctattggttacgattctcggcacaactcccgtaaatttgctcatgatgctgctcgtgtattaggtgctcatgggattaaggtttacatctatgataatttacgcccaacgcctgaattgtcatttgcagttcgtcacatggggacttatgcgggaatcatgattaccgctagtcataaccctaaggaatacaatggttacaagatttacggtgaagatggcggacagatgccacctaaagaatctgacatgatgacaggttacatccgtaagattgatgatatttttgacattgctttagctgatgaacaagaaatgcttgacaatggtttggaaacaatcatgggtgaagatgttgatgctgcataccttgctaatgctaagggtgtaactgttaaccctgaattagccaaggaatacggtaaagatatgaaatttgtctttaccccattatgtggaactggccgaatgcttggtgaacgggcattgcgtcaagctggttttacaaattatgaaatggaaccaactgaagcacaaccaaatggtgatttccctggtttggaacatcctaatccagaattcccagaagcatttgttcgttccattgcccttggcaaaaaagttgatgcagatgtgttgatcgccacggaccctgatgctgaccggcttggatgtgcagttcgtcaaccagatggtgaatatcaattgctaactggtaatcaaattgcttctatcatgcttgcctacattcttgaagcgcataaacaagcgggaaccttaccaaagaatgctgctgcggtaaaatcaattgtttctactaacttcgctgctaagatcgcagaaagttacggcgttgagatgatcaatgttttaactggtttcaagtggatcgctgaccaaattcatcaatatgagactggcaaagctgatcatacctttatgtttggttttgaagaaagttatggttaccttattaagccatttgttcgtgacaaggatgctatccaatccttaactttacttgctgaggttgccgcttattaccgtagtcgtaacatgaccctttacgatggcttacaagaattgtttaagaagtacggctacttccgcgaaaagacaattgctaatacttatgctggtgttgatggcccagctaagattaaggctttaatgaagaagttcagagaagaagccccaactcattttgccggtcatcaagtagtagttactgaagacttcgctaatgggactaaaactacagctgatggcgaagtaagtgaattaggtatcccagaatcaaatgtattgcgttacattcttgatgatgatacttggattgctattcgtccatcgggaactgaaccaaagcttaagttctacattggtacaagtgctgataccttagataaggcaaatgaaaaattagctgatttcgaaaaggctttacaagagtttgctgaataataataactgagagactgttgaaaaaactttgcttttttcaacagtctctgtttttatatacgatattggggatgtcactaagattaaatttttcctcacctttcttgaaatttcgccaaaaaattgtatgattgtacaaattaattattttttgggaggacttcatcgtgggaatgcatgaatatctgaaaagtttaagcgacctcgaaatgattaaccgtgctccaggatattttaaatttgaggaacacaatgtggctgcccattcatttaaagtaacgcaagcagcacaaatgcttggtgatattgaagaacaagccggaaatgaaattgattggcgttctttatatgaaaaagctcttaatcatgactatacagagcgatttattggtgacatcaaaacaccggtaaagtatgctacccctgaattgcgctcaatgctggcgcgggttgataaatcattaacagaaaacttcattcaatctgaaattccggctgagttccgggcagcttatgaacgacgatttgcggaagggaaagatgatactttagaaggtaaaatcctcgcggttgctgataagattgatcttatgtatgaatcatttggtgagatccaaaaaggtaatcctgaaccagtttatatggatatttataagtcgagcttgacggcaattatggattttcgtgatatggctagtgtccagtatttccttaagaagattttaccagaattattaaaagataatgcagatggtaatgctaaaaaccaattagcaattattactacgcaaattattcaacaataatttatgcttttaggcttccttttatcaaatagttgatttttgaaaacgctttcttataatagaagtagaaggtaaaaattaacaaagtaaagggaggcggcaaggatgacaccaagtttatttgcaggaacatttgcaattttagtattgtggctaatcgttgatattatctgggaattgagtcgaccaagagacattgtaatgcggcgcctctgtgcttggcttaatcttattgcgattattggtggtttttctgtattttatggagtaacccattttgataatgctaatcttgttccgtggtttatttgtttgaattggattaatgttgttgccgcgggcttacaattttactttggttactttcggcataattaaatgataaataaaatattttaagaagtgagtgaaaatgggcttgtttggagagattgttttctactcacttttttactgtaaatttatagacgaatacatgtttgggtgataaactaataacagtaaataataaatagttagtgataagtgggatgcggtaatttatgaagttgcgattccactttattttatttaactgcgacgtaagggaggaatttcttttgatttaccggcaaccagataaaaaatttgaactagtgtcagagtacaaaccaaccggcgatcagccccaagcaattaatcaattgacaaaggggattgaagatggtgaaaaagctcaaatcttattaggagcaacaggaacaggaaaaacatttacaatctcaaatgtgattgccaatgttaataagccaactttgattctttcccataataaaactttagctggacagctctatggtgaaatgaaaaaattcttccctcacaatgcggttgaatattttgtttcctactatgactactatcaaccggaagcatatgttccatctagtgatacttatattgaaaaagatgcgtcaattaatgatgagattgataagctgcggcactctgccaccacttccttactggaacgaaatgatgtaattgtcgttgcctctgtttctagtatttttggattaggggatcctcgagaataccaaaatagtgttctttctttgcgcgttggtcaagagattgaacgtgatcgattgttgaccgaactggttaatattcaattcgatcgcaatgatattgattttcaacgggggcgtttccgcgttcgtggcgatgtagttgaaatctttccggcgtcgcgtgatgaacgagcattgcgaattgaattctttggggatgagattgatcggattcgtgaagttgatgcgctgacaggcgaagtgattggtgaccgggaccatgtttctatcttcccggctactcactttatgactaatgaagaagtcatggatcgggcattgccacaaattgaagctgatatgaagaaacaagtaaagaagtttactgatgagggaaagcttcttgaagcagagcgaattcaacaacggacaacttatgatattgaaatgatgcgtgagatgggctatacaaatggaattgagaattattcgcgttacatggatggtcgaaagcctggcgaacctccctataccttattagatttcttccctaaagatttcttattagttgttgatgaatcccaccaaaccatgccgcaagtacggggaatgtataacggggaccgagcgcggaaacaaatgttaattgattatgggttccgcttaccaagtgctcttgacaatcgaccattaaaactaccagaatttgaacaacatgttaatcaagttgtatatatgtctgcaaccccaggcccatatgaaatggaacagacagaccacgttgctcagcaaattattcgaccgactgggttacttgacccaacagttgaggttcgcccggtaatgggacagattgacgacctagttggtgaaattaacaaacgtattgagaaaaatgaacgtgtttttgttacgaccctgacgaaaaagatgtccgaagaccttactgattatctaaaagatatggggttaagggtcaaataccttcatagtgatattaagactcttgaacgaacgcaaatcattcgtgatctccgtcttggtaaatttgatgttcttgttggaattaacctcttgcgggaagggctagacgttccagaagtatccttggtcgccattcttgatgccgataaggaaggctttttacgtaatgaacgttcacttattcagacgattggtcgcgcggcccggaatgagaatggggcagtaattatgtatgctgataccgtgactgactcgatgcaaaaggcaatggatgaaacaaagcggcgacggacgattcagatgaaatacaatgaagaacatcatattacgccgcatacaatcatcaagccaattcaagaagcaattactgttactaagaaagcaacggatgaagctgaagcagataacagtgctgaatttactgacaaagattttgcaaagctagataaagaggcccaagcaaagatgctggatgaattaacagagcaaatgcgctctgctgctaaacgccttgactttgaacaggctgctacgcttcgtgatacgataatggaattaaagacaaaagcaaaaaaatagaggagggattatttcgtggcaaatgataagatcataattcatggggcacgggctcataacctaaaaaatattgatattactattccgaaaaacaagttagtcgttataactggcctatcgggttctggaaagagttctttagcttttgatacattatatgcagaaggacaacgacgctacgtggaaagtttatcggcttatgcgcggcaatttttaggccagatggataagccagatgtagattcgattgacgggttatctccagcaatttcaattgaccaaaaaacaacatcccataatccgcgttcaacggtcggaaccgtgactgaaattaacgattttctccgcttactatgggcacgggttggtacaccaatttgtccgaacgataatattccaattactagtcagtcaccagaacaaatggtggatcgggtactagaattgcctgaacggacacgtctgcaaattctttcgccggttgttcgtgataaaaagggaacacaaaagaaagtctttgaaacaattaagcgtgagggatttgtccgagttcaagtggatggcgaaacttatgaccttgattcagtccctgaattagataaaaataaaaaacatacggttaacgtcgtgattgatcgaatcatcatcaaagagggaattaggtcgcggttatttgactcctttgaatcagcgctccgcttaagcgatggttatgcaattgctgatgtgattggtggagatccaattccattttctgaacaatatgcttgtcctatttgtggctttacagttggtgaattagaaccacggttattctcctttaatgctcctactggtgcttgtccagaatgtgaagggttaggattgaagctcgaagtagatattgatttagtagtccctgaccgaacaaagaccttaaaagaaagggcgattgttccctggaatccaatctcatcgcaatactatccccaaatgttagaacaattctgcaagtcggttggcattgatatggatactcctttcaataagttgcctaaaaagcaacaacaacagattttgtacggtaatggtgaaacgccatttcacttccattatgagaatgactttggtggcattcgggatgtcgatgtgccatttgaaggtgttatcaataatattagccgacgataccgggagactaactcagattttacaagggaacaaatgagaaagtatatgactgagcttccatgtccagtttgtcatggttaccggctaaaccagcgggccttagcagtaaagattgatgggcgaaatatcggtgaagtttccgctttatcaattagtgattcccttgaattctttaagagcatcaaactttctgcacaaaaaaatgaaattgctaagccgattttaaaagaaatcattgatcgattaacctttatgaaaaatgttggtgttgaatatctaactttaagtcgctcagcacgaactctttcagggggagaagctcagcgaattcgattagcaacccaaattggttctaatttatcaggagtaatgtatgtccttgatgagccgtcaattggacttcatcaacgagataatgaccgtttgattgagtcgttaaaggctatgcgtgaccttggtaatacacttgttgttgtagaacatgatgaagatacaatgcgcgcggccgattacattgttgatattggccctggagctggtgaaaatggaggccaagtgatggcagccggaactcctaagcaaattatgcgatcacggaaatccttaactggccaatacttatcagggaaaaaatttattccagtacctcaagagcgtcgaggaggtaacggtaagaaaattactattacaggagcagcagaaaataacttaaaggatattacagttgattttccacttggtgagtttatttgcgtaacgggggtttctggttcagggaagtcaacccttgttaatatgattctcaaaagggtcttggcacaaaaattgaataataattcagcaaaacctggtaagtacaagtcgattagcggggtcgaaaatattgagaaagttatcaatattgatcaatcgccaattggtcgtactccacgaagtaaccctgcaacttatacgggagtctttgatgacatccgtgaattatttgcccaaaccaaccaagctaaaatgcgtggttatactaaggggcgttttagctttaatgttaagggtgggcgctgtgaagcctgccgcggggacggaattattaaaattgaaatgaacttcttgccagatgtttatgtgccatgtgaagtttgtcatggaacacgttataattctgaaacacttgaagttgaatacaagggcaagaatattgctgaggtccttaatatgactgtttcggaagctcttgaattctttagtgcgattccaaaaattaagcgcaaattgcaaactattgaagacgttgggctgggttatgttcaccttggtcaaccagcaactaccctttcaggtggggaagctcaacgaatgaaattagcagctgaacttcaccggcagtctcacggtaagagtttctatattttagatgaaccaactactggattgcacatggatgatatcaagcgcttattagctgtcctgcagcggttagtcgatgcgggaaatactgttttagtgattgaacatgatttagatgttgtgaaatcagcggactggttaattgaccttggccctgaaggaggagctggtggaggtaatgttgtcgctaccggaacaccagagcaagtagcagaagtaaagggaagctacactggtaaatatttaaaagagatgctcgaacgtgatcaaaaatgggcagaagaacgagaagccaagcaaaaaaagtagttgcaatctaattcttctaatggtattctaataaaaattaaagtacacgaaacgagggaaaagaaatgttattttttaataatcagaatcaacaattttcttcctcctcagcctctaacactattaaggctgagtgattttggtgtacccaatcaataggtttatacagactcgggttctctattaatcatttggcgtgaccaaattgcattaatagatgatacccgggtttttattttgcctaatattaagaatggaggaatgatgatgaatcaacaaccaacagatgaactaaaaaggtcgcttggattttggtccgctatttcgattgttgttgggacaattattggatcggggatattctttaaacaaggatctgttcttgatagtgctggtacatctacgcttgcaattgcagcctgggtatttggaggaattattactttaactggtggattaacagtggcggaaattggtgcccaaatgccatatacggggggattatatgtatatatcgaaaacttgtatgggcgccttttaggatttttagctggctggatgcaagtaattgtttatggaccagcaattattgcttcggttgccggattcatgagtattttaatggcaaacttctttggtttaggaacccagtggcgaatacctttagcagtgattacagtgattgccattggcgtaatgaacctttttgaaaataaagttggggcaattttttcgattgttacgactgccggaaaaatgattccaattgcggcaattattatctttggtttgttctgggggcatcaagatgcttttggtcaaacggttaccgaaattcaccaatcaactggtgggtttggggtagcagttttagcaaccttatttggttatgatggttggattttaatcgcaaaccttgggggagaaatgaaaaatccccaaaaattattgccacgagctatcattttagggattactgctgttcttattatttatactttaattactgttgggattcttaagttccttccagttaacactattcatcggctaggtgaaaatgcaactgcatacttagcggtgaaagcttttggcgcaattggaggaaaattgctgtcagccggaattattatttcgatgatggggactttgaacgggaaaatgattactttcccccggattgtatacgcaatggcgcgtcgtcatgatttgccattctcacgctatctcgcatatatcacgccaaagggtaagtcaccagtagtcgcaacgatgtttattatcattcttgcaacggttatgatgttcttctttgaccctgatcacttatcagatttgtgtgtgtttaccgtttattgtttctatcttttagcattctttgggatcttcattttaagatataagaataagggaccgcgcccattcagcacaccgctttaccccttagtgccaattattgcgattgctggtggaatctttgtcctcgtaagtgaagttatgaatgatcctgctggtgtaattctttttattggaatcgtcatcgtaggattaccaatcttatatattgttaaacgaatggatcaacgacggatgcattaatatttaaggctgagtttgacttggccttttttgttgctcaaataagacacacccggcttgatgtgataaaatagttgggtagctgtatgcgaaaagaggaactagtgatggtagataaaaaattaaaagtagtaattattacagggatgagtggtgcggggaaaaccgttgccgttcatagcttagaagatttaggatatttcgtaattgataacatgcttcctggattggcagaacgttttgttgatgtgatagaagattcgagagagtttgataaaatcgccatggtaatggatatgcgttcacgcggattttacgatgaggttttaccaaactttgaaaaactgaaaaaacgggctgatttagatgtgaaactactcttcttagatgctaatgatgtcacgttaatttcacgttataaggaaacaagacgttctcatcctttatctccgcaaggtcgaattcttgatggggtagaattagaacggaagctttcaactgatcttaaaagtcaagcagatatagtaattgataccactaatgtgacaccacgaaatctaaagttaaggcttaataaattattcggacaaggtgaaggcaatgacttttatgttgaagtaatgtcatttgggtttaaatatgggttgccacttgatgcagatatcgtaatggatgttcgtttcctccctaatccattctatattccagaattaaagcacttaacggggaatgatccagctgttcaaaattatgttgtgcagagtccactggctaaagaattttaccagcatttacggtcgctcttagagattgctcttccgggttacattaaggagggaaagagcagcctgaccattgcaattgggtgtacgggcggtcaacaccggtccgtaactattgctaacaaattatctgctgatttaaaagaaaagggatataaagtaaatacttaccatcgcgatattgagaaggcaaagtaaagaggagttttaattatgttgcataaaccaaagattgtagtgattggcggaggaactggtctaccggttgtccttcgtggattgcgcgatcaaaatgttgatgttacggcagtcgtaacagtagctgatgatggtggttcttcaggaattttacgaaactatattaacgtggttccacctggtgatattagaaacggtttagttgcgttatcagaattacctgatctcgaacttgatatttttcaatatcgttttaagagtagtgaccagttctttgccgggcatgcgattggtaatttaattatttctgctttgtctgaaatgaagggtggtatttttaccgctgttcaagagttatcagaaatgatgaagattaatggacatatttatcctgttgctaatgagccgttgactttaaatgctgaatttacagacggtacaaagttaagtggtgaatcggaaataacggctgcccataagcaaattaaacgggtctgggtaacaccttctaaagataatgatgggcatcctgctcgtcctgtgtcagaggttataacagcaataaagaacgcagatcaaattgtccttggccctggaagcttatttactagcatcctgccaaacttgatgatttctgaagtagggcaagctgtttacgaaagtaaggctgaagttgtctatatttgcaatattatgacgcaaaaaggtgaaacggataactttacagatgctgatcatgttcgggtattaaaccatcaccttgggaagaattttattaatacggtcttagtcaatattcaacctgttccagaaaattatcttgattttcaggaatggaatgaaatttctcaaccagttaagcatgatttccaagggctacgagcacagcattgtcgtgtaattagttcaaattttctgcggctaaaagacaatggtgccttccatgatcgcgataaagttgtagcagaattaatgaatcgacttcaccaagttcacgagtagttaggagactgatgctagatgtcatatgcaagcgaagtaaagaaagaattaacgggaattactgttcatcgggataatgcaaaggcagaattgatggcccttattcggatgaacgggtcgattggcattgctgaccaccagttagttttgaatgttcagactgaaaacccggcaattgcgcgacgaatctattcacttttaaaacaattttacggggtagaaagtgaaatcgtggttcgtcgtaaaatgaaattaaaaaagaataaccaatatatagttcgcttacgctatcatgcacaacatgtcttagatgatcttggtattttacaaaattatcaaattaaagaacaagtacctgtagaattacttaaggatgaatggatggtccgttcatatctaagaggtgcgtttttagcggggggatcagtgaataatcctgaaacttctcgctaccacttggagatatactccctttatgaagaacataatgagatcattgctcagatgatgaacaagtttggtttgaatgctcaaacaaccgctcgccgtagtggttttatcgtttacttgaaagaagccgaaaaaattgcggattttatgtcattaattggtgcaactaattcaatgcttcaatttgagaatgttcgaattgtacgagatatgcggaattcagttaaccgattagtaaattgtgaaaatgctaacctgaataagattgcaaatgcgtcaacgcgccaaatcgaaaatattgaatttattgattcacgagtaggtcttaacagcttacctgataagttgcgggaaattgcagaaacgcgattagcccatcaagaggttagtctaaaagaattaggggaattggttcctggtggtccaatttccaagtcgggtgttaaccatcgtttacgtaaattgaatgcttatgctgatgagttgcgtgcatcgcaggttaaacaataaaaaacctttgaggggactgtgacataagttaagttactttcataaaaagcaaatacgcagtacaacaatggcctctaatgtccggcaaaaccgaacgttagaggcctattgttgcttgcggggctcgaaaacgaagtcacaagtgacatctgtctcgctcccctcaaaggttttattttatcttctttaagtgaaatttatttcttatttatactttcgctaattagtgctaattcagctgctgcgcattcttgatctaattcgttccagttagcggtaacgttaaaaacgtttaatttatttactgacattataacatcctccttgaccttatacctttattctctttcatctacattttgtatcatactacaattggtctaaaaaattaaacattataatatcggcatttgaagaatacttttttaaataggtatagttatattgctgaaattaataatgtaatagcaaagttaatcgtttgtcaaagttagataaattgttaaattttggaaatggcattcacgggatagttgttttggattaagggagacttgctttttaaaacaatgaccggtataattggaacgttaattaatttacgtttaatattaaaggaggcaaagtaacatgcgtaaagcacacccatacggcgtacaaggccgtcgcccaatcgcttcaaagtacaagcgagcattaaaagaaaagaagatcgaagctattcgtaagtgggctaaggaaaagccagctgaagaaaagtaattcagtctataaaagctatgcaattcagtgcatagcttttattttttaataacgccgtttgtaaaattaagttagaaaaatagaaaagccatttgtggtagacttttgaatacccctaaacaaaagaaaggaaaccacaaatgacttacacccatcttaccacaaacgagctgacaatcatcgcccattctttcgtgcaaaagcttaaagcgtaccgagtggcccaaatgatcaaccgttgttccgaaaccgtttatcgcgtttatcgttacctggaaaccggtgccttaattgctgattatcaagatcactagcaacgttgtggccgaaaacgtactcagttgtcactggctgaactcacttatatcaacgacaaaattgcccaggggtggacgcctgataccattattgggcgcgctgagcgcccaattagttgtaaccagcgaactctttaccggatgtttgaacgtggccagttcggcttcgatgtccgttccttgccgatgcgaggtaagcggcacccgaatggctatgtcgagcgccgcgggaaggttggccaattggggcgaagtattcacgagcgtgccaaggactttccgcactatgccactgaatttgggcaccttgaagctgataccgtccaaggcaaaaagcaccaaggggcggtaatgaccctgaccgaacgctaatcgaaggtcgaaattgtactcaatgtgcacaaaaagacggctgatgcgattaaccaacacttaagtcagcggcttcggaaattctcgtggcacttcttcaaatcgattacctttgacaacggaaaagaattcgccggctggcgcgagattgccaatcaatttgaccttcacacttactttgccgaggttggtgctcccaatcaacgagggctgaacgaaaacaacaacggtcttttacgccgggatggcttaacgaaacagctagatttccgcaaccttcctgatgaattggtaacccaactgatgagtaagcgaaataacctgccccgtaaatcactaggctatcgaactccatatgaagtattcatgtcttacgtcactgatgagcaactattttctttctaacttaaattgacatttcgggatttaatggtggattatagaatgaagttagccacccagttggtggtaaataaaaaacgccattcggcgtgacatcaggtatcatattaagtgaaccaaacctatatgaaaggatgtccgtcaaatgacgcacttaaatgataccatgtctactagtttattgactactcataaaaagaatgctcatcttactaaagaagaacgtgtgatgattgcgactttaaagtcgcaaggactttccaatcgcgcaattggtcgccaattaggagttaatcatcaaacaattaataacgagctcaaccgtggtacggtccgccaacttcgtcgtcaaaaatctaatggtaagatttacgaatattcttactacatctatagttatgaagctggtcaggccacatatcttgaacatcaccgccattctggtcgtcgtcgcttatattattcttcaaagcaatttttacgattagctgatcagctaatgcttggtgagtttgacgaccaccattactccccacaagcggttatttataaggctcgagatttaatgaatgatggcaccctgatcccaaagtcggttgtaactttatatcaatggattaatgagggtgtgcttcgtacgtccaatttagacctctttgaaaagcctaaacgtaagcatcatcgaactcatccgcaagctaaaaggtgcttaggtcctaatattgctcaacgacctcaaactgcggaccaacggtccgaaattggccattgggaactagatacagttcagggacagaaaaacggtaatgacagtgttgtactagtaatgactgatcgcctttcacgagttaatatcacgagtaaaattgctggtaaaactgcgcatgcagtaaatcagttctttataaatttacgccagaaaatgggcacagatgcttactatcgcatctttaagacaataacctctgacaacggttcagaatttagtgagttaacacaagttcacgatcatgttttctatgctgatccgtattccccttgggaacgtggatccaatgagatcaataaccggtttctccgcaaggagattaccaaaggtgaagctataaataactatagtagtgctcagatcatagcgactaatgattggatgaatcactatccacgagctatgtttaatggacattcgtcaatggatatctatcgtaaggccttctaccaagagatatcacagctccatcaaccaataatcaattggtcagtattatttatttgagtccagtggctaacttattcttgaaatttaggttcgggatttaattaaatggtcaagaatattttgcaaaaaaagattaaataatagttaaaacatttgaccttttttgaccaatcgagtatagtattattatccgttagcatataagactaacgagtgctaatttattaaggaggccatattatgaatttagtacctactgtcattgagcaatcatctcgtggtgaacgtgcttatgacatctactcacggcttctgaaggaccgtatcattatgctctctggtccaattgaagacgaaatggcaaattcaattgttgcgcaacttttattccttgatgcgcaagactcaactaaagatatttatttatacattaattcacctggtggagttgttacctcaggaatggcaatttatgacaccatgaactttattaaggctgatgttcaaactattgtaatcggaatggctgcttcgatggccagtgtactagtatcatctggtgctaagggtaagcgttttggattaccacactcacaagttttgattcatcaaccatctggtggagctcaaggtcaacagactgaaatcgaaattgctgctactgaaattttgaagacacggaagatgcttaacggaatccttgctaagaattctggtcaacctatcgagaagattcaggctgatactgaacgtgatcattacttgacagcacaagaagcagtagattacggcttacttgatggtgtaatggaaaataattcaaaattaaagtaaagtgataattaaaaagatctccaattattcgattaatttcgaatgacggagatcttttttattatcaaaacgtgcgtggaaattaacagccttgtggcgactgtaatatcttaaaaatgaaaaaaggctgtcgaaaaaattcaacagccttataaaaatgcgccccccgagagtcgaactcggatctcgagaaccggaatctcacgtgcgatccattacactaagggcgcgtcaacaaatattatactatcttaaataagaatgaattgcaagcattatttgaaaattttaattaaaataacgcttacatcagaaaaatgttgtgattgaatagacaatttttttgaagatggtatcataagtatcgtaggagttgtattattgcttagaccttaccactgcgtcacttacaatggttgagagttgcgatgctgatgtaatgtgataaactaagcaagtacactaattatgttttttcctaaaggaggaatttgcagtatgactgtaaaaattggtattaacggttttggccgtattggtcgcttagcatttcgtcggattcacgaacttaacacaaatgatattgaagttgttgcaatcaacgatttgactactccttctatgttggcttacttacttaagtatgactcaactcatggtaagttcccaggtgaagttacatctactgatactggtattgttgttgatggtaaggaataccctgtatacgctgaacgcgatgctcgtaacattccttgggtaaagaacgatggtgttgactttgttcttgaatgtactggtttctacacttctgctgaaaagtcacaagcacacattgacgctggtgcaaagcgtgtattgatttcagcacctgctggtaacatcccaactgttgttcctggtgttaaccttgatactttgactaaggatgacattatcgtatcagctggttcatgtactactagctgcttggcaccaatggctaaggtcttaaatgacgaatttggtgttaaggttggtactatgactactatccacgcatttacttctactcaagctatccttgatggtcctcgtggtaagaagatgcgtaacaaccgtactgcaagtgtaaacactattcctcactcaagtggtgctgctaaggctattggtttagttattcctgaattaaacggtaagctttcaggtcacgcacaacgtgttggtgttgttgatggttcattaactgaacttgtttcaattttggacaagaaggttactgttgaccaaatcaacgatgctatgaagaaggctactaacccagcattcggttacactgaagatgaaattgtttcaactgatattatcggttcaacatacggttcagtattcgatccttcccaaactgaaattatggaaggtgacgatggttcacaattagttaagactgttgcttggtacgacaacgaatacggtttcactagcaacatgatccggactttacttcactttgctactctttaatttgaagtaaaattaaactaatttgattaaggtgggaggaggactactccgcccgcctttttttatcaagagaagaggagacataatacaatggctaaattaactgttgaagaccttcctttagaaggcaagaaagtattaatgcgtgttgactttaatgttccaattaaagacggcgttgttggtgacgacaatcgaattgttgcagctttaccaacaattaaatatgttattgaccatggtggtcgagcaatcttattctcacaccttggccgaattaaaaaagaagaagataagcctggactttcacttcgtccagttgcagaacgtctttctaacttactaaacaagccagtaacatttgttccagttactgaaggtaagcaattagaagatgctatcgacaacatgaagaatggtgatgttttacttgtccaaaacacccgttacgaagacgttaaggatggcgaatatgtaaagcgtgaatctggtaatgatcctgaattaggtaagtactgggcttctcttggtgatgtatttgtaaatgatgcttttggtacagctcaccgtaagcacgcttctaatgttggtattgctactaacatgccaggcaaagcagcagctggttacttgatggaaaaggaaatcaagttcttaggtgatgcagtagataatcctgaacgtccatttgttgccattcttggtggtgcaaaggtttctgataagattggtgttattgataaccttcttgacaaggcagacaagattattatcggtggtggaatggcttataccttctacgctgctaagggaatcaaggttggtaactcacttgttgaaaaagacaagattgacgttgctaagcaaatcttagacaaagctggcgataagcttgtattgccaattgataatgtagtagctgataagttcaacaatgatgctgatacaaaggttgttgaaggtgatattgacgacggttggatggctcttgatattggtcctaagtctgttgaagagttcaagaacgtattaaaagatgccaagactgttgtttggaatggaccaatgggtgtatttgaaatgccaaactttgctaagggtacgcttgaaattggtaaattccttggtacattaacagatgctacaacaattgttggtggaggagactcaactgctgcagttaaggaattgggtgttgctgataagcttactcacatttcaactggtggtggtgcatcattaacttaccttgaaggtaaagaattgcctggaattgccgcaatttctgacaaataattaatgtttaactactatttataattcttatataagaggctgagaaaacttttgcttttctcagcctcttaccgtatcttggtattaacaataaaatggtagataggagggtcaaataatgagagtaccgattattgctggcaattggaaaatgcataaggatgtacaagaagctgtctcttttatcgaaaaaataaaaaatcagcttccacctgccgaccaacttgaaacagcaattgctgctcctactctttgtttggtaccaatggttaaagcggctaaagaatctccgttaaaaataatggcagaaaactgctattataagaatgaaggagcctatactggtgaaacaagtccatatgctttataccaagcaggaatccatcatgtaattttaggccattctgaacgccgaacttactttaatgaaactgatgaattaattaataaaaaagtgaaagcagcattagtaaacgggttatgtccgattgtttgttgtgatgatactatgcgtcgacgagttgctggaaagaaagttcattgggtggtgagccgaattctcgctgatcttcatggattgaccaatgacgaaatttgtcatgttacggttgcttatgaacctagttgggcgattggaacaggcgagagtgctgatccagaacaagcggcggaaggttgttaccttattcgccagacgattagtgatatgtatggcgatgaagttgcaaataatgttcgaattctctatggaggaagtgtgacaacatctaatatcaatgcactaatggcaaaaaatgatattgatggtgttttagtcggagcggcgagcttaaatccagaaacatttttacaattagttcaccattaggcggttaaatgcttgtttttaattgtgtaaaataatacaatgttaagtggaattgctttccaaataaatgacagaggagagattcatcaaatgtcactcattacagatatttatgcacgtgaagtccttgattcgcgtggtaacccaacagttgaagcagaagtttacacagaagccggtggtgtaggccgcggtatcgttccttcaggtgcttcaactggtgaacacgaagctgttgaattacgtgacggcgacaagaaccgttttggcggtaagggtgttttaaaggctgtttcaaacgtaaacaacattattgctaaggaaatcgtagggatggaagttactgaccaaatcgctatcgataaggcaatgattaagttagacggtactccaaacaagggtaagttaggtgctaacgctattttagctgtttcattagctgctgctcgggctgctgctgacgaattacaagtacctctttacaactaccttggtggtttcaacgctcatgtattgccaacaccaatgatgaacgttattaacggtggtgctcactcagataacaaggttgacttccaagaattcatgattatgccagttggtgcaccaactgtacgtgaagctattcgttggggttcagaaactttccacgctttgaagaaggaattggaagctgctggtaaagtaacctctgttggtgacgaaggtggatttgctcctgactttgctaacaacgaagaaccattcgaatacttaatcaaggctattgaagatgctggttacaagccaggtaaggacattgccattgcctttgacgttgccgcttcagaattatggaacgacgaagacaagaagtacaagcttcgttggtcaactggtgaagaatacaccactgaagaatggattaactacttatccggtattattgaaaagtacccagtagtatctgttgaagacccaattgacgaaaacaactgggatgattgggtaactattactgataagttaggcaagaaggttcaacttgttggtgatgacttctttgtaactaacactgattacttgaagaagggtatccaaatgggtgctgctaactcaatcttaatcaagcttaaccaaattggtactttaactgaaactgttgaagctatcgaaatggctaaggaagctggttacactgccatcgtttcacaccgttctggtgaaactgaagacactactattgctgacttggttgttgctacaaacgccggacaaatcaagactggttctatgagccggactgaccgtcttgctaagtacaaccaattaatgcggattgaagatcaacttggtgatgttgctcaatacaagggtatccactcattctacaacttgagtcaacaagctcgtcaagacatcgaaaatcgttaattttaagcattagttaaaaatcaaaaggactatggagaaaattccatagttctttttagttacaaattatttaattaagattaaaaacgattacatcatttatattaaaaaataatgagaaagaagcgttggaatttagtataaaatataatataatctttaagagttaaatacaatgaaaggataatgatacacatgaaaaaatcggcaccagaacttaatcgttcgatgactgctggtcagatggaaatgatttcccttggtggagcgattggtgttggactgtttatgggatcaacatctacaatcaagtggaccgggccatctgttatcctcgcatatacgtttgtcggcttaattctatatattgttatgagagcgttaggagagatgatttacattaatcctggaacaggttcttttgcggattatgcaactgaatatgttcatccagtagctggataccttgctaaatgggctaacgtatttgagtatattgttgtaggaatgtctgaagtagtagcagcaactgaataccttaaatattggtggccacaccttcatacttgggtagctggaattgttattattattttcttggtcctcgctaatttagcgagtgcaaaagcatatgggtcgcttgaattttggtttgcgatgatcaaagttattactattatctttatgatcttacttggatttatgattatcttctttggctttggtaatggcggtcatccaaccggtttcagcaatctttggtctcatggtggatttttcactggtggctggagtggtttcttcttctcaatgtcaattatcgttggatcttatgaaggaatcgaattgctaggaatttctgccggggaagtagcaaatccgcaaaaagcaattgttaaatctgttaagtctgttttattccggattttaattttctacgttggcgcaatttttgtaattgtaacaatttatccttggaatgaattaagcagtgttggatcaccatttgtatctacttttgctaaggtcggaattacagctgcagcatcaatcattaactttgtggttttaaccgctgcattatcaggtgctaattcgggtatttacagttcaagtcggatgctgtttaagctatctcatgaaggggatgctcctaagatttttggtcgtctttcaaaacggatcgttcccgatgctgctatccttggtatttccggtggtattttgattggctttattattgatatgatttcggcaacttatagccattcaactgctgatatgttcgtggttgtcttcagttcttctgttttacccggaatgattccatggtttgtaattttactggcagaattacgtttccgtcgtaataataaagacttgatggttgatcatccattcaaattaccactatatccattttcaaattattttgcatttctcatgttgattgtgatcgttatctttatgtttattaatcctgacacacggatttcggttattgttggtgctgcagtattgattctagcagtcactgtataccttgttcggcatggttttaaaaacgaaaaagcataagataaataagaagctaggaaaaaatccctggcttctattttatttttaaattaatttcgtctcactaagctcatgtagtacaatggcatgtagacttttaataaattggagaagaacaatggagagtagaaaagaggtatttcatcgctataatcagttcaatcaactaattcgggcgatcattattggaatattgactggtttagtagttagtgtatttagactcataattcaacactttttacaattagtaacagcaagttttgcatattttcattctcatccattatggctaataccatggacaattggatcaattattttagcattattattaggatggttagctcaatcctatcctgatataaaagggtcggggattccacaggttgagggacagttgactaaccaatttgatgaaaaatggtggccagtgttatggcgaaaatttctcggcggagttttcgccattggatctggattatatctcggacgtgaaggaccatcaattcaacttggggcaacaattgggcaaggagtagaggaaaaggccaaagtagggcaccttaatcgccaaatagggatcgcaagtggagcagcagcaggattatctgcagcctttaatgcgccaatcgctgcgactatctttattttggaagaagtgtatcataatttttcaccggtaatttggttggcaacatttgtgagttcgctttgttctaatatggtttcgatgcagttttttggcttacgaccggttttgaatgttccttataatcatatgcttcctaataatctttattggcatttgatcgcgcttggtattttattaggtatcttagggcgtctttaccaaattgttattttgcatttgaatggttggacggcacggattcctaaactatctcctattgcttatccaattattccgtttttgctggttattcctatcgcctggtattttccaatcacgttgggcggggaaatgaattaattattattttacgttccttgccattttctttagcgctttttgtggggctttttgtccttcgctttgtattttcaatgattagttatggttcgcaattaccgggtgggatatttttgccaattttaactcttggcgctattttaggcgcagtctattgtgcgttaatggtccgtttgggattaatgccagttcgatatttacctaattttattatctatggaatggcaggttattttgcatgtattagtaaggcgccatttactgctattttattaattactgaaatggttggctcacttgcgcacttaatgccattagccttggtagcagtagtagcttatcttgttgtggatgcgttacacggtgaaccagtatatacagcaatgtttaacgcctttattggaaataatccgcaaccagcacgccataaagaggatgttacgatgtcgattaccatttatgctggcgcccagttggatggttgtaaaattaaagattttccatggccaactgattgtattgtgatggttgtctatcggggagaagaaaagatcattccgaatggtcaaacaaagctgcaagctggcgatacgttaattttgcgggctaattcagcaactactagacaagtttaccatgagataagtcgggctgcgcattatgcacaaggatagcaatagaataataaatatgatatgataattaagataaaagcgtgaaagtattaggaggaaaaatccttgtataacacattaatgactttattcttaattgattgcgttgtattaattgcttgtgtaatgatgcagccagcaaaaaacgataatgatgcaatgtcagctttgacaggtggtgcgggtgacttattctcacgtcgtaaagcgcggggatttgaagctgttatgcagattgttacaacaatttgtggagcactcttctttattctggcattagcgatgatttacgtttcgtcacattaaatttaaagtgcctcctgaaattattgtgattccagggggcttttttgacgctacggttggagtgcaggggatgatgtagtgataacgtatactggtgagtcttttttctttcccatagtggacggcatggagttattttgcttcatgcatatacaggaaatacgaatgatgttcgaatgctgggacgtcagcttaactggcaaggatatacggttttcgcaccgcttttgcatggtcatggtggtgatccgcaaaaggtgctggaaagcaatggcccagatgattggtgggatgatacccggatggcaatttttcgtttacgagatgccggagttgatcaaattgcaatttttgggttatcgcttggtggtttacttgcaacaagagctcttgagaatgatccgcaattattaggtggtggtgtttttgcatccccaattaccacctggggacaatcgaatgttccggaatacttccctaaaattgcggcaaagtattatcgtcagcaaaaaatcaacccattaattactaaggaaaaggttgctaaattgactgaacgactcccccaacaactagcacaaattcaaacaatggcgcatcaaatttgtgaccaattagatcagattcatcagccattctttattgcacaaggaggcacagatgaaatgattgatccagcgtctggactgcaattaaaaacaaaattacaggagaatggggttgcagttgattaccattactacccaaccgctactcacttattaacagttaataccgctcatcgtcaactatttgccgatgtagaaaaatatttacaaaatttattcgaggtgccttctaatgacaacaaataatttaaaagaaaaaatattaacacatttaacagataatgcaggtgtgagttactcagcagaaaaacttgctcatcaattagggatggatgatgctgagcagtttacaccgatcgttcaatctcttgctcaattggaaagagagaaaaaggttcaagtaactgatcatggtgaattcgaagcagttattaaacagcaaccacttattggaactttccacggaaacgataaggggttcggttttgtagactatgaccctgatcttccagacatgtatattaatcctgatcatactttgcatgcattaaatggggaccagatagaagttaaagtattacgtccagcaaaagcaggtagtgatcagggtccagaaggtcaagtaacccggattgttgaacataaatatgaaaatgtagttggtgaatttaagcaagcgactatcggcgatgattacattggtgaaattttgcttaaagataagaaattatcgcagtatcatttctatgtaacggacaagggattaaaaccacttgacggccaagtagtaacagctactgttgagacttatcctagtgatgaggcaccggaagtaatgacgggtgccgttactgaagtgattggtgataaggatgagccgggtattgatattatgtcagtaatctatgctcacgacgtccctcatgaattccctaaagaagtgatggaacaagctaataagattccgcttcatgttctcccagaagaaaaaaagggtcgggtggatattactgaccaaccgcttgttaccattgatgcaattgaatcaaaagacctggatgatgcggtggtagcttggaagatggataatgggcactaccaccttggggttcatattgcggatgttactcactatgtaaagccaggtacaccgcttgatcaagaagcatttaagcgtggtacatctgtttatctaactgatcgggtagttccaatgcttcctaagcggctttctaatggaatttgctctttaaatcctaatgaagaacgtcttgctatgagttgcgaaatggaaattgatgagcaagggaaaattgttaatcaccgaatcttccaaagtgttatgaaatcacatgcccgaatgacttataaagcagttaataagattctggagtcgcatgatgctaaaacgatgaggcaatatgaagatctcgttccaatgtttgaaacaatgggggagattcacaaattactgcttaagaatcggaaaaaacgtggtgctattgactttgaagctcctgaagcaaagattattgtggatgaaaagggtcacccaactgatattcaactacgagatcggggactttctgaacggatgattgaatcctttatgttagctgctaatgaaacagttgctgaacactactttaaggaacacgttccattcctttaccggatccatgaaacaccagatagtgaacgtattaaatcatttgtggactttttagctgtgtttggaattgaggttcatggtgatattaagaatgttaaaccagggatgcttcaaaaagtattgaaggatgtggctggtactcctgaagagcaaatggttcaagtgatgatgttacgtagtatgcaacaagctaaatactcggatgaagagctaggtcactttggcttaggcgctaaatactacactcactttacttcaccaattcggcgataccctgatgatacggttcaccgtttgattaagtggtacgaagaacatggtaaaaacgaaccagctaaggaccattggcgtgataagcttccagaaattgctgaacatacttcggttaccgaacggcggggaattgataccgaacgtgatgttgatagtatgaagaaagccgaatacatggaagaccatgttggcgaaacctttgatgccgtcgtaagttcagtgatgaagtttggtttgttcgtcgaattgccaaatacagttgaagggttagttcatattagcgtcatgaatgatgattattatgaatattcagaaaaacacatggccttaattggacgaaactctcatcgaattttccaaatgggacaacctattaaggttaagttagttcgggcagataaagatcttcgtgaagttgattttgaaattgttaaccctgaagaagcaccaaagacaaagattcgggtcccacgtaatgatgaatatcggggtcgaggtcgtggccgcaaaggacgtgccaataataattcccgtcatgagaacactagcagtaatcattaccgtaatactcaaggaaaatggcgtcgaactcaccaagaaaatggtcgtcaaaataatcgtcaaataaatcggggacaaactcgtcaccacaataattcacgtgatcatgaaggcgtttgtcgccaccattaagagcggggagggatattatggcaaaaaaatcccatcaagaaaataatgacaatttaattgcacaaaataaaaaggcacgtcatgattattttgtcacggatactgttgaagcaggattagttttaacggggacggagataaaatctgttcgtgctcaccgggtgaatttgaaagatggatttgcccaagttcgtaacggtgaagcttggttaatgaatgtgcatattagtgagtatgataatgggacttacttcaatcaagatccattaagaaatcgcaagttgctattgcacaaaaaggaaatcaataagcttgtaggagctttacaggataagggagttacgcttattcccttgaaaatgtatattaaacacggctatgcaaaagttttattaggactagccaaaggtaaacaccagtacgataaacgtgaagcaattaagcgtcgtgaacaaaaccgtgaaattgaacgagttatgaaacattattaaaacgaaaagcctaggtgaaaatcacaaattttcacctaggcttttcactttaaaatctatttgtttctacgttctttacagtttaagtttaactgattgctaattgaaaatgacatgctggtattaagattaggggaacgcttcattaatcgtgctaataaaggttcttgttcacttcgtcgagcccaatggttaagaatactagcgattagaattgctaaaggttcatcttcttttttatttatctttaattcatgacaatatccgcttgatagtttaacgggttgaattgaaaaaactaagtgactaccggaaaaaacacggtaacggcttgttaatggtgaaccaacaacgatccagttaataccgcgtatataaataacctgttgaacaaatccaagacctttcccaattgttccaacgcgttgtcgattaacatataatgcgaatttgggtaacagtccaagagttaattgctttacttcagctaataaggctccatcaattgcatacaatgatagggcatcgtacctcattccccacttaccgacaagaagatagcacgatttaccattcttatcgcgaatgacggtcgttccatgtaaatcacttgaacgatcgcgaatatataattgtcgcactttgccaccaccattctttgataatctaccttttattttaccagcttcttagcaaatttggtgaagaaacttctaagttaaaaaacgcttccaatttatcccatgatgatgtttaattatgctaaaataataggcgaggtgctaataatcgtgaaacaattaattcataacgactggtgggaagttttaaagccccagtttgaaagtgcatattatgcgcaattgcataatttcctaaaagaagaatatacccatcaaacgatctatccagaaatgcatcatattttcgaagcatttgaatggactccttttagtaaggttaaagttgttatccttggtcaagatccttatcatggaccaaaccaagctcatgggtgtagtttttcagtactgcctggggtgccggtcccgccttcattacagaatatttacaaagaattgcaaagtgatttaggttgtataccggtaaatcacggctatttaaagaagtgggctgatcaaggcgtcctgttattaaattcggttttgacagtgcgagcagggcaagcatattctcaccgtggacatggctgggaacaattaacagatgcagcgattcatgctttatctgaacgtcctaaaccagttgtgttcatcttatggggacgggctgctcgaaataagaaacagttaattaatacgaagacaaatatcgttcttgaatcagctcacccgagtccattatctgctaaccgtggattctttgggtctcgaccattttctaaaacaaacgaagcacttcaggcaatgggagaacagccaattgattggcaactgcctgccaaaccaaattatcgttaaagatgtgattgttagtcacaactttaaaatgtttagtgaccataaggaggtacttgcattatggaattatttgatgagattgctgcaaagattaagggacaaaacaagaccattgtttttcctgaaggtgaagataagcggattttaggagctgctgtccgtttaaagaaagataatttagtagagccaattttacttggtgatgaagaagcgattaaagaagttgcaagtaaaaatggttttgatcttgctggccttcaaattatcgatccagcaacttatccagaagacgataagcaagcaatgtttgactcattaatgaaacggcgtaaaggaaagaatacccctgaagaaattcaaaagatgcttgaagatgtgagctactttggaacaatgcttgtttatatgggaaaggctgatggaatggtttctggtgctgttcattcaactggggcaactgttcggcctgcattacaaatcattaagactaagcctggtgcccatcgaattagtggagctttcctcatgattaaaggcgatcaacgttatatctttgctgattgtgcgattaatattgaattggatgccccaacaatggccgaagtggcaattcaaagtgcggaaacagcacgcttatttgaaattgatcctaaggttgcgcttcttagtttttcaactaagggttctgctaagggtgaaatggttaccaaggttgcggatgctgctaagctagttcatgaattagatcctgatttaccagctgatggtgagttacaatttgatgctgctgttgtcccatcagtaggtgaacttaaagcccctgattcaaaagttgctggtcatgctaatgtctttattttcccaagtctggaagcagggaatattggctacaagattgcacaacgatttggcggttttacagcagttggtcctatccttcaaggacttaacgcaccgattgcagatctttcacggggatgcagtgaggatgatgcttataaggttgcaatgattaccgcagcacaagcattgtaaatattgatgaaaaggaagtgggactaaaaactcgcaagcgagtttagtcccacttcctttgctttttaaacatgagatgggtacaataaggctagtattttaaacttggagagagtactatggagagcttaacgttaacgaatcgtgacgcaacaattgcccttggaaagaaaattggtcagcaattagttgccggggatgtgctagtcttagacggtgatttaggagcaggcaagactacttttaccaagggattggctgcagggttagaaattcctgatatcattaaaagtcctacttttacaattattcatgaataccaagatggccgtctccctttataccatatggatgcatatcgcttagaaaatgggggagcagaagacctcggacttgaagaatactttgatggtgatggagtttcagttgttgaatgggctgaatttgttgaagatgaattgccagctgactttttagctattcacttcaagcgaacaggtgatgataatactcgtattctggaatttgaaccccatggacagcattttgaccaaattgtaaaaagcgtggtgaaacaatggcagacgacatttcgataaagttagcaacgagtgaggatgccggggctgttttacaatttctacgggcaactgcaactgaaagtgacgcggtattagttccgcatttaaatgagattagtgaaaagacagaagcaaaaaatatcgatttaataaatcaatttgatgattgtgttattttacttgcgatgctcggcgaagagattgtggggatggttactgtaatggtattagatcatcaaccgacaaccggtgaattaggagtcgtggtacggaaaaagtattggcgaaacggaatcggtcgcttattagttgatgaagcagagtattggtttaatacttatagtagtttagaaaatttgatcctgacagtttttgaggataatattccggcaattaatctttatcagcaattacactttgttacaatagaaaaaacggttgagcagggtcgtaatgtcctgcaaatgcaatacgataataaaaaagaggaaacaatggaaaagtaagccattatttcccctttcttgtgcgcccggcatgggtattagctaggtggtgaaagtccgctatgggccgtagtagtcggaaccatgagctgaggacaagggtgtccaccgtgaggtggaatttgaaggaagtctaaggcaaagtactgcatcgatgaacaagaagtagctataaggctgaaattaactggataaggctgctagacaagttgaagtccaatactactcgaagttggtctcagtaaagctaacgatgacatggtacgaaagctaatattcttacccggggagatctggcctacacgtttccgacaagaggaataagtttaatttccacagaaacaagcggtgcagtgatgcagtgttgagtaagccagaagtcagccgaggtcatagtagtttgaataatcagatgaaggactgaacgacaataacttgtaacttatatcggagatgtaatcaggtgcgacaatcgcagaaaacagaacaacaagctgaccgcttgtcgaggataggtttggaaaaccgaaagtacacaagggcgcgtagtaccggttatggtgaaggtaaaggtatgagtgtcactatccaagacctggtcttagatcgcaataaccttaatcaggcttatttgcgagttaagagaaataaaggagcagcaggcgttgacgatatgacagtcaatgaccttctgccatatctcagagaaaataagacggaactgatcgctagtttgcgtgagggcaagtataaaccagctccagtcaaacgggtagaaattccgaagcctaatggtggagtaagaagacttggaataccaacggtggtggaccgaatggttcaacaagctgtagcccaaattcttacgcctatctttgagcgtgttttctctgataatagttttggcttccgtccccaccgtggggcccatgacgctattgcaaaagtagtagatctttataatcaaggctatcgaagagttgtcgacttagacctaaaagcctattttgataacgttaatcatgacttgatgattaagtatctccaacaatatattgatgacccatggacactaagattcattcgtaagtttctaactagcggagtcttagaccatgggcttttcgctaagagtgaaaaaggaaccccacaaggagggccattgtcaccactactggcgaacatctacctaaatgagttggacaaagagttgactagacgtggtcaccactttgtgcgctatgcggatgattgtaacatctatgttaaaagtcaacgagccggagaacgagtaatgcgaagcattacccagtttctagaaaagcgcttgaaagttaaagtgaacccagataaaaccaaagtcggtagcccgctacggttgaagtttcttggcttttcgctgggtgtagaccacaatggggcctacgcccgtccagctaaacaatcgcaacaacgagtaaagaaagcactgaagttattaactaaacgtaatcgtggaatatctctgacaagaatgtttgaagaaattcatcgaaaaatgcgtggttggcttcagtactactcaattgggaaactaactaactttattcaacgccttgacaagtggttgagggtccgaataaggcagtatatttggaagcaatggaaaaagtttaaaactaaggtaactaacttacagaagttggggctgtcccagcatgatgcatatgtcttcgctagtacccgcaagggctactggcgaactgcacatagtaagaccttgagctattctctaactaatagaaaactggaacaactcggacttatgaatatgtccaagacgctccagtcaattcaatgtgattaagttgtcgaaccgttgtatacggaaccgtacgtacggtggtgtgagaggtcgataatcgaactaatcaattatctcctactcgattgtacatatgtttattttttatgtaggacttgcataatgtttcgccagaaggatccctttgtttgctgtttactaacgtcttgtgttacctctacacatccgaggtatttattttgatcatcacgtaaggcgtaaaaagcaatatttacaggttgaccatgatgcttgatcataatgctaattgaatcacggtctccggtatgcatatcatgaagtacttgcttaacatggccttgactatgcccgggatgaacctcaagcacatgtttacctaagtctgcatccgttcgcttgaataaacgatgccgattagctgatgaccagcgaatgatatcattttcatcaatgaaatcgaattctacggggatggtttcaaaaatagtattaagttgttcaatacttagttttccacctttaagattaatatctgtcatgattatctcctttagccgattaaattaataaagggctgaatctgttgtggggtaaaatgcttgctttgataaagcagaatgttagcgcaagcctgggcatcatcaagagcattatggtggtgatgaaggtcaatatttaacgcgtcacaaacagtattaagtttataatttgttaatcctggaatcaactggcggcttgaagcaacggtatcgagcgtctggtaggcggggacttcgatattgtaatgttctaacgtattccttaaaacgctattatcaaatcgattattatgggcaataactaatttatcaggagtgtagaattggttgatatgttcccatacttctggaaaatcaggcgcattttggacgtcacgttcatgaataccgtggatctgtgtattacgccaaaagaatttagtatgaggattaattagggtgtaaaattcgtcggcaatttgtccattccgaacgattgtgagtgcgagcgaacatgcactgtaacgcttaccattagcagtttcaaagtccattgctataaaattcatcatacatcctccttgcaaaagtcgataattttattttacaatcaactaatcatttttcaaaacttttacttttgaaaaatgatacaatagctcttgaaagtaaatataaaaaaggaagaaatagagaatggctaatttgatgaacgaatttcctgatattgaaattaaacaagatgaaccattaatgaattacacctatactaaaacaggaggtccagctgactggttggcttttcccgaaacgattgaccaggtaaaaaaattggttgattatgttcgtgagcataaaatgggcttaacggttttaggaaacgccagtaatttgattgttggcgatggcggtatagatgatttaacaattattcttacgcggcttaataaaattgaagttcatgataataaggtaacggcacaggcaggagcatcttatattgcaacaaccgaggcagcccgtgatagtgaacttactggattagaatttgctgctggtattccgggcagtattggtggggctgtcttcatgaatgccggtgcatatggtggtgaaactaaaaatgttgtttctgaggctaccgtaatgcttcccgatggaacgatcaaacactttactaatgaagaattggactttggttatcggcatagcagtattcaagataataatggcgtcgtgttagatgctacgtttgctttggaaccgggtaagtatgatgatatcaaagcaaggatggacgacctaaatgaacggcgagaggctaagcagccattagatctcccatcttgtggaagtgtctttaaacggccagaaggatattatgccggaaagttgattcatgatgctggattgcaaggatatacttcaggtggagcgcaggtttcgactaagcatgccggctttatcgttaatattgaccatggaaccgcagcagactacgtaaatgttatccatcatgtccaaaagacagttaaagaaaaatttggtgttgatcttgaaaccgaagtaaggattatcggccggcaagattaaaaagataaagtgtaagtttattaaaagattattaataagcttgcacttttattattttaaagatagtgaagtgatgaatgaatttaacttaatagttaggtgccgttaaaaagggaaaaaataatttaattgatcttattatttgctaattatgaaaaaatctcacaaattgctcattgaaaaattattattatggatgaaaagcgattccaaaggattttgaagtataccgattcactgactgataaaaataactttgtaatcactttcaaaatatgataggatatttaagtctcatttttgaaaaaattcacaaagtaaggagtatatttatgagcaataatgtagttgttttaggaagtattaacgttgatactacttatcacgttgatcgcttccctcaacctggtgaaaccatttcagcagtaagtaagagttctgctcctggtggtaagggtgccaatcaagcagttgcagcagcccgctctggtgccaagacggcttttattggggcagttggttctgataaagaaggagcttacatgcttgaatcattggctgatgatcatattgatacacgccatatcatgactgataagttacatggcactggtagtgctgcgattactttagatgctaatggtcaaaatgacattatggtatatggcggtgctaatcaagcaatgaccactgatgttcttgcaggtattgatgatgttttagaagatgctgactttttaattagtcaatttgaaacaccacaagaagtggctttagatgcatttaagcaagctaaaaaatacggtgttactactcttttaaatccagcaccagctcatgagattttaccagagttattaaaatatacagatgttattacgcctaatgaaagtgaatgcgccttattaacaggtattgaaattactgatgaagaatcaatgttaaagagtgctgattacttccgtgaacggggagttaagcaccttttgattactttaggctcaaaaggagtattttactctacacctacagctcatggattagttccagcatttaaggttaaggcagttgatactacagcagctggtgatacattccttggtgcattaagttcacaattagaaaaggacttatcaaatgttgacaaggcacttgtctacgcacaacgagcatctagtttgactgtccaacaaatgggagcaatgccttctattccaaaccatgatgcggttataaaagcattagcagaaaattaaggagtactatcatgaagaaaacagggattattaattcagaagtttcagctgtcgtggctaatatgggacatatggattggttatcaattggtgatgccggaatgcccgttccatttggtactaagaagattgatttggctgttgataaggaattgccaagctttatggacgtattgaataatgttcttaaggaaatgaaggttcaaaagatttacttagctgaagaaatcaaggatcaaaatccagaacaacttgaaaatattaagaaggcattaccagatgttgagattgcatttatgcctcatagtgagcttaagaagagtcttgctaagacgcatgcctttattcggacaggggaaatgacgccatactcaaacattatccttgaatcaggcgtaacattttaatattaggggttagttttttatggaaaatgaagtaaaaaaagataagggacaaagttgggttcaactgtcagacggttatttaagtcggacaccaatgttccaatttgttattttatgtttaatcttcccattatggggagcagcggccagtcttaatgatattttgattacacaatttaagacggttttcaccttaaatgatactgcaacggcctttgttcaaagtgccttttacggtggttatttcttaatggcaattccggcttcaattcttattaagaagacatcatataagttagcaattcttattgggctattattttatattattggttgtggaatgtttttcccagcttcacatgttgctacttatagtatgtttttagttgctatttttgctattgctattggtttgagttttcttgaaactagttgtgatacgtatgcaacgatgtttggaccaaaagaaactgctaacaaacggttaaacgttgctaatgttttgattcctcttggtgatatcatgggaatcgttcttggtaagtaccttattttcggtgaaggtggaaacattgccgacaaggttgctaagatgtcaaaatctgaggcagaagcttacaatgaacacttgcttcaattgactttgcagccttataagtacatcttgattgttttaatcatcatctttatcgttttggcagttactaagatgcctcgcgctaaggccttctcaactggttctgaaactaaagaagaccaaccatcacttggcgaaactttcaactacttattccacaataagcggtacatgaaaggggttctctgtcagtttatttatgctggtatgcaaacgactgtatggtcattcactattcggttagcattacgccttgattctcatatttctgatgcagctgcttcaactttcatgatctatagttacatcgcttggttctttggtaagttagttgcaaactggttccttgaccgttactcaattactaaggtattaacttggttctcattacttggaacaatttcattagtaattacctttactgttcctaacatcacagcggtaattgcggcaatcgcaactagtttcttctttggaccagaatggccaacgatctatgctcatacccttgatcaaattcatgaaaagaagtacaccgaaactggtggtgcatttatcgttatgtccttaattggtggggcaattgttccaacaattcaaggacgggtatcagatttaactggttcaatgcagttatcattcattgtcccagcaatttgtttcgcacttatcactatttacttctggactgagcaccgttgggaaaaggctcatccaaatgaagtgcaagaacactaaaatttcccaggaaataaataaaggcccagcggttatttaatcagctgagcctttatttatttccaaaactttaaagtaatttttttctagattaagctaaacacgaaatgaaatgatataatatgaacgtgatttagaggatggtgaatgcgatgcaatttataatttcgcttctaacatggcagaatctgattcacttaattgatatcttagtaatttggtttttaatctacgagttattaatgttgattcgtggtacaagagctgtccaactatttcgtggtattctgatcattattttggttaagattgttagttggtatgttggtttaagtactgtttcgtgggtaatggaccagattatcaactggggtgttattgcaattgtcattatcttccagccagagattcggcgcggactggaacaccttggtcgaggaactttctttactcataatcaaacagcaaatgagaaagaagaagatatgattaagcaattagaccaagcgattcagtacatgtcaaagcgaagaattggtgctttaatgagtattcaaatgaagactggtctagaagagtatattgaaacaggtattccactcgatgctgatatttcaggggcattacttattaatacttttattcctaatacgcccttacatgatggagcagtgattataaaaaataatcggattgcagtagcggctgcttatcttcctttgtctgatagtaaattgattcctaaagaattagggacacgacatcgggctgctgtcggaattagtgaagtgacagatgcattaacaattgttatttcagaagaaaccggcgaagtttcaattacgaaagataatgaattaattcgaaacatgtcgcgagatgaatacctaaagttcttacgtgctcagttgtatacgcatgagcctcaacacgaaaacttggtaacagaactttatgctaagtttcaacgtaaaggaggtggccgtcatgggcaaggacactaaaggcttctttcgccggaaatggtttttgagaattatttcgttaatcctagcactctttctattcatgtatgtaaatgggagcaaaagcggcttccttcgtcaaaatactcggaataataaccagagtagtgctttaatgtcgaataaatccgttacccttcgaatgccccttgatgtaacaattgataataataagtatattgtcagcgggtatcctcaatatgttaaggttaaggtaaccggtccttccgcattggttacaactacctctaatactcaaaattttaaggtgtatgcggatttgtctgacttgactcctggtaaacaccgagtaaagttaaaaacgagtgggttaaattcagaattaacttctaaaattgagccacaatatattaatgttaatattcaaccacgcaagacgattacaatgaaagtaactattcgtttgagtactagagatttggataatggctataagcttggacgtccacatagtgatattcagactgtccaagttactggttcacgagatgaagttaataaagtaaatcgaattgttgcttttgtagcaattccgcacgatgcaaaggatagtattgcacgacaggtaacactacaagcaattgatcggaatggtcaaacacttaatgttgtgatttcaccaactactactaatgtttctattcctatttctgcgggttcacaaagcagcagttcaaatgatagttcatcaagtagtagtggtagtgaagagagtgaagaagcaaagagtaattcaagagcaacatcgcgaaatgactcttcagattcttcatctgaaacatcccaatcttcaagcagcataagtaatgaagattcaagttcaagtagtcgaaatcaataataaagatacacatagaggagaagtgaaatgaagttaaaatattttggaactgatggagttcgtggagttgcaaatcaagatttaagtccagaattggcgttccgtgttggtcgcgcaggtggatatgtccttactcggcactcggaacgaaaacaacctcaagtattagttgctcgtgatacacgaatttcaggtgaaatgctagaaaatgcattgattgctggattattatccgttggtattgaggttttacggctaggggttgtcactactcccggggttgcttaccttgttcgggcacaagaagctgatgctggagttatgattactgctagtcataacccaattaaatataacgggattaaatattttggtggtaatggatttaaattatccgatgaattggaatatgaaattgaacaattactagatgctgaagaagatacgttgccacgaccatctgatgcaggcttaggaacagttgctgattatcatgagggagcattaaagtacacttcattcttggaacaaactgtttcaagtgatcttgaaggattaaaagtggtagttgatgctgctaatggtgcaacaagtggctttatctctaatctttttgctgatatgaatgtggactttattccaattaatgatcaaccagatggcttaaatactaacctaaattgtggatcaactcacccagagagcctccaaaaagcggttgtggaaaataatgctgatcttggagtagcatttgatggtgatggtgaccgttgcattgctgttgataatgagggaaatattgttgacggtgataagattatgtatatctgtggtaagtacatggataagaagggattacttaagaaagatacagtagttacaactgtgatgagtaatctgggaatgtacaaagctttagaagcgcacaacttaaagagtgttaagactaaggttggtgaccggtatgttgttgaggaaatgctgaaaaatggttataaccttggtggtgaacaatcaggacatattattttcttagatcacaatacaactggggatggaatgcttaccgcactgcaactcttgtctgtagttaaagactctgggaagacactcgctgaattggcaaatgatgtaacaacttatccacaagagttattgaatattaaggtagcagataaaactactgcaatggaaaatcaaaaattaaaggaaattattgcgcaagtcgagaaggaaatgaacggggacggacgggttcttgttcgtcctagtggaactgaacctcttttgcgcattatggctgaagcagctacgccagaattagttcatgaatacgttgaacggatcggtgatgttgcccgcgcggaattagaagtagaataacttgagaagtgaaaaagcgaggctggaagaaaatttattcttctagtctcgctttttaatcttttaataaattttaaatcatatagaccaatctaataaaataattgacaagataatctaaaaactgtactatacaatacagttgattagatctagtgataatcactagttatctataccaattttatttaaaggatggaatttaattatgtgtggaattgttggagttacaggaactgacaagagtttgtcaattctaattgatggattaaagcgtcttgaatatcgtggatatgactctgcaggagtttatgttaatgatcaacaaggacatgattaccttgtaaagcggccaggtcggattgctaatctagaagcggctcttggagaagaagtccatggtttagccggtattggccatacccggtgggctactcatggtgaaccaaatgaagccaatgctcaccctcaatactctcaagacgaacggttctacttagttcataacggtgtaattgaaaattatgctgacttaaagaaagaatacttatctgacgttaaatttgttagtcaaactgatacagaagtaattgttcaattagttgataaatttgtagttgaatctggaatgtcaacagaagcagcccttcttaaggttcttcgtttaatcagcccagattcttcatatgcatttgtattgatggataaagaacaaccagatacattatttgttgctaaaaataagagtccattattagttgggattgctgatggttacaacatggttggttctgatgcaatgtcaatgattaaggaaactaatacctttatggaaatcggtgaccacgagttggtaatcgttaagccagatcacgttactgttaaagactttgatggtaatgagattgatcggccaacatttaaggttgatatggatgctaatgccgcagataaaggtgcttacccatactacatgttaaaggaaattgacgagcaaccagctgttatgcggaagttagttcaagaatactttggtgacaatgatgtagcacagattaatgaagagatgttaaaagatatggcagatgctgaccacctttacatcgttggtgccggtacaagttatcatgctggcttagtaggtgcgcgcatttttgaaaaactttgtggaattcctacatctgttcacatttcatcagaatttgcttatgagcaaccactcctttctaagaagccgttctttatcttcttaagtcaaagtggtgaaacagctgatagtcgggaagtactggttaatgttaataagcataactggccaagcttaacaattactaatgttgacaagtcaacgctttctcgtgaagcaacttacactgaattactttacgctggtccagaaattgccgtggcttcaacaaaagcctacactgcccaaattgctgtcgaagctattcttgctcaagcattaggcgtttacatggataagcaagcagctaaagactttgatgttaagcaccaattaggattagttgctaatggtatgcaatcaattactgatagtaagaagaaagtcgaagaaattgcttctcgttacctctctaaatctccaagcgccttctacattggccggggaatggattggtcagtttcacttgaagctgctttgaagttaaaggaaatttcatacgttcaagcggaaggttttgcatctggtgaattgaagcatggaacaattgctttaattgaagatcagactccagtgattggaatcattacccaagatcggactgctggtttaacacggagcaatcttgaagaaacgcaggctcgtggggccaatgcaattacaattgtttcacggcaccttgcaaaagaggacgatacattcgttcttcccgatgtcgatgaagtgttgacaccacttcttagcgtaattccagcacaattgttggcttactacactagtcttggtaagggacttgatgttgataagccacgtaacctcgcaaagtctgttacagttcaataaaaattataaaggaagttagagaagctttagttggtttctcaacttctttttatttttaaagtaatttgatattttctttagatttgtttaataaaagggttgacttacttttatggaaacgctaccatgatagttgcaaggtataaaataattaccttctaatcaattctctttctctcttatgccgatcatcgtcttttagacgatgatttttttatttaaactcgctataatgataagggttgaaaggggaagaacaacgtggaagaacaacacgaaacgttaacattaattgaggaaattacccgtaatgacggctcaaaatattatgaaattggtaatatggttcaaaatggccgtgcagaattagcagctgaacggaattttattaaagaggttcgtattttagaactaaatatccctcattctaaaaatattattaaatatgaacactttataaatactcactataagatgcaaaccgaagcaatggatcattgggaagaatggaaacgtcccccagagattgaagaggttgttcaaacgatcttgaaagaaaatcatattgggtaaaccaggaagctgagttatttggtagtactaaaaatggatataaaaatgtggaggttaggcaatgaagccaaattttaatccatcacaggggatgaagtcgcactatttcgttacagggatagacggcttacgaacattagctgtcttaggagttattatttatcacctattgcccaatgttttaatgggtggttatttaggagtgccgctttttctattagtctctggatattttgtaacctatcaatttagtcggcagcttaaatatggtagtcatattaatttagggcatttttatctaaaaaggtttcggagactatatccgacattaattgcgatgttaattttaacaacagcgtacattacattatttgcacgagagctactccataacattcgggcagtaattgttactaatttaacttggatatataattggtgggaaatcagtcatgggcagtcctactttgatcagtttggtggcgtttcaccttttacccatctttggacattaggggttgaagcgcaattttaccttttgtggcctttgattattacgttattgtttgcggtttttaaaaagctacagaatgtgcggcgggtagttttcatattagctgtattgtcagcaatagaaatggctcttctttacgatccggcaaatatcaaccgggtttattatggaaccgatacacgggccttttcacttttacttggctcatggttagggcttgcgtggccattaaatcgacttcggcctaatttacaggcaaatagtcgccggttacttaatattataggaattattgcaacagttttgaccattgttggttttttctcattgaatggacagtccgcctttacctaccgcgggggaatgtttctctatagttttattggaatgatattaatggctactatcattcacccaggtgcggggatgaacaagtggtttacaaatccggtttttcattgggttggccagcgttcttatgggatttatgtttatcaatatcccgttatggtcttttatgaacgagtaatcaaagtcggcaatcatccacttctcaatgcattagtagaaatcattattattttagtagtaagtgaagtttcttaccggttaattgaacgcccatttgctcagtatcagtggtcaaaattaccggctgatctccagcatgtgttagaaacgcatcactttagttggcaaagcggggctaaaatgatggtaagtgcattagttgttgttattgcatttatcggtttgtgccaaccaaaccgtgcaccaaagaaaacagcggttcaacaacggatagagcaaaaccaccaggctgctgaagaacacaataagaagattacaaagggggataatgttgcggaagctagtggtaatacttctaagcttcagaaacagtatgatttaacccctgcacaaataaaagcagcgcagaagttaaaggtaacggccatcggtgattcggtgatggctgatgccgcagatagtattcagaaattaatgccaaatacttatgttgatgcacaagttgggcgtcaaggttctgccactcctgatgttatcaaacaattaaagacagatgggcatttaaataagattgttgtcttgaatttgggaacgaacggccctatgacacaagatacgttagacgatattttaagtacgattggctctgggcaccagatctattgggtaactgctcatgttccaacaaagccatggcagcaaacggttaataacgaaattaaagatttagcaaagaagcataagaatatccatgtggtcgattggaataaggcaagtcaaggacactctgattggtttgcaagtgacaatgtgcatatgggaccaagtggaaatgatcattttgcacggctaatcgcaaaggagatcttgacaaaaaaataggaggttagtaatgacacacgaagatcaattattagacaaagctatcaatatttacttaacaggattaaagggcatcgaaagctttatttccgaaccagcgagtgaatataatttatcttttgaacaattcttgattttacgaaaaataattaaccatcctaatatcaaactaatggatattgccgagcaacggcaagtaacaaggagtgccgtctctcgccaattaaaagttctttttcaacaaaaatatgttgaacaaaaagctgatccagccgatcgacggcgaatgttcttagttgcaacaaaaaaaggcaaagatgctgaaagtgagatttggcaaaggattaatcaccgctttgccaattgggttcagatttatggtgaagatcgtgctgatcagtttttaacactttttgaagactttaatcaacaaataattcaggggaatatccgaaagaaggaataagaaaatgattaagatggttgcgctagacctagataatacgcttttaaatagtaataaagaaattagtcaacgtaatgaacatgtcctaaagcaattacatcaagagggaattaaggtagtgctttgtactggccgcccaatcaatgcaatttggccatatattgaacagcttggtttaactgattcagatgattacacagttacgtttaatggcggattagttattaataatgaatcacgtgaacatctttttgaattagggatgaaaaagagtgatttactgccactattttcttatgttaaacgaaaaaagattcccctcaatgttttagactttgaacgggtatacgaattaaatgattatccaggatctatttatcggacagtgttaaagaatattgaattccaatctttgccaatgagtgatgtgccggaaaaaacttatagtaaagctgtaatggcaatcacccctgaaaaattgtctactattataggagaacttccagctgatcttaaagcgcagtatcatgcagttcaatctcaaccaatgataatggaatttttacctaaaaaattaaataaggcggttggactgaaggcgctactagatcattttggggatgattttagtaatttgatgacatttggggatgctgataatgatcttgaaatgattgaagcagctgcccaaggaatcgtaatggaaaacgggcttcctaacgttaaagcagtggcaacagtaattacagatacaaacgataatgacggggttgcaaagtattgtgaacgttattttgcaacacttttgtaataaagattgttataaaaagtaaaataaagagtatttttggcgcaaatatgaattttttgctaaaaaaatactcttttttatgtataatttaatgacttttcaataaaagttatggggccctaaaagctaactagcacaaggacttacagattttataatcatattaattgacaacttatattacgaaatattacaaaaagtcaacggggagtagtaaatagaaatggtgctgttacagcttagtaatattaagagtgtaatatataaggtgttgaaacggaaaagataatttgttgaataataaaggatggttgtttaatttatgatttctaagaaaaactttgctaaagtatctgctactcttggtgcagtggccttaggtgttagtgcaacggctactgctgctaacgctgacactatttacaccgtacaaagtggtgacacactttcaggtatttcttacaaattcgcaaaagacaacagtatggttaatgatcttgctaagaagaacaacattcaagatattaacaagatttatgttggccaaaagttaatcatcaagagcgatggtgaaattcaagaatacaacgctcaaaacgcagctaatgcaaacgtcgctaataacaatactcaagctactcaacaacaagctgcacaagctcaaagtcaagctagccaaagctatacttcaaatgcttcaggttcagaagctgctgctaaggcttggattgccgctcgtgaatctggtggtaactacggtgctactaacggtcaatatattggtaagtaccaattatcagcatcataccttaacggtgactactcagcagctaaccaagaacgggttgctgaccaatacgttgcgagtcgttacggttcatggcaaaatgctcaggctcactggcaagctaacggctggtactaaaatttaaactgaattattaggacaaagtaaaacgagactaagaaggtaatcttcatagtctcgcttttttatacaaatgtggtataataggtgtacctcttatggggatgtttatggattcgacaggtataggtcgagtttcaattgcgtttcgaaggttgcgtcttcgtaaaaacgctcagttttaaattataactgcaaacaataattcaaactcttacgcatacgctgcctaacaagtagcgcgcgtagatccattccgggttcgtccatggtgcggcaatgggttttataattagtggactacgcttgttactcccgtttgaagtaataagaagagattaatcaagctagctaaccatagttgccctgatcaacggcgttttggttagtgaaatctaaatagttgagatatgaacgtagagattgaaatggcgatatgcttggacacgggttcgactcccgtcatctccactatagggttgcacccagtttcaaatagcttcaaaatgctgatataataagatttctcaaaatgtaagatttaaacaatttcattaaattgcatttaaatgttgtatgaaatgttgtacagaaattaaatatcatttaagcatgaccaccacagtaatatgtggtggatttttttattttaaaatttattgagttgttgctgcttatcatttttgaaattgattttggtagtgtaaagatattaaattgtaaaggatgatgaatacaatgcttagtgatatagacagttggcgagatcttgtagcagcgcgtgaagatgatgaagcagaggcaaaggcaatcatgcaagatgccaagtttgaagatggttttaatgaattacagaaaatagatgataaaattattaaattgtatcgagaattcaatttaaaattaaagtatttacaagataatccacctgctgatacttccatgttgcaatggaatgaattaaagggactaaagccatttcctgttaacgaatattaaacaattagcttgcactaaatgcaggcttttttatttaccgaacgtaattatctaagttttaacttagataatgaaggtgaggtttagcaactggagctatagcgaaaggcggtagttttgtcttatattacttctgatattagaagtaatctgtttgtttacttgacaggacaagtaaatgattgtctgcttctcttcatcagttgaaagagaagggtctgtttggttcattttcgacaaggaaaaacgaacttgctttatccagatttacaattaaatctggtcaattttgattcttttggtgagtcaaaagaatgttcaattataagtctcaaaacggttagtgtttgaacgaataattgaaccagcgtaggggtgaaggggagctgattaagcgcccctccaagaagtatattagctgtattacagctaatattaactacttgcaaattgatcatcaatgttatattattggtatagaccaataaatggtatagctataacatagatgatcaaaccgacgaattacgtgatttagtcaaccgataattaccaaaaggtataggttgaaaatcacttaaaatttttagaattttactggtaatgaggagggataaaatgtgaatacaaatatcaaacgtaatatgattcaagtacgcttaagtgataccgaaatgaaaaatttcgaagcaataaaatcaacgttaaacgaaaaaactaatgctgcaactttacgtgaactaatccaattagcaccattagttggaaagcaatcgcaagagcaagttaaacatttattgaatacctacgatgacttggaagctaaagttagcgcgttgctgtgggatagttcgaatgttacaaaaaatctaaatgaaattgctcatgctgctaatattgcgaagaataatgatccagcaaatgaagacacttggaattggattattcaacaattaaaggaaattttcttaagtattaaccaattaaatcaaataggtgagcagactaaaaagttcttgaaagaaggactggaaaataatggcaattcttaattcgacagcatgtaaatcttcttatggtcgattaacttacatttttaatcaatctgctcataatacaagtaagacgaatcaccgtgttttagcttgttcaggaactaatattaatatgttgcatactcctaatggccatttatcaacattacagtcgggagcttacttagaaaaacaatttcatcaaagtttaaagcgagcttataatccgaaacgaaagtatcaagctcaaagtattattattagcttctcaagtgaagagtttgatacttccgacctaaaacggcaagctactcaagcaatgcaattggtagaaggatacgtacatcaacattttagtgatgctcaaagcgtttcttgtgttcaatgcgatggtgatggtggaaaacttcatgttcatttattgattaatactgtaaagacaaatggtaaaacagtaccaacaaatcgcttctctgtctatcgaatgcggaggaatttcaatgaatatcttgaacgtaattttcaactagttaccggaagagaatggtctaattcatttaataaagcaagtacacgtaaggatgctaaaacaataattacgcggtcaagttgggaagaacagcttaagcagaccataaatcaggttaaacaggaagtacgtaatgttgttgactttattaatcgtttgtctactaaaggcattcagattaaagaacggggtaaaaagaagcaatggacttacacccagattatcccagataaaaatggtaagccaaagcttcatcgagtgcgtgcttattatcagcgtaaggataaagctgggcatgttttatctacgcgcggcttaggtcaagcttatacgagacaaggcttagacaattattggcgtcaacaactagaaaaagaacaggagattacacctgttaaaagtcattacagaaaggaagtaaaaacaaatgacagaaaagatgttcaaactgaacgagaagaactcattaaaattagaacactcgcccgagatgctcaggcagcagcaaacgaacgacagcgacgaatccagcttaatctccaaaaatcacgttccgccgatgctgaagagcggaaacaaagaactcaacctcaaactggatcagctacttcaagacggcgcgaccaaagccgatctaagtcaattagcaagcagcaacgatatgcagaaactacgcagcgacgtgtcaaaaagcagcaagaacgtgcaaaacgaactaacggaaaagatgtcggaccagacctctaaattgatagaagtcgctaagagtacacgtgatattgcttataacaatgggttgcaagcagatattacgaatactcgtcaattggttgatgcaatgcagaaacgacaagataccgctaatgtacatatgaatgaggtaacaagacaaaatgaagctatgaatgctgatttaaaacaaattggtcctgcaattgcgaaagtagttaaggctcaaaaccataatagtgaaattttaaataaggcgttgataaacggatttcatatccatactaatgaggttacagaatctgttgctaatgagtttaagaaacttactggatttacaatcaatgagtttttgcaaaacgaaattattaagcagattaatgttaatgtttatgaagcgaaaaaagcaaaattatcggtaattcaagcagcccaagtaactgaagaagtattacataaaattgcattattaattcaacgctttataagttttgtaagtgtattagtttttgaattagggctaataattgcatgtgccattatgcttcctggttggtggaaattaataggattaatagtgactactagtgcatctgcaattttaaattattatttgaagaggaggatggatactaatgggctataacctaaatatcgatactgacaatgaaggtgcattacaattagcgatgcagggccaacaaattccttcttgggtatatgaaaactctcagatagcccatgagaataagcgaattcgtttagtagctcttcaactcgaagctgtagaagaagcacaacaaaaacagcgaggacaattacaaaaacaagaaaaagagagtaaaaacaatcagcctaataataaacgtcaacgccatcaggtaaaaaagcaaaaagatgatttgttattcgaataaaaaaaagacctcccgtcataattgggaggtttttatttgttcttaagaagttctaatattattttacttaaatgttctgttttagaataatcgtaattttcaagcttattaattaatttcgttaactgtggtccacgatgagaattgttttccgtagccgcctgattagtcattagagaatccatcgatgtgccgagagcagttgccaatcttaaaagggtagtcgaactaacatcatttgatccaccacgctcaaggcgagaaataaaattaattgatagattgcttaactcagcaagttgttgttgggtcatgtttaattcatggcgacggttagcaatattttttcctaataattgttgcatagttaatctcacttatccttttaatattaggataaaagtaagtatgactatttagaacgttatttataagtgttgatagttgcatatatgcatttataattagttatttatgtgcaatgatattgacttatgtgtggatgaaaaatataataaaaaatgttaattgtaaatagcttcttttactattcaaagtgattagtaataaccatgtatttagggagatgttaaatacatataaatagaaaataaaggtcatatcgatttaggtttaattattagaaatttaatgcgcacataacaaatataattttgggggatattatgaatagaaaaaataccatccttaagtcaactttacttgctacatcagttgtaactattagtgcagttactaatgttacggttcatgctgatgacatggcatcaaaaacgcaaagccaaaatacaccggagaaacaaattgccaaaaagcaagataacaacaaccagcaactatctgctttaaagcaacagcaaagtaactctgaaaatgaagtggctaaacaaaatgctgataagttaactgaattacaagaaaataatgctgaaaaaattaagattttagatcagcaacttcaaaaccaaaaacaagttacccaacagactgctaatgatcaattagcggctaaaactaatacagttcgccaatccgaacagtcacaagccgttgctgaaaataatgcttaccaatctcaagtagatgctcaaactaaggctaacgatcaagccgttgctaaccaacaacaagcaaacgcccaagaattagctaacgccgctaagcacatcgttacccctgaacaaaagcaaagtcaaattgactctgccactaagaacactcaacaagccttaaaccaagctaagtctgatcatgacgctattgttaataagttaaacgatcaattaactaacgacctcaagcaaagcgctcaacaagaacaagcagctaagaacgatcttaagcaacctagccaagcagataagcaaaagcaacttgatgatgcgcaaaacgctgttaacaatgcacaaggtaaagccaatgacgcgcaaaacgccttaactaatgctaagaataccctaagtgctaaccaaagcgctttgacgcaagcacaagatggtcaaaaagaacatgtgactaacgctattaaattaccagctggttacattgatgcttggaaagaatatgttaacactaaagaaaaaaatgactatttagtaacagaaagtacttatccagacgtatttaagaagcttgaaacgctagataaagaagcattaaagaacaacgtatatcacactaattcagcagcagaaaaagtgccagtgaccttaaatgctaatggcactctttcacgagatgacattatcaaagccactcaatttgctgtttcattactaaacccaattcgtgaagcaattggcgttactccatacaagatcaccaacgcatctattgatgtcgctcaagatgttgctaacgaatatcgcaaggataactggaatacttgggaccacgcacacgataacgatgctctagatcgcgttgctaacaaatggaatattgaccttgtcggcgaatcatgggctggagacggatcatttggtcaagtcaaatggactccaaacaatggcgatacaaaattcatccacaactataataacctaacactaaatgatttatacaaaggtgtttatagttcaatcttatccttattgttccacgacgccgatcaaggttacggtcacgccactgacctattaggtgttcgtgccgctaattccgatttaaccgttgctggtgacaaccttggtgtaagctttgaatacggcaaggggatgaaggcttggggccaaaccaacgttggtggtttccacttcaactctatttctgacgcttcttccaagaacattcaacgtttagttaaggaaggctacgttgttgacgccgctgatccaaatgccaaagttaaccaaccaggctatcgtgatgaaatcgccattcctggtaacacatctcaaaagcaaatcgctgatttacaagctaagatcaaccaagcacaaaaccaaattgatcaattaaccaagactgctaacgcagctaaccaaacattaactgcggctaaagctaagttagctgatctgcaaaagagcaccactgatgctaaaaacagttatcaacaacaattagcagccattaacactaagtacagcgatcaaacaactaagcttaaggctgaccatgacgctaagatcaaggccgaaaatgacgcttaccaagctaaagttagtcaattaaacaatgaccttcaaactaagatcaacgctattaaggctcaacctgaaaacactgatcaattaaagacccaacttgaccaaaagctggcccaagttaagcaagatggtcaacacaagcttgatcaattaaagcaagctcacgaagctcgtttacaaaagattcaacaagacgctgaagatactttagcggcatacaaggctaacttagacaagaatgctcaaattaagattgctaaggctcaagctgatcacgatgcatcagttaaggctcttaacgataattatactcaacttaagaaccaattagatgctcagcaagctaagctcgttagtgatgaccaagctcaatacaatgctcttgctactaaacttgacggcgaattagctgccttaaagaaccaagtattgccaaagactagcgatcaccaaactgctcaaaacaagcaagttgttgctggtaacaccgataccgttgctttagatactactggtaagactactgttgtgttgcctagagtgactagtgatatcaatggagaaaaaccagagtcagttaaattcttaccgcaaactggtaacgaagagaactcgtttgcaattatcgcactaggtgctttcactgctatgtttggtatgaatttagcttcacggaagcgaaagttttagtttgaaatatagagggaattgatagcattgacagtagaagttgataatgattcatatttttatagcctattaaaagcacatgcagcagaggtagcgaaagagccaggaaagtcgccaagtcactacgcagcatacggtatgccaatcgatgtattacgacaaaatataacagaatatatgtattatggaaattctgaaaaaattgaaaaaaagatacaaacaaccatctcaaacatagcgtatactattcaacttttggaattttatattaatgctaagaatgaattatatttatcctatccaatggagagaatgttgaataaggaaattttaatcacttcctttgaaatccaagaagctctaatcagtataatgtttgacggatactataaggctaaaacggcgcaagaaagaattttaaagcttaaaaataagaaaaaattaagtgaagattttattaatgctttagacgatgaaagaaggtatcgtaataaagttcatttaactggaaaagaagataattctattcctgactataaaatttttgatgatactgaaatggttaataagtcaattaatttgttaaatgagctttttgaactaaaaatacatgatgatcaaaagatagtattaccaaatgttaaataataaatcagatatcaatccagataatggacagcccaatgtagactttaagtaataccataagcaagttcagctcaaaatagagaataatatgtgtttactaaagtagttgcgaaatataagactgaacatcattagaaaaaaagccctagttaacgggctttttaattttttaaaacccgaaatgtcaatttaagttagaaagaaagtagttgctcatcagtgacgtaggacatgaatacctcatatggagttcgatagcctagtgatttgcggggcaggttatttcgcttactcatcagttgggtcaccaattcatcaggaagattgcggaaatctagctgttttgttaagccgtcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgctgcgggaatttccgaagccactgacctaagtgttggttaatcgcatcagccgtcttttcgtgcacattgagtacaatttcgaccttcgattggcgttcggtcagggtcattaccgccccttggtgctttttgccttggacggtatcagcttcaaggtgtccaaattcagtggcatagtgcggaaagtccttggcacgctcgtgaatacttcgccccaattggccagccttcccgcggcgctcaatatagccattcgggtgccgcttacctcgcatgggcaaagcacggacatccaaaccgaactgcccccgttcaaacatccggtaaagagttcgccggttacaactaattgggcgctcagcgcgcccaataatggtgtcaggcgtccacccctgggcaattttgtcgttgatataagtaagttcagccagtgacaactgagtacgttttcggccacaacgttgcttattgcgcatatagtgatcttgataatcagcaattgaggcaccggtttccaggtaacgataaacgcgataaacggtttcggcgctacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgaaataataaatgacaacctttaagctcaatttcaaagtcgctactaatggtattaagactaagtatccagttaatatgatgtgattttataaatttattcaaagagtcgaaatatggtgctaattcagttagacttatttcgactcttcctgtaagacgtaattcatctatttgtgcatcgttaagttgataaccgcaagcaccttttatttcactaacaacagtattaacatgtttttctattacttgatttaattcgctcattacttatccctccgttaaatgtaagatattgagattaattacagtttgaatcgtcatttaagattaatgtgtaaaaacctaaaaggttattactaatatctgtagctttatacattgtccacacacgatcttcttgagaagtttctcgtaaataatttctaattttagcaatgtatggtttaatccgttcagcagtaaagaatagtaagccactatttaatagtgcttgttgctcactatctgttaatagaagacttgcttgcagttgcaagtcctcattaacctcttcaataatttcattcattgtttgcataataaaaaacctcctaaatttttgaattcataaatttttctgcgctgaaagcgcgaaactttagaagctatgtgtttattgttaaattattgacgtacattattgcgtacgttataattacggtataactataatgtgaaagaaggttaattaaatggataacattattacaccaactaatgcgcgaaaaaatttatataatctgattaagaaggtcaatttagatcataccccagtaacaatctcttcaagtaaaaaagaagaagatgctgttttaattagtaaaagcgattgggacgctattcaagaaacaatgtatttagaaaataatggagttggtgatgtagttcgtcaacgtgagaaagatgatagtggctttaccgatatagatgaaattgattgggataagttgtaatgtataaagttcaaattaagaattctgctaaatcagatctaaggaaaattaagcatagcaatttaaaaggaaattttaatagggtcatccaacagttaaaagaaaatccatatgaacctaatcaaggatttgaaaaattagagccaccaatggcgagaaagtattcacgaagaataaatgtccaacatcgtgtagtatatgtagttaatgataaagaaaaagtcgtttcaatttattcggcatggtctcattatgaataaaaaagagtaatgagcctgtttaactcattactcttagtagtaacattagcaaaaacacattttttaattagtcttgaattcggtaagttcttaaagtatcaataatgttttccctcaaaacgcatagtgggttaataaattgatctttgtttcgctttaatgcacgattgaatgatttgaattctttataacggtcttgaaataaatcattataaattagctttaagtcatattcatctgaatgctgtgctaaatagcgtaacatcactttttgaacatattcttttttataattttcaaggatttcaggataattcttaccttttaaatacgtatcatctttaacccacgatacatgtttctcaatccgttcaccatgatgataatcgcgtacagtttgatctaatcccataaactgtttagcgtatttttttcgaaagcttgggaagagagaacgataattctttaattcttttcgatacgtcattaactcttcgattgaggagaagggacgtgtcaaataataaccgaaatcactttggggtacaaagccaattggttgataagtgtcgtcgggactcaagttaagccatttagtctgtttccaagttttcatactaacatagcgcttattatcaattgagtgtttcatgtcgtttattgattgcattctaaaatcatcaactttaaatgtcacagtatccttttcgagtagtttaattagtcgatctgttgtccagctgttaggctgtaatccgactagcgctttaatatggttatcttctgtcatattgaaacgagtgcgaatgttgattagagcagcttcggtatatttttgattgtgattatgcgactttagctcaaaaaattgtccaccaaagttatttttgttaactatcacccagcggttatcaaaatagttttcacatttttgacgaataatttcttcattaagtaagttgttagaacagaagataaacccatcagtggtcagtgaaggaacgagactattcgggtatgtttgttcaaccaggtccatcaacgcattgacttgatatcgggcaattgacgtgtattgtgcagctgtaaaagggttagtattacggctgaaaggtacatacattgtgttgccacttaaaaagtctcgtgttccgccagaacctaacccttgggctgatttaccgtagccaccgtttcctaataacttatagaaaagctgaagggcgtcatattttcgatattcatcagatttagagtcaaatttatcacgttttgctttagcttcatttcgacaaattagtgaccaatgctgcatttttccgattggcgctagacaggcaacatgtccatccaatattttttgttcaggaataatgattcgatgaactctaacagtacctccgtgttcaacaatgttaataatatcagttacggtcatattaacatgatttgcttgccggacgtaaattggcccttgatcttttattaaaggcttatagccaaccggcacacgttttacattgtccggaaagtgataagaaacattagcaacaccgattgtaaaagctccatttacaaaatattgtgaatgtttacggtaattttttaaaatgttgctatctaagtcatgtacatctaaaattggtttacaatcaagcctaaaatctgggattaagtgaccagcatctacatagcttgatttgagatcaatatcatatttatatttaaacgcactcgtgataattccagggttaaaggctaaattcattccaccaacatacgcttctcgtgccatagcgaatccatcattatacacggaatcaggtcgaacgctaaattgatcatgactacctttcttatgttttttatcaactgtactagattcaataaaattataacctttccgcatttgatcaaaattcaattgggttgttaaaaaaatttcaggcgaccaagtaattacatctttgttattaaaccaagaaacagtactataaatagaagcgttatttaacttagttaggatattatcaatggttggaggtacattattacgtgtgtaattaaattgatgtgcatgatccgcatattgattacgtaacttagtgctgatcgcaaattttggcttactgactttgaccttctgatttatcaaattgcttacatcaaatttaggattatcttcgtataactttttaaagttaattcgatcggctaatatcgaaggtgatcctttttgatttttagcaggtgctgaaccaattagcttttgatagatatatcctttcttgcttttcttgtaagcaagtgtacctcgagcgagataaggttttagtttttcaataaatagtttttgaaattcaaaattatctgaaccatcaacagcatcgcttaaaactttaacccattctctcgtatctctgggtggttcttgattgtataattttggtcgtaaatatttatcaacatcaataccgcgaaaaatatcttggaaaatatttttaaccgtttttgaatcataaggttcttgagagtaatgagaactaatttcatctgctaaagatgttactgtcgcgggaatatgcacattttcaattaattcttcattatatacatcaattacatttcccataaaaaagtctaagtattttaaagtaacttctgaatcacctagagcatagtttaaataatcatcaggacgtttttctaataaagaacgcatgtgagatttataatagccaccgttataaggatcattgaattcttcaaaagaaattagtttatcctcaagatcccaatctttcgtgttaagtttcttttgatcaacaattgatcccaaggctgctaaacctccttgtggcccaaggggcattgtatcgacaaatttaatagttataggatacttgattcgtcgtgaattaggatttgtaaccatgattgaatatggattactaaagaattcttgcttgtttaaagcaataaaagttggttcattctttgactttccttgaatatctaaatatttttccaatcataataggcggtaatgtcaacacctgcaaagaagcctacatatacaaccggcggaactcgattcgatttattcaacttttctttaattttatcttcttttaaacctaattgtcgcgctagtcgtcgataatctccgtctgtatattcttcacagtaaccaacattattaagataatatcgaacaacgctaataagatcccagaagctgaatgatttgtctccaggttgacgataaattacaatccccatcgcagaatattcagcatattttattacgtattgatgactaataatatcgtcttgattacgatagtcagtatcattactatggctctgcgatgtgtcccattcgctgtcatcagcaataaacactgtgtcaagtccataatctttttttaatttagaaagattttgataatcatcaatcttataatttctaattttaaaagttcgtgttaatgtgttaacaccgctcaaatttatagcctccttatataactaaaggaagcaatactaaaaaccacactatactaaatagtgattagtacacacaatatttatatgttataattttttaaatactgaagtgagtttttaattggtaatgatacttcactttagtgtttttaatattttttgtttggagaattaatcaaatggcggtttggttaattcttttttgttattttgggtgaacacttttgttaatgttgttcacccaataaatgctctgctttcttactgtcacaacgattacggtagggtgtcaagcgggttctttatgggagagtccccagaggtgctaccttttgacactaattcattattaatgataattgctaatccatttaccattccaagctttatttggaaggcgattatgaataccggctaaataaatttgcttggttgtgggtcgcacatgatgcgaacgataatacttaattaacaacccggttagtgatttattagggtcaacttctcgttgaaaaatattacctggcaaattttgaggaaggcgattataaaacggtggacaacagataacatcagcgatctcgaactttatctgataaaacagagcttgaagcaaataattattactgatatttaagctttttgccactaaactaaagtcattttgatcacttcgatctcgcttgtttttgttaaaccaaagcaagaaatctcctggaatgagagatgaagctaaaggatgcaattgactgcgataccaccacgaatcatgcggaacatagtcaatttgtagtttactccgctcaattgttttattagatgaagaaaaagtataattcaaatattgtttatgatgatgctttgagatacctttttctacatctacattaattaatgttaattggctttggggctgcgtgaataaagagttgttcagactaacgctttgtagtaatcgtgtgtaagttgctgctgtaacttgtgacggttgatgtattgctagctcactaatttttaagtttaacgctgtcattaacgaattgagcgattttagtgcttcagttttttgctcttcatgtgatgcgttaatcataagatcacatgtcttaaaattttcactaatttgaagtaatttgcgatgcgaagatgctaatgtgagtttgattccaaaatttgggtaaatcacttgtgcatcaactaaaattaagtctttaatagactctgtaagtttactttccaaaagcactcacttcctttttgaaaatgacttatagtaatcgatataatcatcaatcgcccagctaaccagctgattaatggaccgaggtggtttacaaccaggccaaaattgcatgtcaaacaacattttttgtacaatagcttctttgttctcgtccaaattaataatgtaattaataataaacactcctcgatgttttccttgctattaattaatctttagaagtcataaacttatcaagttcatatcgattgaagcgataagttttgccaaatttggtatatggaatgttagtagtagcaatccattggtcaagcgtattaggagctatatttagatacttagcagcttcagactttgacatataaggtggatattggctagtaagtgctcgtttgcttgcctcttcaattgcttgagtaactgcatatttgattgaattagctaagaaatcaggtaattcaactttgatttttgacatttaatcatctcctctcttctcctctttggttaaaataaagttaactaaagaggagaataatatgcaattctagccaaaattaagtaaactaaattttaaccgaattgcttgacgcaatattacaatattactaaaataaaatcaagtaaaattaaatagatttcttttttattcttagttcgcaatggaggtaaattgcgtattatcaactaaaaatagcgattacgattttttttgaggaatatgaagtgaactttgagatatataataaaatagcaattatatcgaatttagatttataacgtaaaaaggtggtatttatgtataatcgggttgcattaggagctagaattaaagttgttagacaaaaaagaggtgaaactcaaactgagtttggaaaaaaatttttgccacctgttagtaaagttgccgtttcaaaatgggaacgcggaattacaaaaccaactgcacagcgtttgcgtgaaattgcgaaacttggtaatgtgacagttgaatttcttattaatggcgacaatacgactgccgaggaagcgcaaaagttgttaaataaagtcattagccgatcacgatctactaatgaagaagataagaaaagattgaacggtattcaactggaattaagacaaaagcttaaatctcatgacgatgctgaaaaaatagcaggtgttaacaaaaaaactcatttattaaatgatctggaatcagaaattcatgttcttgatgaagatttagattattcaagtttagtaacatttgatcaattttttaagctttttaattttctaagtagtattaaaaatccttcaattttaaaagaatttaatgagattctttggcatattaatcaaattgctgaaggaaacgaaatttacgataaagaaagagatttattaaagatagataatttcttgacaaaattaagtatgtctaattagactgatagatataatgtaattcacttctcgatgtttcccttgctcaatcatgcttaaatgatgtacgcagaaagagagtgaaattacatggaaccttatgggtataatacaaaaaagggtaaacgttatcgggtagcttaccgaactccagataataaacaacataataagggtggttttactactaaacgtgaggcacgagcttggtatcgtcaaaaaatggtcgaaattgagaaccatggctttagtagtaatggaaaggtaacgtttgaagaagttgctaatcggtggcttgataataagaagcagacagtagctggctcaacctataaaaaatatgaaacggaatgtaataaacatttaatacctgctctgggtgataaattacttaaagatatcagtattcctacttgtcaatctttagtttatcaatgggctaaagatttcaaattttataataaaatggtcaatgatgccgcaagtatttttgatctaggtattaaatacaaattgatccatgataatccttttaaattaatagagcatccaaaaaaagataaggatgatgaaagaaaagtaagatcatttaccaaagatgagttcattacttttaaaaaaggattgcatgagcattatgaatcaacaaattataaggcgtttgctttcctttttatcttgtcacatacgggattacgaaaaggtgaacttctagctttaacatggaacgatattgaccttaaaggtggattccttcatataaaaagaggtgttacccgtgatactaaaaataatcttataataggtggaacaaagaatatttattctgtacgtgatgtacctattgggccagaaactattaaagtgttggaaaaatggcgttctgagcaatatcaagaactgaaattttttaatattaatacttttaaaccaaatcaattagtatttacaggcgaaaaaggtggtatattgtcaccgtcgaaacctggaaaatggctaaatgtaattgagaaaaagtataatcttccctcttatgtaacgccgcatggactgaggcatacatacactagtttactaattgaagatggaatgtcggtcaatgatgttgctagtgtgttagggcataaagatgctacaattactataaaagtttataatgatttacatccgattaaagataattcgatcggtaaaattattgagaatctttaaaaactaaaatgttgtagagatgttgtataattaacatctaacaacataaaatagttgatatagcagcctttgggggacacgggttcgactcccgtcatctccactatatgcctataaggactgccattggtttatggcagtcttttttaatactaaatattgggataattagtggggtttcataagaagatattctcatgtaaaaattagtaaataaagttcagataaaatataaaggaatgaattaaatggaaatattaatgattgaggataatcattctgtctgtgaaatgatggcaatgttttttaagaaagaaaaatggcactatgaatttgcttatgatggcgtggaagcagaagaaaagtttaacgctgaccctcataaatgggatattattttgctagaccttaatcttcctaaaaaggatggaatgcaggttgcagctgatgttcgacgggtatcaccaacagttcctttaattatgttaacagctcgtgatactgaaagtgatcaggtattgggattggaaattggtgctgatgattatgtaaccaaaccatttagtacgattactttaattgcgcggatcaaggccctttatcggcgaacacatttaaacaaacttgaggatgttcaagatactgatagtgatgatacattcgatattcaaacaaagaactttaagatgaatactaagacaagagaagtattcttatatggaaaaccggtcggtgacttgacacctaaagaatttgacttattaaagacgcttgcctctaaaccacgtcaagtattcacccgttcacaacttttacaattagtatgggattatgaatattatggtgatgagcgaactgttgatgctcatattaaaaagttacggcaaaagttagaaaatattggacctcaagtaattaagactgtatggggggtcggctataagtttgatgacgagggtaacgactaatgaaattaatgtatcggttgatgctttcattttttgcgattattctgacgctaatggtgattgttagtatttcgtttataaatgtaactaataacactatgtatcataatacgtggcaacaattgaaaagttattctgatagtttaattcaggattctattcgttacaatatggcaacccaaagttttgaagggtttgctacagaatcgttaaatagcaatgccaatcttttaacacggcaaaatgttcactttgcaatttatgatacaactcaccggaaaatttttgccagtaacggctttgctcctagtatgagtaaaaatgattggaaaaagttaagaaagggagaaactgtttgtactaaactaattactcctaaaattaattcacgagtatcaaaaggtgtttctccacgaatgaccgaagtttcacgaccatacttctataaaggaaagatgattgcggtagtttcgattgcaactttcgtctcgacaattgagcaaaatatgcaccaaataaagattaacttaataatggcactactgactgctagtcttgtaacgcttgcagttagttacttcttggcacggtcaattaccaaacgaattgatcgattgcggatggctactcaccaaattgcgcaaggaaattacaatgttgaagtggacgataatgggcgtgatgaagtggcagacctcggtcggagttttaaccaaatgaccgcttcgttacgtgaatcgcaacaagaaattcgccggcaagaggagcgaagacgccaatttatggccaatgcagcccatgaaatgcggacgccattaacaaccattaatggaattcttgaagggttacagtatgatgcgattccagaagaggataaaaagcatagtatccagttaatgcaaaatgatacgcggcgtttaattcgcttggtcaatgataatttggattatgaaaagattcgcactaaccaaattgcgatggaacggaaagtatttgatgcatcggcagtactcgaaaatttacgagagcagttagcgaaaaaggcaaaagagaaaaaggatactctgcacttggatgtagaaaagaatttacgggtatatgcagactatgatcggtttgtacagattatgttcaatatcattcaaaacgcaatccaattcactgataacggaattattgacattcggggaaaacgtgtggaaaagggaagtcaatttgtagttcaagataatggaattgggatgactcctgaacaacttgaaaatatctgggaacgatactataaagctgatcgttcacggatgaatactaagtacggagaatctggcttgggacttgcaattgtgcggcagttagttcttcttcatggcggaaaaattgatgtaaaaagtcagtatggtaaagggacgacatttacaatctttttccctgatcgtgaatacgctcctcataatattcaacctacaaataataaagacaaaaagtaagccaatgatttaagtgaaacgctttaactgtgataataaagtgtttattttttgtagaccaatttttataatccaaagagatttaaagaaagcgcttgtgaaagcgtttaccatatgatacacttatatctcgtaataatattacggattgataggagagaattttttatgaactacttacttgctttaatccctgcgattggttggggaattatgccactgatcactggtaagatcggtggttcaacgattaaccaaatgtttggtattggtgccggtgctacgattgttgggttggttgcatttattatcggtcatccaactgttacaacgactggattctggttctcagtactgtgtggtgctttatggacaattggtcaaattggacaattcgtttcatttaagcggatgggtgtttcaaacacgattcccctatcaacagtacttcaattagttggtaactctttgattggggttattatctttggagaatggcgtggagcacgtacccttactattggttttatcgctttagcaattgttattgttggtgctttgatgacctctgttactgatcagagcagcggaaagaaaattactgttcagaatttcctttttctattaattacttctattggttactgggtttactcagcattccccaagatgccaatgattgctaatgatagttctttaggaatcttccttccagaaatgcttgggattttacttggatctgttatttatgctatttgttcaggtaatattgactcctttaagcaaaagaagcaatatctcaatatctggggtggtatttcttggggaattgctgccttagcttatatctttgctggacgggcattaggaattaatacagcctttgtctttacacaaatgaacgttattattgcaacaattggtggtatcttagttcttcatgaacacaagactcggcgagaaatgtcatttacaattgccggaatcatctttattgttgccggaagtattttaactatttttgcttaaattatattaaaactaaacttaaaaagaccttcatcggattttgatgaaggtcttttaatatcgaaattattatttaataagggaaatttcctaagcgatctttttcagtaatgggacgaattactttgcctgggacaccaaggacaagggagttatcaggaatatctttagtaacgacagtacctgccccgataacgcaaccattgccgattgttacacccggacaaactgttacattgcttgcaagccaacagttatcgccaattgtaactggtttgccatattcaacgtcatcgaacagatcgtcagcttgttgacgaatattacgctgctgatacatgagaggatgtatggctgtaatgatcgagacgtttggaccgcacattacattatttccaatagtaacaggacatgtatctaaaatagtaaagttaaaattagcatagaaattcttacctattttagtaaaccgaccgtaatcgatatgaattggtccttgaagatatattccgtcagcatgctgagaaaataggcgatcaataatcattcctcgttcaacagtatcttcatcagttgttaaattatagtcacgataaagacgatgagcaaggtgagaaaacttattgagttccggtgttccaggacgataaggcttcccagctaacatattttcagtgtttttatccatgaataattattcccttcaatttatgtaagcggatacgctgtgtattcccagtatgcctaattaaccttaaattgtcaattttcattaagaaaaatttgctagttctgattgaaaccgacttcattatccgctatcatttaaatgtctaaaaaataaaaatagaaagaagctattggaatgacacacattaaatttgacagtagcgcattaaagcaatttgttcatgaaaacgaacttggcgaaatgcaagcaatggttaacgccgctaatgatgaattacggaatggaactggtgctggcgccgacttccgtgattggctccatttaccaaccgaatatgacaaagaagaatttgcccgtataaagaaggccgctgacaagattcaacgtgattcagacgtcttagttgttattggaattggtggttcttaccttggggctcaaatggcaatcgacttcttacataataccttctaccaagctcaaaaggcaaaagaccggaaaactccattggtagtctttgctggtaactccttgagttcaacctatgttcacgacttaatccaattaattggtgataaagacttttccatcaatgttgtttcaaagtcaggaacaaccactgaaccatcaattgccttccgaatctttaaggaccttttaattaagaagtatggtgaaaatgaagctaataagcggatttatgctactactgataaggctaagggtgccttaaagactgaagcagatgctcatggctatgaaacctttgttattcctgatggggttggaggacgttactcagttctttctgcggtaggtcttttgccaatcgctgcttctggtgcggacattgataagttgatggaaggggctgcacaagcggaaaaggattatgttgatcctgatctaaccaagaacgaagcctaccaatacgctgcttaccggaacattctttatcgtaagggctatgaaacagaattactcgaaaactacgagcctaacatgcggatgtttgcggaatggtggaaacaattagctggggaatcagaaggaaaagatcaaaagggaatttatccttcttcagctaacttcacaaccgaccttcactcacttggtcaatacatccaagaaggtcgccgtttcttaatggaaaccgttgttaagctcgataagccaaattatgacatggaaattccaacagaaccagataatcttgatggtttaggctacttggaaggtaagacaatggattacgttaacaccaaggcttatgaagcggtggttgctgctcatactgatggtggagtaccagtgatgactgttcatatcccacaagaagacgaatatactttaggttaccttatttacttctttgaggttgcgatgggaatttcaggttacttaaacggtattaatccatttaaccaaccgggtgttgaagcttataagtctaacatgttcggattgcttgggaagccaggatatgaagagatcggcaaagaattacgagctaagatggataaaaacgattaggataaattagatataatttaagaagggaatagctgttacgacatagctattctctccttttatctggagtatttttatgaaaaaagaagaattaattgaacatcgggatcgggtaaaagatcatttagtagtgtggattgttttaacaatttgtctgcaaatattaactgtttttcatatcttagcgttcttaaaatatgtagtatggctttctgctgcctatagtattttactaatcatcttgtggtgttatttagaatttaagctcctacatttaaaataatttaataaaaggagtgggactataaacttgcttcgagtttttagtcccacccctgcaagaatgactacgacgcgaagctagcctattggggtattatggacgctgatttatcaacgttcataatccatccatctactgcgttttggcagtttacactttaaaatagtaaagaggttggattattttcccagcctctcttttctattaaataagttaaataagaccaaaacgatttcttgcagctgtattaatacagtttgctaatttctctttaacctttttatttatatctaaattatcggtatcatttttaagataggcattaattatgattgaagccattacatgtttaggaacagaaaatattttaatatccatgtatttaggggggcgggaatatcttcaaaagtgagaacaatatccttaccattaacactaattgttgttttcccgcccttcacaactgtgtagtcaagttcgttaggggtacaatttttatatgcagtcataatggttatcccttcttattattaatattattgttagtataacataatttaagttataatcgatgattgtaaattgtgaagagaagaatggtaagataattgaaaataaaattggttaagaagggaataaaattataatgaacgaatatgtaattggggttaacctaggcacaagtgcagtcaaggtttcagcgatggaccgtgatggcaagattgttgcgcaacaaagctatggttatgatctccatcagcctcatcctggctacagcgaacaagatccgcgagattggctttatgaaacaacgattgtaattgatcaattaattttaaaagaacttagataatgtaaataacggagaaaacaaccgtcttaaggtcattttctccgctattttattgttaatttatttcttgaatcaatccattaaagaagtgttttagtgacacttgcccaccattagtacgctctcctttgagaaatgaaatttcattgtggacatttttatattcatataagttattcgcatattccaaaataatgtcgttttctggataatccatacacatatgtgcgagattattaagaccagtttttatatcgcgtcgaattcgttggaaaattatctttttgccatgctcatcacattggaaaaattcttcaaagttaacctcatcaaaactaatttcccgttcaatcatcgtattaataagtttgttaattgcaggagcgccatttccagctgtaataccgagaaaacgtaagatggactgagcgttttcttttttcttatttttcccactgatcgtaactgtattattattcgttgcagcaccgcttacaaggtccaaaacttgaaggaggcggttagacatattaatattttgcgctgctagtttaatcactgacttaacttctgcaatgtttagtggtttttcaataaaaaaatcaattccatgttgatatgcacttgttttaacagaaggcagaattgcttgagcagtcataatgaagtgtggataatgatgactgtcctgaattttttgaataagttgaactccatccattgctggcattgcataatcgataaacatgatatcaattcctaggcgcattgcatcgtcataggcctgttgcgggttagaagttgttccgacgacagtattgttgaaatcattttcaataatattggataataaatgaataattttactatcattatctaaaatataaaaattcatgtattttcaccgatttcttgatgttgtttgaagtattttgaaacactatttaattttactctttgtgaagataatagacaatagagttgctgttttacaaatgtgtagctgtttccgcttacatccttgtgaataaagagattgctgcaaaaaaacgctgaatttttctgttatttatggagcctttttgaagtattatgaaactttagcctattatagtacttgtattaaaaccttaggaggaaataaaaatggcttttaatttacgtaatcgtagtttcttaactcttgcagattttaacactcgggaaatggaatacatgcttgatcttgctgaagatttaaagaaggcaaaatatgctggttatgaaggcaagaatcttgaaggtaagaacattgctttaatttttgaaaagagttctactcgtactcgttgttcttttgaagttggtgctaaggatgaaggtgctcatgtaacttaccttggcccatcaggttcgcacatcggtcacaaggaatctgttaaggatactgcacgagttcttggtggaatgtttgatggtatcgaataccgtggattctcacaacgcaatgttgaaattttagctaagtactctggtgtaccagtttggaatggtttaactgacgaagaccacccaacacaagtacttgctgacttcttaaccgctcacgaagtattgaagaagccttacaaggacatcaagtttgcctttgtaggtgacggtcaagacaatgtttcaaatgcattgatgcttggtgccgctgtaatggggatggaataccacgttgttactcctaaggaattggaaccaactaaggaaactctagataaggctaatgaaattgctgccaagactggtgctaagattgttgttactaatgacatcaaagaaggtgtcaaaggtatggacgtaatctatgctgatgtttgggtatcaatgggtgaatctgatgatatgtgggaaaagcggatcaaccttcttaagccttaccaagtaacaatggatgttatgaaggctactgaaaaccctaatgttctctttgaacactgtcttcctgcattccacaacctcgacactgaagttggtaaggaaattgaaaagaagtttggcttaaaggaaatggaagttactgacgaagtattcgaaagtgaacattcagttgtcttccgtgaagccgaaaaccggatgcacactatcaaggctgtaatggttgcaactttgggtgaacaaaactaattaggaggcatttgccatggctaaagtagtcgttgctttagggggaaatgcattaggcaaatcacctgaagaacaattaaagttagtaaagaatactgcttcctcattaattgggctcattgctgcagggaatcaagtagttattagccacggtaatggtccacaagtgggtgccattaatttagggatgaattttgctgctgaacacggtaaaactgctgcttttcctttcccagaatgtggcgcaatgagtcaaggttatattggctaccatttgcaacaaagtttagaaaatgaattacaccgtcgttggatgaataagagtgtggcaacgattgtaacgcaaattgcagttgaccctaatgatcctgcttttgaaaatccatcaaagccggttggcgacttctacactaaaaaacaagctgatgaaattgccaaagaaaagggctacacttttaaagaagatgcgggccgtggataccgtcaagttgttccctctccactaccgatgaagattatggaacttgatagcatcaaaacattgattgacgctgacaagcttgttattgccggtggtggtggtggtgtacctgtaatcatcactgataaaggacttgaaggagttccagcggttattgataaggaccgttcaagtgccttgctagctgacaagatcaatgctgataagttaattattttaactgccgttgatcatgtttatgttaactatggaaagccggatgaaaaagctcttaagacgttaaacgttgcagaagctcagaaatacatgaaggaaggacagtttgctgctggtagtatgctacctaagattgaagcatgtctttcatttgttgaaggtcatccagaacgagaagcattaattacttcattagatggtcttgatgatgctcttaccggtaaagtcgggacagttattcgtgataactaaaaagaagatggttaggaaaataaaatcctggccaccttctttttttagctactctttaattttttctgtggaatgcgaatgttaatcgcaagtactgcaacgataactaaaatcgaaccaagaatatctgctcccgtcatttgtaaatgaaaaatcaggactgaaccaattgttgctgataaaggttcaaatgcatccattaaactaaatgtagttgcatcgatatattttaatgaattattagctagctgaaagggaattaaggtcccaattactagaatgcctaacacatataaccaaactgaaggaacgttaggaatatgtggttgactagggtgaataagtactaaggttaatccggcaaataatagcccccaccccgtaataattaatgagggaactcgacctttgcgaagcatgttttgtggaattaaggtgtttgttgcaacaccaattgcagaaattaatccccatattaaaacactaagcgtcattgctaaatggttaaattggccatgagttgcgataataaaaacacctaaaaaggcgataattgcactaataatttcaattcgtcgcggtggcaggtgtcgaaacacagcttgataagcaatgataaaaaagggcccgataaattgaaggatggttgcgatcgaagcattcccatattggacagccataaaataagcatattgaaccgggactaacccaaaaacaccatatgcaaagataatccatgcagagtgaagatccttaaaaatttgaaagggatgctccccacgaatttggcttaataagactaaaataattccagctgaaaccattcgaacctgcgttaaccacattgatgtaattgaactactaacattaaaaagggccttcgcaaaaagccctgaaataccccaaaaggtacaggcagtaataatcatcgctgtacctaaaacttttttatttgacataaaaatactctttccaattagatttgctattttattttatagatttgctattttattttatagatttgctattttattttaccataccaattctgtgaagagtgagctcgaccttttaattatgactatctgttggaattgttttcagcgatgattggttgtggagttcgtgaatataaagccttcacagcctctatgtctcgtgattgaatgggataatatgatccagctggctgcatcacagaaatcttgttcgtgtgctgtagaccaattgcatgccctaattcatgctcagcagtatttacgattcgttcttgtgagtagccaaaggcaggatttaataggtagtaagaatttagctctactgttgcgtgcagataatatccagttgcggaattcatgcttgtattggtaagccccgctgccccattatttggatcattaacagcggaaacactaatatttgcattcttatcattaacgattttaaatgtgaatgacttcgtgttattccattgggcaattgcggtgtctgttgcattctttaatactggattactgatattaacatagatcgttgcagagttttgttcccagcgtgcatcagcgggtgtatcttgtgccccagtttgttggtcagcattttgtttagttggggttgcaacttctttgccggttattcggtgtagccacgattgagtaagcacctgagcattatgaatgccaatattaaattgttcttgaaaggtagaattattttgataaaaccaaataattccgccaaagagtaataaataaaataaggttaataagaaattggacttcttaatcggtcacacccccctagtatttaaattctaattaaaaaagagtaaaacgtccattatttaatatttttttattgttgacaactgtaaactttgatagtatgctgtacctataatataattacaattgtaaactaaaagaaggtggaaatattgagaattgccgttataattattgccctacttttgattgcatttattgtttggtggttcttcggaaagcatacagagtcggcgggaaaatcaactattgttaatgatgaacaaactgcaacgattgtcgttaatggtggttattctccatcaaccgttaccttgaaaaagggaattccggctcaagttaactttgatatgcatgactcgacggcttgtttatcacatgtagtatttgaacagctaggagttaataaggacttaacaaagcaaaagattacgacgattaatattccaacagataaagcccagacttttaattttgcttgtggaatggatatgtttcatggaaaggttgttgtaaagtaatgaagctcacaaacattcagcgattttggatttcatttgtattatcaattccaatgttaatacaaatgcttgcgatgccttttcactggatgatgcctgcctataattggatagcattaattactactactattattatggcaatttcagcatttccatattggaaaagtgcgatcgctgcatttaagaaacatagtgcaaatatgaataccctagttgccacaggaacagctgtcgcttatttttatagtatttttgcaatgataactgatagggcagtttattttgaaagtgctgcttttgttactgtctttgttttactgggggatgcgatggaagagaaaatgcataacaatgcttccaatgctcttggtaagttgatgggccttcaagcaaaagatgctgaagtcttaaaagatggcaaatttgtcaaagtaccactcgatcaagttcaagttggcgaccttattcgggtcaagccaggtgaaaaagtacccgtagacggaacaattctggaaggggtaacttctctggatgagtcgatggttactggtgaaagtatgccggtaatgaaaaaagttggcgatactgttgttggttcaacaattaataataatgggacgattacttttaaagccacaaaggttggagcggatacaatgcttgcacaaattgttgacctagtaaaaaaagcgcaaaccagtcatgctcctatccagaacttaacagataagatttcaaatgtgtttgtcccagcagtaatgattattgctattttgacatttatgatttggtattcctttgttggcgcaacatttgttcaagcattattatttgctgtttcagtaattgtcattgcctgtccatgcgcattaggtttagcaactccaacagcattaatggttggtactgcaagaagtgctaagatgggtgtccttattaagaatggtgaagttcttcaagaagtaagtaatattgatactgttgtgtttgataaaacagggacaattacggtcggcaaaccagttgtaactgatattgttggcgatgctaaaaaagtattaacaatagctgctagtcttgaggaatcgtctgagcacccgttggcatctgcaattcttcaaaaggcaaaaaataaagagatctcaccagtaaaggtagataaatttgaagcaattgaaggtaaaggtgtgcgtgcagattataatgggcaagtagcatttgttggtagcaatcggcttttggttgatgtaaatatttcccgggaaatggcatcacgtgcagaaaaattacagaacgaagctaaaacagttgtttatgttggtcttgatggggaaataatcggcttagttgccattcaagatgttccgaagtcgagttcaaaagatgcaattgcggagctaaaagcacgtggattaatgactgtgatgttaactggtgataataaacgggtagctcaagcaatagctgatgaagttggtatcgatagggtaattgctgaagtaatgccgaatgacaaagctcaacaaattaaggaacttcaggacaagggtaaaaaagttgcttttgttggtgatggaattaatgatgcccctgctttgtcgacagctgatgttggaattgcaatgggatctggaactgatatcgcaattgactctggtggaatcgttctcgttcaaaacgatttgcgaggagttgtccgggcacttgatacttctaagaagacctttaaccggattaaattaaatctcttctgggcgctcatttacaatgtcattggtattccaatcgctgcagggctatttgcatttgtgggctttacgcttagtccggagcttgccggcctagcaatggcctttagttctgtttctgttgttagttcttctctgctgttaaataaaactaagattgcgggagaccatgttgttcaggcttaaactaagattataaggagttaagaaatataattcttagcttctttttgttatattctgcacaaagtaaaaggattttgcggtaaaatattaataaaaatgatggaggagtatttaaaatggcagctgcatttttagttcatactcgattaagctggggaaaaacgtgcgattatttaattgctaatgatgttgagccggggttaatgcatcgttatgagacacgagaagattggcaaggggttattcttgatgcattgatcaatgttcctttagcgccgtatttgccaagtggtcagcctattccgccaattggaacggcaaaagtaataggggtagaagcagttgatccgtcacaggttaaaaaaaatgtgcaacggacacgaagtcaatttataatggcaaccatttggaaaaagcaatcggccttaaaaaactataatttcttacatcatgattatgacaaatggacgcaaaagcaaatttgggccgatattgattactggtgtaattctaaaaaacatcccattatcgatttaattacaaaatggcgttgcacccgtcaacaccaacgattacgtgctgaagagaaatgataaaaaaagagttgactattaagctacttccatgtatagtatatatcgttgtaagtttaatttattgggcattcgccaaactggtaaggcagtggactctgaatccataatttactggttcgagaccagtatgcccaacttctaacaaaagacctgctagctaatctagcaggtcttttgttgataaggaagttatttgttataattacagtcaagtgaggggacgaatatggctagtaattctgattcaatttattatgttttgacaaaactaaagcatcatccagagttaattaaaagcattagaccacgttatactaatacggttatggttctttttgatgattccttaaagatagcggatgcttcattttattttcccgttgatcgtttcatggtcaatcgtttgtcaaatgattttgtggcaaagaatggtgaccttcttgatagctatttttcgatgaccaatggaacgaagaaaaattaccatgatgtttgggcgaccacctgtcatattccagaagagaaagtatatttattagaattatcatttgaataacgcaatgtaagctgcgacaaaagatgtcacagcttatttgttataaagggagagttttgtagtgcttgtttcaacgattgttttaacggtagcggcagttttaagtagtattatttccagcttttttccgcacttttcaattaattatattagtattttcgtcggcttaattattggcttagttcccttttttaatagtcgtgttgctcctttccacacagaagtattcatgtatatagtagctccattgatttattttaaggggcaatcaacgagaataaatttaattggaaaaaggttgcgacaaatctttgaaacggctgtcctcttagtgattgtaggaacaatatttgcaggttttactgtatcgcttttagaaattccactggcactagcatttctgatgggtgccttaagtactccgaccgatgctactgcaactgaatcagtttcagaaggtttaattgttcctgaaagacaagaaaatcttttaaaaatggagttattatttaatgatgcttctgggattatcttagtaactgcaatggcactgtgggtgaaaaacggtcagttcaactatcaacaaacattttttgactttttgcgttcagctggtggcgggataattattggcattttggcagcccttgtaatgatcagttttcgtcaatttttggggcgaattaaccatgatgcttataatgcgcaaatattattatttgttagtacgccattctttatttactttatagctgaagaattagaagtatctgggattattgccgtagtttgcgctggtttaatgcagaatagcgaaagtgtccgaagtcgttttataacaccccgccaattttataatgggctagtacttttaaaattgattcgggagctcttaaataataccgtcttcgttattttggtagtattggttgtcagaatcattcgtgatgacttaattattgggaatacaaattcacaatggattgtgattggaattttactctatcttactaatctccttgttcgttatttctatggactattatcaaagatgggtaataaaggaagtataatttttgctctgggggagtccatggagcagtaacactagccttagtatatatgattattgacaatgttagctcagcacaatttgacatgattgtgttagcagaaatgcttgttattattttgagtatggtggtgccttcaatcgtatttcgctttattcttgatcatgatatgtcaagtaaggagacgggaaaacagattcagcgtttacggcaagaaatggttaaagaaggcttgagagccgtggaaaagatataccttccagaaaacattcgagaaagtgtcgtttatgattcacgggatcaaaagagtgctaattcattcgcagacttttggcaccaatgggctaaagcaagtcgctatccagagttcaatgagcaggaaaaggaactggaacaacgagcattattatgggcattccgggctgaaagacaatatcttaatatggtatctcaaaaggaaaatcgtcgcgactatctttttgagctttacaatgaaattctattagcagaatcgattttgcttgacactgaaaatgaatattaaattaatttgattttaagttgacgaaaaattgaaattaacgtatacttttatttgtacgttattgcccgctggtcaaattggttaagacgtcgccctctcaaggcggagttacgggttcgatccccgtgcgggtgaatatgattgagtctgttactcatttggtaacagacttttttatttatattacaaatttagtaaaagcgttaagaaaaggtttaattgatgctatgatggatttgtgtaaatagaaaaagaataggatggatttggtgagttaattatgcgagtaatgaatttaatgatagtattagcagttattgcgattattattttagctgctcaatatttttctcagttacggaaaaaccgcaacggtaataatttcgtaagtgggggccgtgtcttttttaactggacgttggtcgctgtcttggtaatttgtgttgggggaatagtttttggtagcattcattcacatcgccaagaagcaaagccagctcaaactgataagacagaaaatgttgaatatgctgcttccgacagtgataatttgggaaaagtctcagttcagtttgatcggaaagttactttaaatgataatggagaagcaaaagttaagtttaaggtttctccacaaactactttgacaatccggggacataagagcaaagagattgttaagacgtttaaagcaagtaagggcgaatcattagttaaccatacttatacatttgacgtagctggcacttatgatattattgcagaacgcggtgatcaaaaggtgaccaagcagctaaaggttaaggacaatgataatgcccaagaaagttcatcaagtagtagttcagtaagttctagctcttcttcagttgcttcctcagcaagtagcacagtttcctcgtcttcaagctcgactgcttccactgcgcaaagtaacagtgaaagttcaagcagcacgacagcagcttcatcgaataacggaggaacttcaagaagctacaatacttctcgtccacgatatagtggcaatggcggtggaaataggacctctggtagcagtaccccgactgctcctgcgcaagaaccaagtactcctgcctatagtcaagaaaacaatggctatgttagcgatggcccacaataataatttttattcgtaatcaaatatctaatgataaaagaataaactgctttcaaaggaacaaaagatgatttttttatatgaaaaattattcttttgttcttttttattatcactaataacgtaaaatcgttgatatatcaagaatgaaaagcaaaaaatactgagaggtatattcctaaacaatttatcagtattgaaataagaatgaagtatattatactcgatattaaataatagttatcgaattataaaagtatttaagggagggagaaaaaagatgcttgatacagatgagatcaaaaaaatgaggtacttggtgttgagcttgccccggttgaaactgttggcggacaagtgaaattaggggagaaatctgcttcaagcgttgcttcactcaatagaacgccattattggaaaaaatgcttaaagcggtgccaaattttgcggctcaacaacaaaaattgaacggccaagaaccggtaataaaaaataatccagcattaggtgaatatcaactaattgatgatttaggtggcttaatgcatgggacttacttacaggcaactaatagtgaaagtcaggataaagatcgttcgcttgttagtcgtaattcaacgagtgaaacggcatcattagttaattatcgcgcagctactgattttagtggatatggtcatttgaaaaataatacagaaactaccaaatcagttgaagttgtctatacgctgcctacatttgaagggaaacaaggaacggtacaaattgtacttgatggggcgcggattaatgaatttgacggtcttgaatataaggatgaaaagggaaatgtaattcctggatttgatattacctatagttgccaaggacacgaaggagagtattcaacgattgatactcttaagcagcgtgatgattttagctgggaaaaggtaacagcggttatggtatttggttccttattgccaaacagttcttaccgtgttgaatttccttttaagattacaaatctagaaaatattaatactcaagagcaatttaatttaaatgaatatgccttttatgatttaacagttaataagcatacaacgtcacaattaaacttccgcttaagtacgcctgttttttgcccatgatgcctattaaaatatctcattcatggcattcagccgaactgaagatggtgatgaggtatttccagaagatgttcaagcaatgatgccaactttgggtgaagtaccatatgcgatcagtaactttaacgatgaaatttcatttgagactgatggagataatgtaatgtggcaaggcggtcaatacttctttaagctggccgctattcaaggtgcgattcaagaaaagggattttcagtcaatgttgataagacagggagaaagttaatggaggcctctgcctttatggttcaacctacttatcttgattttgaaagttttgacttcattccttatgttgtcattcaccaactttttattactaaatcatttacgcttaaggcagaggcaaaagatgattggaattcatttggcgggattgaaaaagtttgtggtctctccgcaactaatgaggaacttccggttagtcctgagcaaacatttattgtggatgattctgaattagtcgatgcaacccctagtgattataatgtcattattggttatttccttaacgggagtgaggacaatgatatgttaatcatttcactggcaaaggtaaggatggttgaaaataaacagacaattaatgtttactatgttgacttggttaatatccctgataaaaccaaagatgatttacaaccaagtggcggaaagattctcgaaaatcaaacccaaacttttaccggccaaggtgatgaagattatcataatgaactctggggtgaagaaaacggctttgagatttatgaatatgaccaaggtgctaaattaaggacctatgtcggtagacaaccagctaaagattattatgtttatcttattcataaaattgaaaaaatcaatgaagatcatcaagtaacacgaacaattacttttaatatgccagatggatccaagcagatcattaagcaaactggaaaaattcagcgttttggaattactgataaaacgactaatgaaaaaacatggagtgattggagtaaagctactctccccgcagttaccgcaccccatgttcctggatatacgggtaaaaacgttgatgctgaaccaatttcattaatgtcaaaagatagcaatattaatgttatctaccatccaaagcaagttagtgtcaagattaaatatgttgatgaagctgggaatgtaattgatgagcaaatagtttctggacttgctgacgacttgatcagtcataagccaacagttgaaactgaccgtcttgctgatgaaggttacgtgattgttaataatgaattgccacaaaatgctcgcttaatagccgaagacagtgatcaagaaaaagaatataaggttattattagtaaacaagatttacagacacaacaaattaccgtcttttatgttgatgtccctgataatcgattaccaattgtcaagccttcttctgggcggattattgataatcggacccaaagattaaatgttacagaaggacaaacatatagtaatgaactatggaattttgaagatgacgggtatgaattgtttaaggctgacaaaggggcattaaaggggaagtactttgctggtagtctggaacaacaatattatgtttacctcactcaccaaactactcccctaaaaaaggaacatcacgtaacgcgaacgattcagattacaatgcctgataaaacacaacaagttgtaactcaggaagcaattgctactcgttttggcgttcatgatgaagtgcttggtagtgacatttggcaagagtggagcaaaggagtgattcctgaatatattccaacaccaatcgcggggtatgatgcatctgctattccagctgaacaggttgatgaaaatgcgagcgatcgaaatgaaaagatcagttacactccacaaccagctaaaattttggttaaatttattgaccaaactggtgcaggattaacatccgaggaacttactggggtaaccggtgaagaatttaactacgatccaactccgcaaattaagtcatttgaagatgagggatatgtgcttgatgaaaatagtttccctgctgatcatcattttacagctggggaacagacctatactattactttaaataaattagtagcagtaacccctcatggtaatagtgaggcagaatcaacaatcgaacaaattaagtcgaacgatgatgataaaactggaaataaaaagggaatctttgctgcatttaaaggctattttaaataaatgaattaataaaggagtacaggaggaataaaccgctaatggtaaattccttctgtactcctttttgagttaaaaatattaattatcataattgccggtgattgggttcatttcatggatttgatttgtagcggggtcatattgatagataccagtaaggtgagctatatttggatcgccgccttggttattgcgaacttcaatttgataattattattttgattattcttagtcatgtaataatgattgccatcttgttgaacaccacttgtcttgacaaaactcgttaggacttgttgatcgttttgtgctgaggaagtggaattggtagttgctgattggctgctagaactactagttatggatgaactaggagcttttaccgtttgattagttgatttttctgaactgttagctacctttgagtttacgcttgttgagcttgtatttgttgaagaagtggactgtacactagtaggtgcagaggtttgctcctttgccttttcgctattagtggaggaggccgcctttttacttgtttgttgacttacttttgtcgcagaagtagatgtctttgttggagctgctgcgctattggtacacccagctagtccaagggctgctaaaattactaatgaacttgttaaaactttatttgtcatcttcatcattttaatgaccccctcaatctctcttatttttataacatcattacacctatattataccgccttttgaaatgattttgtaacatttttgacttatttgtcataattgactgattttgtttaataaatttctggatatttttcctttgtctgatttacgttaaaataaaccttattgaggaagtgaattaaaatgatgaataaatacgatttaacaattactaaattacaccaaatggttaaagagggagttgttccaggagttagctatttgatttttgatcatcaacatacgattaaggaagtaacagggatggcccaaatttatcccgagactgaaatattaaaaccaggcatgctctatgatattgcttcactaacgaaagtgataggaacagttccggttattgcccagcttattcagaaaggaacattgtctttagatgatccggtaaagaagttcttaccagaatttaatgatgaccaaccaactattcgcaatcttcttacccatacttctgggattactggttatattccccatcgtaatgagttgactgcctccaaactaaagaatgcttttttgacgaaaatgtatgtggaggatagcttgaaccgccaaatcaaatatgcggatgtaaactatttgtatttaggatggattattgaacgaatttataatcaaccagttcaaaaggttattacagaacaggtccttaaaccattaaatatgccaactgcgacatttaggcctcaaccagctaactgtgtaccaacagaagtacaagaaaaacggggcttaattagaggagaaactcacgatcctaaagggtatattttgggagaaagttgtggatgtgctggcctctttgcatcgttgaaagatttagaggtctttagtcacgcacttattgaaaataatttaaaaggtcttcttacttctgaaacaactgatcttctttttacagatcaaacacgaattcctggtccacatagtcgctctcttggatggaaactgtttcacgctaaagaccaccaccttttgattagtcacactggatttacgggaacttggatggtattagatcgtcaaactgaccaaggctttattgtattgacaaatcgcgtccatcccagtgctaaaaatcaagaatatttagatgctcgtgaccaactttttgcaatttatttaaaagaaaaagaaaaaactttgtgaaatttatatgcagtcaattgaataaccgctttcacagaatatgcgctttaggggtaagaaatgtataaaaactgtcgataatttatattaataacttctttttatatgattcactaaatattgatttgacggcatttgacaacgtttacataaactaatatgatgtagttgtagtcaagtgatacttcaaaaaggagtgatattgtatgcaaagtccaattcacgttacatcagaaattggaaagcttaagacagttatgttgcatcgaccaggtaaggaaatcgaaaatgtttatcctgaaattcttcaccggatgctcgtagatgacattccatacttaccgatcgctcaagaagaacatgaccttttcgcccaaacgttacgcgataatggcgctgaggtattgtatcttgaagatttattaacagacgcactagcagatgataatatcaaagaagaattccttgaaaagatcattgctgaatccggttatgctgctggagcaatccatgacggcttaaaggaattcttacttagtttcagtactaaggacatggttaacaagattattgctggtgtacgtaaagatgagattaaaactaagtatgcttctcttacagaattagcagaagatagggattacccattctatatggatccaatgccaaatgcatactttactcgtgaccaacaggcatgtatcggggatggaattaccattaatcacatgacctttaaggcacgccaacgtgaatctctctttactgagtacatcattaagcacaataagcgttttgctgacaaaggtgttgaagtatggcgaaaccgttatcctgaaggccggattgaaggtggagatgaattagttctcagcgatcatgtattagcaattggtatttctcaacgaacatctgcaaaggctattacagaattagctgaaagtctcttcgaaaagtctgattatgatacagtaattgctatccatattcctcacaatcacgcaatgatgcaccttgatactgtgtttacaatgattaactatgatcaatttacagttcatccagcaatcttacatgatggcggacatgttgatgcatacattatgcacccaggtaataatggtgaaatttcaattactcatgaaacaaatcttaaagaaattttgaagaaggcacttgataagccggaaattgatttgattcctactggtggcggtgacccaattattgccccacgtgaacagtggaatgacggttctaacacgctagcaattgcccctggtgtagttgtaacttatgatcggaactatgtctcaaacgatttgctgcgtaagcatggtattctcgttcacgaggttcgttcaagcgaattatcacggggtcgtggtggtccacggtgcatgtcatgtccaattgttcgtgaagatctcaagaaataaataagataataaaagcagcaaatttatctgagtaatctagaaagggtataattttactgctttttcttgtatcattttagtgtaattaacatgataagaagggaacacgaatggatcgaaaggcaagaagaaaatatattgaacaagtggttaatgatcgtaaaattgagacacaagaagaattgcttaagctgttaactgaggcgggtttcgaaacaacacaagcaacaatttcaagagatattcatgcgttgaatattgttaaagcaaatgatggcgatggtcatacccattatgttcaacttcatgtgacgcccgaacataattttgagcgcttatatcaagggattcatgataatgtgcggacaattgaaactgttcaatttatgaacgtaatcaaaaccgcactaaattctagctatgcgacgattttggctggaatgtttgatgaacttgatattccggaagttgtgggcacacttgctggaaacgacaccttgattatcatcagtaaagataatgatgatgctaaaatggtctatgacttaatcattcaacatatgcattcataaactgcataggagggatatttatggatgaacaaaagaaaggtattggtagaggcgaattaatcgccttaattgtaagctcatgtatcggtaccggaatatttggtatcactagtgatgtagcggcagcggcagcgccaggacctgcattattggcctggatctttgttggaattggctttttaatgctggttctctcgctaaataatttatccgaaaagcgaccagatcttacttcagggattttctcatacgctggtgccggctttggaccattaggtgaatttatttctggatggtcttactggttatccgcatggctgggaaacattgcttttgccaccatgttgatgagctcgattggaacgttctttccaacatttaaaggtggtcaaaacttaccctcaattattattgccatcatcttctgttggctattgacaatcttagttaacaatggtgttgaaagtgcatcctttgttaacatgattgggacaatctgcaaggtcttaccattggttatctttattataatgatggttgtttgctttaaagccgggatgtttacagcagatttctggggacgggttgctaataatgcttctcgcggtaccacaactggttctgtttgggaacaaatgaaaggtaccctaatgacattaatttgggtatttatcggtgttgaaggtgcctctgttatggcaagtcgtgctaagtcacttacagccgctcgtgaagcttctcttattagttttggccttttagtagttatttatgtattgatttcgattttgccttatggtgcattaactcgggcagaattagctggaatgggtcaaccagctattggtcatgttcttcaagcaactgttggtagttggggctcgattttaatcaatgttggtttaatcatctcaacaattgtttcctggctttcttggacaatgcttccagccgaaacaacgatgttagttgccgatgataaagcaatgccaaagctttggggaaaggttaatgctaaaaaggcaccaactgcttccttgatgattacagcggtattgcaaacaatcttcttgttctcgttgcttttcactgataaagcctatgaattcgcatattccttatgtagtgcagcaattttattctcatacttatttgttggactttaccaaatgaaatacagttctgcacaccaagaatggggacaatttacaattggtttgctctcggctgcatttatgttcgcatgtatgttccttgctggatggcaagaagtattattagtttcaattagttttattcctggattctacatttactacttagcatgtaaagaaaatgatcgtaaagttacaactgctgaaaagtggacaatggcgctgattttaatcctaagtatcattgcaatttggcttgttgctaatggaactattgccattagctaggtaaataatgtataattattccacattttaagaatatttataagtgaggtgattaaggtgaaggaaaagaagttaaatctcttcctcttaatcaccttaattgtaggaacgattattggtggtgggatttttaatagtccaaccgatttgattttgaaagcaaatccaatggctgcgttaattgcatggttaattggtggcttcggaattttgatgttagtattagtcttctacaagctttctgttgtcaaaccggagatgaacggtggaatttatacttatgcaaaggaaggctttggcaactatattggttttaactccttttggggatattggatgggagcagtttttggtaacattgcttttatctcgctcttttttaagaccttaaatagtatgatcgggacgcatcaactttcgccattaatgtgttttatcgggggctcaattattctgtggggatacactgcgattacatggtttggtgtccgcgaggcaagtattctcaatgccattattacgattattaagatcttaccgcttttattagttgttattgttggtgtttttgcatttcagccgcatgtttttaatgttcctgattggacaagcattcttgctgttaatcaaacgcatgtcccatttaaagaccaaattagtggtgcgatgagtactattgtgtggtgttttgttgggattgaagcagctgtttcaatgtcacgtcgggcaaagcagccacgtgatgttggattagcaacgattattagctttgtaattgtattggtcctctatatttcaatctctattattccaatggggattctacctgctaaagaacttagtcagacttcagttccactggcagcagcccttagtcatacagcattaggaatagtgggaagccttattattaaaattggcttactgatttctctattaggagcattattgagttggtttatgattggaccagaaattgcatatgtaaccagttatgatcgggatatgccgcgagcatttaaacttgttaatcgccatggtgttcctgggtttgcattaattgtatatacaattattatgcaagtatgtttactagttttactgcttccacagcttcaaatggcctatacaattgcatatactttagctgcgacgatgaccttagttgcttacctgctctctgcgttatatgggttgaaattagcaattagcgaaaaaatgggccttggctttaagattattgctacgttagcttctctttattccgtctatatgttagttgcttcgggacttgaatatgtatttgcaagtgcgattatttttgcgctaggaataccattatttgccagggctcctaataaaatgagtaagaaagaaaagtggttagcaacaattatcgccttagcagctgtgattgcgctgatgctgattattactggaaagattaatttttaaaaaattaaaagggatgaggttagaaggaatttttactttccttcaatctcatccttttttgtattctaatcttcgctagtcatcttacttttcatgttatccattcgccagacaacataggtttcaatcaatgtgattaggcttacccataaaatcgtgaaatttgatgaagtaagaaatagtaagatgattaggatccaagatatccagttccaacgacgctcaagacgaataacttttgcaaagcgtggtgggattctagttggattttgaatggctagtgcttgtagttgggagaaaagacggacttcacaaaaactttctagcaaaaaaataatggtaaatacaaatgttatggtttggttcactgtttgtcaccttaattaaaatgtaggtttaatttttagggctttttgactgcttaagtcggcatcggggtatttatgctcaagagctgctaaaagaatctttttagcaatctcaccatttcttgtaagaatgggaccgtggaaataagagcaataagtgtttttatagattgctccttcggtatgatcttcaccgttatttccattaccagaaattactttaccaagcggacgctcaccttttcctaagaatgtgcggccgttgtgattttcaaaaccatggtactcttgattgctttcttcgtttttgatggtgatatcaccaatgaaacggtgattatcctggcttaaagtatagtgatcaaggatgccaagccccggaatcttttcgccatcagcaccgatataatagtggccgagaagttgataacctccacaaatagcaagcagcggctttccatcattaataaacttgtcaatgcctgcttttttgtttggaagatctttggagacaacaagttgttcgtaatcttgtccaccgccgaaaagagctaaatcaaaatcttgtggattaaagtcgttgtcgatactaatgactttgacattaatatcggtatccatctgtttagcgtaatattgaagggcgataatattaccgacatcactataagtatttaataaatcgccgtagaggtgggcgaggtgtaagtgatattttgccattagtccattcctcctttaatatagcccttttctgctagttgtttgcgtaattgcagaacggctgtatatgttgccagaatatagacatgttcagttggcatttccttgattttatcaattacctgggtaaggtctggttcatgccacatatcttttacgccggccattgttaatctagtggtaatatctttatagcgttctcctcccgtcatgtattgtgggatttgatgttgggtaagtttttcaaagtcgccgtcccagatccagctagtatcaattccatcagcatagttagcatttagtaagaaggcaaagctaaagggctcgtcatctgtctcaatcatatctaaaacctgattaagaccaactggatttttaactaagatcaaagtaacttgttttccatcgatattaatgacttcttggcggccaaaaactcgttcgtctgattcaaaagcatctttaatttgtgcttggctcactccgagaaaacgaccaagagagtaagcggcaagagcattatagatgttatataaaccaccgattccgatggtgtatttttgcccatcaatttcaaaagttgaatgcgtgggggtaagcttatcaattttggtaacagcatacgttaattctggtcgatggaaaccacaatttggacagaagtagttacctagcccggcataagttcgcatttgatactttagaatgtgttgacatttaggacaaaggagaccatcagtgttagctggggcgttgaaaggctctttttcttcgtggttaaagccataatagatgattgggttaggcaagtctttgctgttaaagagctgttcatccccgttagcgatgatggttgcttttggtgctaatttaaccccctttaagatcttgttataagtggtgtagatttcaccgtaacgatccatttgatcacggaaaatgttggtgaagacaaaggcaattggggtgatgtatttacatactttaactacatttgcttcatcgacttcgaggacggccagcccttttttctttggatagggagccgtaataaaggtagttacgattccttgctccatgttggaaccagtcggattagtaagaacttggtcatacttttcccgtaaaactcgtacgcttaatgcggtggttaatgtttttccatttgtccctgttacaataacaaggtcgtactttttgctaaaggcttggagaatatttggatcaagctttaaggttaattttcctggaagggaacttcctccgttcataaaagtatggaggaaccaatagcttgaccgcccggcaaattcggcaaatgaacttcgaactgtcatgaatatatgtattcctttcgtgtcaattgtaagtgatacaatagtgatgattaaaattaccgtttaattctaaactttacgataacaaaaagaaagttattaaactgaaattattataagattaaagttattcaatgtaaaaaactctttcctaatgtggaagtatttaaatgacacaaatttttggatataatgaagagtactatgcaaacaaaaaggagcaattgtagtggcacaactattctttaaatatggcgcgatgaattctggtaagtcaatcgatattttgaaggttgctcataactatgaagaacaagggaaaccggttgttttaatgacgagtggtgttgacgatcgttctggtcgaggcatcattgctagtcggattggcctagagcgtaaagtaaaaccaattatggatgataccaatatttacgattatgttaataagatggaccgtaagatatattgtgtattgatcgacgaagcacagtttttaaagaaagagcatgtcttacaattaatcaaaattgttgatgagctaaatattccggtaatggcttttggactaaagaatgactttcggaatgaattatttgaaggttcaaaatatttactgatttatgctgacaaaattgaagagatgaaaacaatttgttggttctgccctcataaagctacaatgaatttacggattcataatggcaagccagtatatgagggagaacaagtccagatagggggaaatgaatcatattacccagtatgccggaagcactattttcatccccaattaaaacaataggaggaataatcaagaatggaaatggaagaaattttcgataagcttcaagcagttgctgatcgttacgatgaactaaatgaattgatcagtgatccagaagtaattgccgactcgcaacgttttatgaagctttcaaaagaagaaggaagcttacgtgaaacagttgaaaaatataatcaatataaaaaagtcacccaaacgattagtgatgatgaagaactattgcgtgaaacaaatgatgatgacttaacagccttaaccaaggaagagttagcggaagcgcgcgaagaacaagcacaattagaaaaagagcttgaagttctactaattcctaaagaccctaatgatgataaaaacattatcatggaaatccgtggagctgccggaggggatgaagcaagcctctttgctgctgatctatataacatgtaccttcgttatgctgaaaagcaaggctggaaagtagaagttgtggatcgaaatgaaactgaagtcggtggctttaaggaaattgccttaatgattactggggataaggtttattctaagcttaagtttgaaaacggtgcgcatcgtgttcaacgggttcctgttactgaatctgctggacgtgtccatacgtcaactgcgacggttggggtaatgccagaagctgaagatgtggatgtagatatcgatcctaaagatatccgggttgatgtttaccgttcaagcggtgctggtggtcagcacgttaacaaaacttcatcagctgttcgaatgacccacttgccaacagggattgttgttgcaatgcaagatgagcgttcacaacagcagaaccgggctaaggcaatgcggattttgaagtcacgggtttatgattattaccaacaacaagaacagagcgcctatgatcaaaagcggaaagacgcgatcgggacaggtgatcggtcagaacggattcgtacttacaactacccacaaaaccgggtaacagatcaccgtattggattaacattaaataagcttgataagattatggctggtgacctcgatgaaattattgaagcattgattgttgccgaccaaacgcaaaagttggagcaattacgaaatgagtagtttcgtaccgaccaactactttatggctcagcgatgggcaaaagaacaattacaaggaacaaatattgacccaagtgcccctcagtttttacttcagcaatcacatggttgggatgcgactcacttacttttgcataatcgtgatgagatgccagctgacgaagtagactggtggaaggatgccataacaagattgcttaatcatgagcctgctcaatatattgttgggcaggccccattttatggacgaacttttaaagttaataaaaatgttttgattccagaagctgagacagcagagttaatcgattgggtgttgcaagaaatgccatctcgcccattaagaatccttgatttaggaacggggagtggagtgataggcattacccttgcacttgaacggccaaattggcatgtaagtttaagtgatatttcaaccgctgcgcttgctattgctcaggaaaatatggctaagtttaacttggagttgccgttaattaaaagcgatttatttgaaaatattgatcagcaatatgatttaattgtgactaatccgccttatattgacccagacgatactgatgaaattgatcaagcggtccttgaaaacgaaccagccctagccctatttgctagtgaacatgggttaggattctatcatcgcttatttaagcaagcagggcaatacctaactacaactggtcaaatatttggcgaaactggttatgatcaagaggagtcaattcaagaattactacatcaaaccgatgaacacgcacagatatgcccacgacatgatgtggcaggaaaaatgaggatgatacacgcatgggatttttcaaacgtaggaggaagatagtaagaatggatacgaagatttttcgacatggtgagattgcccaagcagcagctgcgattaagcgcggtgaattagtggcttttccaaccgaaactgtttatggattaggggctgatgcgaccaatgaaaaagccgttaagaatgtttatttagcaaaagggcggccaagtgataatccattgattgttcatgttaactccatcgcaatggttaaaaagtatgctgccgagattcctgataatgcccgaaagttgatggatgcattttggcctggttctttaactattatcttgaagattaagaagggcgcactttcaaaaaccgtcacaggtggtttgaaaactgttgcctttcgttaccccgactgtcaaccaacccttgacttaattgaagaagctggtgttccgatggtgggaccatctgctaatacttctgggaaaccaagcccgactactgcccaacacgtttatcatgacttgcatggtaagatctctggaattgtggataatggtccgacacgggtaggagttgaatccactgtccttgatatgtcaacagaccaccctgtaattttacgtcctggtgctgttacgaagaaggacattgaaaaagtgattggatccattgaccttaatcatcataaagtaggcaaaaatgaaactcctaaagcacccggaatgaaatacaagcactatgcacctaaggcccaagtatatattgttgatgaagatactgattgggataaagttgttgaatggatacgacaacagccatttgacgttgggatgatggctgaagaaaaggttctccaacaagaagtattgccgatgaatgctattcaattttcattaggaaaaaatgttcaagatgccagtgctcgtctatttgatggcttacggcaatttgatgaccaacctaatgttaaagcgattgtcactcaagcatttccagctcatgatttagggggcgcatacatgaatcggttaaataagtcggctggtggtatgcactttgataggaatgcggtaaaataataagggaacgtagtggaagaggtaccactccctaattaaaatctcaataaaataataaagagactgagtaggattcccagcctctttatttataaccagaggagatgttgtaaatgaactatggtaaaaaatcaccccaattatgggcagccattgaaaatgaagaacaacgccagcaagatacgattgagctcattgcctccgagaatattgtttcagatgctgttcgtgaagctcaagggtcagttctaacaaataagtatgctgaaggatatcctaataagcggtattacggtggttgtgagtttatagatcaagttgaacaattagcaattgattatgctaaaaagttattcaatgcagcatatgttaatgttcaacctcattccggatcacaagctaatatggcagtttatcaagcacttctcaagcccggagatgtgattttagggatggggatggatgctggtgggcacctaactcacggagcaacggtcaattttagcggaaaactatataagacgtatggctatggcctaaatccagatactgaagagcttgattatgatgaaattatggcgttggctaaaaaagtaaagccacaattaatcattgcgggtgcttctgcctatagtcgaattattgattggcaggcatttcggaagattgctgatgaagttggggcttacttgatggttgatatggcccatattgccggattagtagcaactggtgtccatccaagtccacttccaattgctgatgtcgttactactactactcataaaactcttcggggcccacggggaggaatgatcctctctaaatcgactaaattaggacggaaaattaattcagcagttttccctgggatccaaggcggaccactggaacatgtaattgcggggaaagctcaagcattttatgaagatttgcaaccagaatatacggaatatatccaacaagttgtaaaaaatgctcaagcaatggaaaaagtatttaatactagtaaacaaattaggatggtttcaggaaaaactgaaaatcatcttctcgttctggatcttactaagactggtttaacaggaaaagatgcgcaaaatctccttgaccgtgtctacattacaaccaataaggaggccattccgaatgacccacgaagtccatttattacaagtggtttgcggattgggactcctgctattactagccgcggatttaaggaagaggatgcgcaaaaagttgcggaattaatcagtacagctttaactaatcccaccgatgaagagtgtctacaagaggtcgcaaaaggggtacacgaactaaccacaaattatccgcttaactaaaaaattagaatataaaaagttgttaagatcctttgtcatgacttgatttttttggtagaatagtgaagaaattcaaaggagtgtatataggcatgggtaaatttgaagtgttagatcatccattgattcagcacaagctaacaatgattcgggataaaaatgttgggacaaagtttttccgggaaactgtcaaagaaatttcaactttaatggcttatgaagttgcacgcgatatgccattaaaggatgttgaaattgaaacgccaattgctaaaacgacccagaaagaattggctggtaaaaaggtggcgattattccaattcttcgggccggaatcggaatggttgatgggatgacggaccttatccccgcagctaaaattggttttatcggaatgtaccgggatgaagaaaccttaaagccacatgaatactttgttaagttacctaatgatattacagaacggcaattattcatcgttgacccaatgctggcaactggtggttcagcaatgatggcaatcgaagccttaaagaagcgcggttgctcagaaaagaacatgaaatttgcttgcttagttgcagcccctgaaggagttaaggctgtgcgcgacgcttatccagatgttgatatttatacagcaggacttgatgatcatcttaatgaagatggatatattgttcctgggttaggtgatgctggtgaccgtctttttggtactaagtagataattaagaattaaaagcatgatctgtagaaaactttttagctttcgcaaattttgcttttatttttttgtttgtgttgaaaaggctttcgcttataataggtactataccagaaaaggggaattgattaatggagacccaaattaatggaattgcagccagtgatggagtgggaattgcacctgcttacttattgacgaagcctaatcttagttttgaaaaatatcatattagtgaccccgatagtgaaaaagcgagattgcactatgcttttgagaagatcattcagaaactaaaggaaaccaaaaagaagcttgttaataaacttaatgcagaaaatttggcaatttttgatacccacattgcaatcttaaatgatcctgaaatgattaaacaagttgaaaaccggatcaccaatcaacgcttaaatgcagaatcggcttttgcagaagtaattactaagatgatcaaaacccttcaggcgatgactggaaatgaatatatgcaagagcgggcatctgattttcaaaatattcaagaccaggttttagcagagttagaagggaagaagctccctaatttacgtgaattagatcaccctgtcattgtagtcgcccattcgattggtccggccgatacttcacagatggatggccgctttgttaagggaattattactgatttgggtgggcggactagtcacgcagcgattatggctcgttctttacagattccagcaattgttgggtgtaacgacataaccaaaaaggtgcagaatggccaacgagtaattgttgacggctttgaaggcagtgcaattgttgaaccatcaacaaatgatgttaaacaataccaaaaaattactgataagtttatgaatgtccgtcagcaatggaaaaaaatgattaaccagccctcagtaaccgccgatggtcaacggtacaagatttcagctaatattggttcttcagtggatatttcgtcagcaatagaaaatggtgctgatggtgttggcctatttcgaaccgaatttctttatatgaaaagtgaccaccttccaaccgaagaagagcagtttaatgcttatcgccgagctgttgaacagttaaatgggaaacggttagtggttcggaccttagatatcggtggagataaaccacttcaatttatgcccttacccaaagaaatgaatccattccttgggtaccgggctattcggattactcttgatcgaccagaaatgtttaggactcagctgcgggccttactccgagcatccgagtttgggaagattaatattatgtttccaatgattaccacgcttgaagaattacgagcagctaagaaaatctattatgaggagcagcagaaattagctgttgatcatccaggaattggccgcgatatccatcttgggataatgattgaagttccattagccgcgttaaatgctgatcgcttagctgcagaagttgatttctttagcattggaactaatgacttaatccaatattgttttgcggctgaccgtggtaatgattcagtttcgtacctttaccagccgctaaatccaacttttttaaaattaattaagcacattatcgatgctgggcatgctcataatacaacggtagcgatgtgtggagagatggcaggagatcattatgcgttgccactattaatcgggatgggattggatgtctattcgatgagtgctagttctattttacggacacgttcaatgatgaagcaattagacagcaaaaaatgtcagaaactctaccaacaggctgttacaacttgtgattcaatgaccggtgtgaaaaagttagttcaagattggttggtagcaaactaaaaaggatttaggaaaagtaaagatttttcttaaatcctttttttatctcttgttaagagtaaaatggcaatagttttgctgtactagggggatgtaaagttgtgattaagcaatactggacaaagcaaagaatctggttgttaatttttttaatggttgttggaattggtgctctcttatttaccagccataatgaacagttttatcaacaaccaattgctaaagtaatcagcaaaaaaacgatgagtaaacaaagagtaaaagaccagtttgataatgttgaccatcaatataatcaacaactccaagtaaaactaatgaatggcaaatatcgcgggcaaaaattaacagtccaaaatacatatagcgattcgcaaccgatggatcaacgttatcgggtaggaaatgaagtatttttaacccagcttcgcaaacgaggcggaaaactgaccgccaatgttaacggttataagcgagacacagtaattgtctttttactttggcttgttgtcttgatgctgcttctccttatggggcgttcagggatgtttgcattcttaagcgtagtaattaatgctcttttgtttataattgcaattgagatcgacttaaagcaaaatggtcagcatatcatgctgctttttagcgttcttgccataatttttacgtttattagcttattattagttcttggttttagtaaaaggatgctggcgacttttgcggcaacagttattggaacatttgttgccttgggagtaagtatgcttgtatttatgtggacgcatgaacgggggatttactatgaatcaatggaatatgttacgcaagttcctcgaccgcttttcttagctgaaacattgttggggtctttaggagcggtaatggatgaatcaagcgatattattgccacactttttgagttaaagcagttaaatccagctgttacccgcaaacagttatttatctctggccgcaatgttggtaaatcaattatgggaccgttaataaatgttttgtttttaatttttatggtggatacctttactggtagtcttttgtatatcaaaaacggtaactcgtggggatatacctatgcaatgaatatgagcttagggactattcagagcctgatcagtgggattggaattgtcctttcagttccccttgtcagtctatttggggcattattattaggtaagaaggtgcaaaaatgacgacaattacgggccttggcttagtattgctaattttgatggtccttgtgggagggaaacagggctggacagcttttttaagcttgcttcttaattttggctttttatattttgcaattattttagtcgcgtttcatgttcccccgttatttgtaacggtaactattgggattacaattttggcaataactattttcatgggggaagatgatttgcggacaaccgtgacggcattttatgcttcactcatcgtgctatgcttaattttagtgctgatctttattgtcgagcactgggcaatggtgcagggctttggaacagaagatagtgatgagttagaagggatgtcaattttaattggaattagttatttcaaagtttctgttactactactattttgagttcactcggagcaattgcagaagcggcgatggcgatctcctctggccttaccgaaatccttgagaatcatcctgaaagaactaatcgtcaattaattcatagtgggatggcaattgggcaacagattattggaacaacatttaatacgcttttctttggcttctttggaggattcttagcactatttatttggttcttaggtctccattattcctttggtacaattatgaataacaaaatttttgtggcagaaatgattgaaattctgatctctttcatcggggtgctgatcactgttcctatgaccgcttgggtgatgacaaagcgtcgtaaagttagtgtaagattttcataggttggatgaataattcatctggtcgtggaaatcttttttgtagaccaatttacttatttacaaaaaaagaaaagaccagtagcctttagtgtgtcgaatactaagcaaaggcaggtctttcctcatggatattttaacagaaatcgagcagaatttggtgaaatcaggcagtttatttgaagctgaacagattattttaaaaggggtattggagttaggacaagtaatcatgcaaaactttttggaaagcttagatcgaagcttaaagtcccaagctccagcgaactatcaagtaattaataaacagccacggacgcttaattttatctttggcccggtgacttttcaacgacggtattatcaggctgggacaaagaaacgtgaattttacttagaccaacaattaaaaattaaaccacgtcgtcgtttatcgccacaatacttaatgatgatggctaagattgcccaaacaactacaatgcgcaatactgccgacattttgaaccttgtatttgacagcggaattactgccgattcggtaatgcacgccgtgcatgagttaggaaatcaggtagctaaacaaactcaagcaaaagaacaccaagctactcctcgccatatgcctaaaaatttaactattgagggtgatgcctttatgattaaaggtaaaaaagaagcaggtcagctgactcttgtgcaccattatcgggtttatgagcgagtagctaatcaaatcattaatcggcatgactttctcagtgttgggcaccaaggacggcttgaagcacgactaagtgattatttagaccgccattataagcttgccggtcaaacgatctttttggccagtgacgctggcccaggttacgaaccagctaagctattaagtctagttcctcaaggtgcacatggtgaatactttctcgaccgctatcattgtttacagaaaattgaacatactttaggccggcacaacgagttagccatgcgagcaattaaagccgttcgtcatcatgatcaagcagagctaacaataattttagatacttatgaatcacaaaacctaacggaaaaacaagcagacgacctaatgcgtttaagaaagtatctacagcgaaattggcggtatatcctctcaccacaaatgcgtggatttaaggatattcatttaattggttcagtcgaaagttctcaccgggcttttacttaccggatgaagaaacagggcaagtcatggactaagcagggggctaaagccatgattggtttaattgaagcccgaatgaatggtgaactgcaagctagtttaaatacaatcctagaacaattaacagttcttcctcgagtggctcaaaccagcctattacaggaaatgcatattcgaactggagagtttctaagaaaggcaccgacaaagccgtcaattggagcagtacaaggaataattccgattaacacggccacaagtagaccaatgggacaactttttaaggcactaacccactaaaactgtatatttaaaggctacctatgaaaacttgacagataccgtcgtaaatctgttgttgacaattaccctaaaacaaagtaacatacgaataacttataaatagacctttaatcggagtcctgtgagacttcaaaggtgcggataaattttcaatgctctttccatagatttggattgagtagggaagagacgactttggagcaggaattccaaggccgttttttctttaggaggatttatatggcgcaccgtgataatgttgttttagatgtagatgaacgaccagctccctggcagtggtttggcttatctttgcaacatatgttttctatgtttggctccactgtcttggtcccaattttggtaggattaaatccaggaattgctttatttagttcgggagtaggaaccctgatgtacttactcattactaagcataagattccggcttatatgggatctagtttctcatttgtggtcccgatgatggccttaatgaaaactactggttatccgggtattgcacaggggaccattgcagttgggtgcgtatatttaatcgtatcagtaattgtaacgttggttggctcgcaatggattgaccgcattttgccaccaattgttgtcggtccgattgttgttgtaatcggattatcattagcaggaactgccgctaaagatgctaccatcaattcggctactggccattatgatttgcgcttttttgcggtcgcaatgcttacgatggcaataacagttatcttcaatatgtattttaaaggattcctcggtttaattccgattttgatggggattgtcgctggttatattattgcggtcttatttggcattgtggatttttctccagttgcgcatgcacattggtttagtttgccagactttcagattccatttgttgattatcatccccaattatactggggtgcgattttgagtatggccccaatcgcttttgttaccatgacagaacacttaggtcatattatggttctaaacgagttgactgagcgaaattacttcaaggaaccaggattgaaccatacgcttgcgggagatgggacggcttcgattattgctggtttcgttggcggccctcccgtaactagttatggtgaaaatattggggtaatggcaattacgcgtgtccattcagtttacgttattgctggagcagctgtatttgccatcttctttagctttattggtaaattaagtgccttgattgaatctattccttcaccagttattggtgggatttcattcctactatttggtgtgattgcttctagcggattgcgcgtaatgattgaaaacaaaattgattttaatgaaaaaagaaatttgatgatttcatcggttattttagtaattgggattggaaatgcctatcttcaattaggaaaatatcaattctctggattagctgttgcagctgtcctcgggataataatgaatttaatccttccacaaaaagccaaaagtgaaatgtagtttgaatttttaagcagagtaagaaaaggcatccgacctcttactctgcttttttcgtatgataacaaaacaaaaaaattaagaggtcgtggaaaaaaacagattataagaaaaagtttatcaagtctaagaaaacgctttctttacactcttgtcaattgattagtaggtatatataaacctaatgtttttttgaattttaacgaaattaatgatatattaacattcgtaacttggggtagttcgttttatttgcaacgttcatccaatttacaagccaaattattgttataaggaaagaggtggaatatgaatgggcggtgatgctttaacttttaagcttttcggacttacgttcaatactacgaacattgtttctggactgattatctacgcaatcgtgttcttcactctttacgggatgtcacgaaagatccaaatgaagcctactggtgcacaaaatgtatttgagtggctagttgacttcactaatggaattgtgcgaagccagatgccagcatccgaacaaggtcactatagtttctttgcctttgttttgtttgttttcatcttctttgcaaaccaattcggtttaattttccaattccattggaacggagctgaggtgcttagaagtccaacggcagatccagttgttacgttaacactttctttaatggtaatggtattagcattcgctgctggagtagcacataatggccttggtggatacctgaaagggtacactaaaccatttactttaatgcttcctgttaacattatcgaagactttgctaacttcttaactcttggtctccgtatttttggtaacatttttgccggtgaacttttaatgagtttgattgctaatatggcattctcacatggaatcctaactattattccagggttgttcttggaactagcatggcaaggattctccgtatttatcggttcgattcaggcatatgtctttgtaacattaacgacggtttatatttctcggaagatttccgaataataatccctaaggaggaattttaaaatggcattaggagcaattgctgcaggactcgcggctatgggtgccgctatcggtggtggtatcggtgacggtatcttaatcggacacacagttgacagtatcgcacgtcaaccagaattacaaagtagattacaagcaacgatgtttattggtgttggtttgattgaagccatgcctattattgccatcgttattggcttccttgttatgaacaagtaattattttaagttttttattttaagataaggaggtgtcaatagatgtttgtaaacagtgtgttagctgaatcaaacagtttatacattggtgacttggtattctacatcgttacttttatcatcttaatgctattagttaagcattttgcttggaaaccggtaacagatatgatgaagaaacgtgcagataagattgctaatgacattgataatgctgctcgttcacgtgaaagtgctgaaaagatggctgcaaagcgacaagctgagttacaaagctcacggcaagaagctgctgagattgtaagtaatgctaaaaagtctggggaaactcagcgagcacagattgttgaaacagcgcaaaaagatgcccaagctctcaagcaacaagcacaaaaagatgctgagcaagcacgtcgcgatgcattaaacagtgctaaggatgacgttgcaaacttatctattgagattgcttccaaactcatccaaaaagaattaaaggcagacgatcaaaaagaattgatcgattcctatatcgaagggttggtagaacatgagtcttgataagaagacagttgctgatcgctatgcgaaagcactgtttgaattggtcgatgctgataacgaactcgatcaaacttatcaagaattgattgctttacgccaagtctttgaggacaacgagggattggacgccgcacttgcgggagttcaactgtcacttgatgaaaagaaatcattgattaaagatttacagcaaggtgcttcaaagtacgttgctaacttaattcaaatggttttcgattacggccgtattgactgcatggtcgcaattattgatgagtttgaacggcggtatgaccgtaaaatgaagcggatgcatgctgacgttaccacagcgatccaactcgataaacaacaagaggatcaactaaaggctaatcttgcaaaacgttttggtgctaatgaagttaccttaacagaacatgttgatccagaaattttaggtggggttattgtccatgttgataataagacattagatggtagtctcagctcaaagattaagcaaattcgtcgtttactagttagataaatatatcttttttcaaagaggtgagacctttatgagcattaaaactgaggaaatcagttcactcatcaaaaaacaactcgccaactaccaagacaaagtatctgtcgaagaaaccggtactgttacctatgttggtgatggagttgctcgtgccgatggcttagataatgctatggctggtgagttgctcgaatttagtaacggggtctacggaatggctcaaaacctcgaaagtaatgatgtaggtattgttattttaggggattacacaggcattcgtgaaggagacaccgttaagcggacgggtcgaatcatggaagtacccgttggcgatgcattattaggacgggttgttgactcattaggtcgtccaattgacggtcttggtgagattaagacagataaaactcgtccaattgaacgtaaagctccaggtgttatggagcgtaagagtgttagtgtaccacttcaaactggtattaaggttattgatgccttagttccaattggacgtggtcagcgtgaattgattattggtgatcgtaagacaggtaaaactgccattgcgttagacactattattaaccagaagaaccaagacgtaatttgtatttacgttgctattggtcaaaaggaatcaactgttcgggctagtgttgaaacccttcgtaagtatggagcattagattacacaattgttgtttcagctagtgcttcaaatcctgctccaatgttatatattgcgccatatgcaggggctgcgatgggtgaagaatttatgttcaacggtaaagatgttcttattgtttatgatgatttatcaaaacaagcggatgcataccgtgaactttcattaattcttcgtcgtcctcctggtcgtgaagcttaccctggtgatattttctatactcactcacggttgctagaacgtgctgctcgtttgtctgatgatcttggtggtggttcaatgaccgccttaccaatcattcagacccaagctggtgatgtttctgcatatattcctactaacgttatttctattactgatggtcagatcttcttagattcagatgaattctatgcaggtcaacgtccagctatcgatgctggtacttcagtttctcgtgttggtggtgacgctcagatcaaagcaatgaagaaagttgctggtactttgcgtttggatattgcttcatacaacgaattagcatcctttgctcaattcggttccgaccttgatgcagctacgcaagctaaattggctcgtggtcaacggactatggaagtcttaaagcagggattacatgatccgctaccagtagaagaacaagttgtaacattatttgctctttcacgtggttttatcgataaagtcgaaattgaagatgttcaacgttacgaaagtgaattggctgcttacatgcatgctaaccaccaagacctctacgacaccatcaagaagactggtaagctaccagaaggcgatgacttgcaaaatgctgttgctaagttctctgaaacatttcaaggaactaaaaagcaagccgctgaagaaaaatagttaatgatgattagtcgaaaggacggtgagatttagtgccagcttcactcgctgcagttaaacataagattgattccactaagagtacgcgtcagattacttcggcgatgcaaatggtttcaaccgcaaaactgaatcaaattcaacaccacactcagacctacgaagtatatgctgagaaggttaagcaaatgttgtctgatctggttaaatctcacagcgcaacatctgcagcttcgcaagatgatgtttacgctgcactgtttaaaaagcgcgcagttaaaaagactggggtgcttgtgattacgtctgaccgaggtttggttggtagttacaacagtaacattatcaagcaaacgttagatatgatggctaagcacaatcttgataaagacaacacggtatttctgacggtcggtaaaacagggacagaattctttaagaagaggggaatgaatgtcgtttacgaatattcaggcgttagcgatgttcctacctatcgtgaagttcacagtattgtgaagaccgctgttcaaatgtacagtgatcaagtatttgatgaaatgtatatggtttacagtcattatgttaaccggattacatcaaatgttattgttcacgatgtactcccaattactgaaaagtcattactcaatgacgaaaatgaagcacaagaaaatacagaattaaataattctgatgtaagtactgcgcacgtttctgccgagtatgaatttgaaccgtcagatacagaaatcatttctgcattggttgcccaatatgcagaaagtttgatttatggagcgattcttgatgccaagacatcagaacactcttcaagtgcgaatgcaatgcgttcagctacagataatgctgatgacattatctctactctcgaattgcaatataaccgagcacggcaagcagcaattaccactgaaattacagaaattactggtggtatgactgctcaagaataattttttctaacgtaggaggaaacaacatgagttctggtaaagttttacaagttatcggaccagttgttgatgttgaatttcccttagacgaaaaacttcctgaaattaatgacgctttgaagattaaggaaagcgatggtaagactttaacaactgaagttgccttggaattaggtgatggtgttgttcgaacaattgccatggacggtactgatggtcttcaacgtggtatggaagttgaaaacactggcgcatcaattagtgtaccagttggtgatgatactctgggacgagtatttaacgtcttaggggaacctgttgacaacggaccgaaatttggtcctgatgcaaagcggatgcctattcaccgcgatgcaccaaagtatgatgacttaaacaatgctaccgaaattttggaaactgggatcaaggttattgatttactagctccatatgttcgtggtggtaagattggtctattcggtggtgccggtgttggtaaaaccgttttgattcaggaattgattcataacattgctcaaggtcataatggtatttctgtcttcacaggggttggtgaacgtacccgtgaaggtaatgacatgtactatgaaatgaaggcctctggagttcttgaaaagacggccatggtttatggtcagatgaacgaaccacctggtgcccgtatgcgggttgccttaactggtttaacaattgcggaatacttccgtgatgtaaagggacaagatgttttgctctttatcgataacatcttccggtttacacaagctggttcagaagtttctgccctcttgggtcggattccttctgccgttggttaccagccaacattagctactgaaatgggtcagttacaggaacggattacttcaactaagaagggatctattacgtctattcaagccgtttatgttccagctgatgactataccgaccctgcaccagctacgacatttgcccacttggatgcaactactaacttggaacgtcgattaacccaaatcggtatttatccagccgttgacccattagcttcaacttctactgctcttactccagaaattgttggtaaagaacactatgaagttgctacacaggttcaacacgttcttcaacgataccatgaacttcaagatatcatctctattttaggtatggatgaattatctgacgaagaaaagacaatcgttgctcgtgcacggcggattcaaaacttcctttcccaaagctttagtgttgcttcccaatttacaggtttacctggtaaatatgttccattaaaggaaacaattaaaggctttaaggaaattcttgctggtaagtatgatgatcttccagaagaagctttccggttagttggaccaattgaagacgttgttgaaaaggcaaagaaaatgaaggctgagactgacgaagatagctcagaagactaggagggataattatggctgaaaatacttttaaggtcactattattactccagatggcaccgtctatgataatgataaggttactatactcgttatgaacactgctggtggacaaatgggaatcatggctaaccacgtaccattaattgctgcacttgaaatcagtacagttcgaattaaacattctgaaggcactgatgaagttgcagcggttaacggtgggatcattcaatttgatggtcaaaatgctacaatcgcagctgatagtgctgaaatgcctgaagcaattgacgttgagcgggcacagagagctaaaaagcgttctgagtctgcaatcgaagaagcaaagaagaagcataaccagagcgatttatcacgtgcagaagttcacctcaagcgtgcaattaaccgtttgaatgctgcttctaagcaacgcaatatctaaggtataatatcaaaaagaggttggagaaaataatccaacctctttattattttaaagtgtaaactgctaaaacgcagtagctgcctaactatctttacggggtgggactaaaaactcgcaagcaatttagtctcacttccttttcgtttaaaagatcattaagcttttttacgaattaataatttaatcatgtgatatgatatgattgaatttagtttaaaagagggtgatcgattgcaaattacaggattacgagcgctaatagaaataatagtgcaactggcatttgtctggttagcgttttttgctattcaagggatacattttgagcatttttttaaccgaccaccacgtacattgcctctacttattgttctgatggctactggactaggatatttatgtgcgacatttttcttaaatatcctaagtgcaattggtaatttgacatatttaattcgatagtatttactggaggatcttatggaaaaaattgttgttaagggcggtcagaggttaaccggtcgagttaaagttgaaggagcaaaaaatgcagtcttaccaattcaagcggcatctattttggcttctagtggaaacattaaattatcaaatgttcccattttatcggatgtaacgacaatgaatcagttattacggttcttaaatataaaagtagattttgataaaaataagcatgttttaacaattgatgcagctgaccctgtattatctgaagcaccattagaatatgttagccggatgcgggcatcgatggtagtcttaggccccttgctagctcggacaggtcatgcgcaaattgcgcttcctggtggatgtgcgattggttcgcggccaattgatttacatcttaagggattacgtcaattaggagcggttattgagcaacacgatggatacttagaagcacgggctgaacacttaattggtgatcatatttatctagattttcctagtgtcggtgcaacgcaaaatctgatgatggcagcaacccttgcgcagggaattacaacaattgaaaatgccgccagtgagcctgaaattgttgatttagcaaatatgttgaataaaatgggtgcacgtgttcatggtgctggaacagacattatccggattcaaggggttaatttccttcatggttgtgaacatacagtaatgccagatagaattgaggcaggaacatttatgattgcgacagccattactaatggtgatgtagtggttgaaggagcaatcgctgagcataacacctcactaattgctaaattggaggaaatgggggtgacagtcatcgttcaagaagacgggatccgtgttcttgggacttctgttctaattcccacgaatattaagactcttccatacccaggatttcctactgatcttcaaccacaaatgtccgttctccagcttttggcaaatgggaccagtaccctagatgagacgatttttgagaagcgttttatgcatttagaagaattacgacgaatgaacgccgattttcaaattaatggtccagttgcggttttaaatggtcccacgcgttttagtggcgctgaagtagctgcctctgatttacgagcgggggctgctttagtattggccgggttagttgctgatggaattacccaggttcgtaacctaaaatatattgatcggggatattaccatcttcaccaaaagttacaacaattaggggccaagattgatcgaattgatgtcgaggataaaattaaattggcggtaaagccttctaagaataaaacaaatcaagattaaagattcgtaagcgacgtctatctatatccctattttgtggtataattacgaacggtattaacgagtttagtgttaaaacttaactagctaaaaggagaagaaattaatggcaaaggatattggaattgatttgggaactgccaatgttttgatttatgttcaaggcaagggtattgttctaaatgaaccgtcagttgtggcggttgatacaaaaaccaataaagtattggctgttggttcagaagcataccgaatggttggacgtactcctagtaacattcgggctattcgtccattaaaggatggagttatttctgattttgatgttactcaagaaatgctttcctactttattggtaaactaagcgttaaagggtttatgtcaaagccaaacatcatgatctgcgcaccaacgaatattactgagattgaacgaaaggcaattattcaagccgctgaacaatctggtggtggtaaagtttaccttgaatacgagcctaaagtagcagcaattggtgctggattagacatttttaaacctcgtggaaacatggtcattgatatgggtggtggtaccagtgatatcgccattctttcattaggcgatattgtctcaagccagtcaattcggatggccggtgataagatgaatagtgatattgcttcttatattaagaataagcacggcctagtaattggtgaacatactgctgaaaagatcaaaatggaactcgggactgcattacgggttgatgatcctaaaacaatggatgttcgtggtcgtgatgtagctactggaatgccaaagcaaatcacggttaatgaaaatgaaattgaagaagcattgcacgatacgcttgaacaaattgtttcagccgctgtaaatgtattagaaacaattccaccagagttagctagtgatattattgaccggggaataatgttaaccggtggtacttctttgttaaagggtgtcgatcaattattcagtgctcgtctaaaggtaccggttgttgtttcacaagacccattagacaatgttgctaagggtgctggtgaaatgttagaacggatgcaaaagactgaacgaaagaagtaagttgaaatggtaaggattttatgtgaccttatacgctggtatcaacaaggcatttccgcccaacgaccatttcgcgtatgtcgctttaccccctcatgttcacagtacatgttagaagctttacaacgctttggtttaaaggggatgttgctcggaagttggcggctccttcgttgtcagccgttttctcgtggtggctatgatccggtacctaatcattttacttttcgtcgtcaggggtaataatagttattaagggtgaaaaagtgtcaaagaaagataaaaaagtagaagtcagcgttaaagatattgaacgtcgtaatcaaccggttcaacaaatttttattggagaccgattgattggtgaagttgtaaccgataatgaacgtttcaaagcaatgctgataagtgaccagagcgaattttatgttcgttctcaagaagagggattagaaatagtccttcaacaatatcatcttcaccagcattagtttggtgaaccatcctctttgattaatattttgtaaaggagtttggtaatgcaacgttcgcaaaatgatgtagaaagtcggattgactggggaattatattttgtgttcttttgttagccttgattggtcttgcttcaatctatgtagcggcagttcatgatcggcagcaaactagtgtagcacgacaggttattacccagttggtttggtatgcggttggaacaatccttattattgtcattatgcaatttgatgctgaacaattatggaaattagcaccaattgtatactggctaagtgtatttttaatgttcgcaatcctagtattttatagtcgagcctattatgctagtaccggggctaagagttggtttgcaattggaccatttacgtttcagccttcggaaataatgaagcctgcctatattttaatgatggggcgtgttattacgactcataataaccgatatagtgtgcatactgttgattcagattggcgattaattgggacgatgttcttatggctattaccaattttaatttcgctgaagtttcaaaatgactttgggactgggttagtattcttcgctattttctgtggaatggtcttagtttctggagttacttggcgaattttggcgccagcagctacgatattagttgttgttgggggctcagccttagcgatggtaactagttcggttgggcgacaaatacttgaacatgttgggtttcaagcataccagtttgatcgggttgatacctggcttcatccagaacaggatacaactaaccaagggtatcagttatggcagagtattaaagcggttggttcgggtggtattactggaactggttttaataactcaaaggtttatgttccggttcgtgaatcagatatgattttttccgttatcggtgagaattttgggttcattggtggggttttattaatccttatctacttgttactgatctacttaatgattcgagtaacattcgataccaagaacgaattctatgcttatatctcaactggagttatcatgatgattttattccacgtttttgaaaatattggaatgaacatcggtctattaccattaacaggtattccgcttccatttattagtgctgggggatcctcattaattggtaacttgattgggattggaatggtaatgtcgatgcgttaccatcatcattcttatatgtttagcagtaatcgtgaatttagatagtgaggttataaaatggcaaaagattatttttgggtaaaagagcaagcagatggtactaagcgtgtcggcttaaacgatgaaggccgtgatgagttaggagaagtaagtttcatcgatgtaccagcagtagggacaactttgaaacaagctgacaaatttattgcagttgaagcagaaaaagcagttaccgatgtggatagtcctattgatggtaagattaccaaaataaatgaagctattattgatgatccggctggattaaattcaagcgatatggaaaaaaactggattgttgaagttaaataaaaaataggagactaggattaggggaaccttgattttagtctcctatttagtattggcggatctttccagttcatgttatacttaaggttctaggaaaacggctaagataaaaatatttaaggtggtatttattatgaccaaaaaattacacatcgctttattatttggtggtaactcctctgaacatgatgtgtcaaagcgatcagcacataatatctatgatgctcttgataaggaaaaatatgatgtaagtctttttatgtttacaaaggatggaattctattaggcaatgaggattctcaaaagatctttgatggtgaacctgaagaccaagtggtagcagaagcatatcaaaagatggatatgagtagtccattagcaccaattatggccttaaacgaacaaaaggaaattgatttcttcttccctgttatccatggtaatttaggtgaagatggtacaattcaaggcctctttaagctccttaataagccatacgttggttcaaatattgcagctagtgcgatgtcttttgacaaggatcttactaagaagattattagtcaagctggtattcgcaacaccccttatgtagtagttacgccagaaaaccgggctgattattcatggagccggattgaagaaaaattaggtaatctcacttttgtaaagccagctaagcaaggttcctccgttggaattcatcgagttactaacgctgaagaatatgaaaaagcgttagatgatgcttttaagtatgattacaagatcttagtagaacaggggatcgctaatcctcaagaaattgagatttcaatcttaggaaatgaacatccaattgcctctaagttaggagctgttcgtgtacctaaggacgatccattctatgattacgaaaacaagtttgtggatgccagcggggttgtttttgaacttcctgttaaattaccacaatacttagttgatgaaattacagatatggctttgaaagcatacaaggcattaggaatgaagggaatggctcggattgactttttagttgacagcaataatgtcccttatcttggtgaaccaaatacattaccaggatttactaacattagtctgtaccctcaaatgtgggaagtttctggtatttcatattctgacttgattgatcggttaattcaattaggattacaagaatttgaacgaaacagcaagattaaatacgacttccgtaagcttggtactgaacgtgttggtcaaaagaaatataacgaagactaaagaataattatttaatggttaggatgttgtgaagacaatgtgctaactatttttattattaaaattatagcaggaagtaaatattatcgtaatggtatgaaatccgtggtttagtattgcagtaagcaaaatttataatataatgaagatacgtagtttttgtaagcgttagagtagcttacagtcacactacttatagtactttataaccatcgcagggggtgactttgaaggtggttataagcatttattttttataaaatttattgtattttaagcataaaaatagtattgatttatttttggtctataataaaagacctaggtaaagccaaagtaatttttgttgctgatggtggtataataccattggcaatggtacagttcatagagtacatattttatattcaacaattatgattaaggaaggtaaacaatgagactccgaggagacgtattaaaacaaattcgtcgcaagcgtggattgtcccaaacggctttagctgaagggatttgtactcaagcgacaatcagcctaatggaaaaacaaaatcgcttacccaaaatggatattttaacggcaatatgtgaacgcttaaatatttcttctgatcgaattgtcgaaaatgaagttagtggaattaatgaaacattcaaccaaatcgttgataatttgatttcacgcaattttgaagatgcttcagcgcttttgaagaaggttcatgtaaaaaatctagaaagtgattttgataaacaacgttactactatctagtaggaatggttcaagttgaaagtaatcaaattgatgaagccatttttaattttgaacttgttttaactcaatttgctactactagtgctaatatttatttagctatgacaactgcaggaatggcgcttgcttacttaaaacgtggtgataaagaacgggcagcacggttaactaaccggtctgtaaaactgattgataataaaaaattgattgggagcctttatcaatgggcatcaattgattgtcaaattgcagaattatatctgcaacttgaagaccctgataacgctattgaagttgctaataagggaattgaactttgtcgggaacatgattcattattcttattagatgaactatatctttgtataggtcgtagctacatcctaaagaacgacaaggaagaagctaaaaaggctttaaagattgctgaaagtcttagcattgctcgtaatggatcagtagcagaagatacaattctattagagttaaagaatttagaaatttaattaatatacgtaactgaaaaacgaagctgagagatggttaagatgtctcagcttcgttttttagtataaatttaaatatttatccgtacaaataattaataaaaacttaattgattattaaagactaatttcagtttatgtgcattaaacgagaattagtcttttttagtagtaaaaaaataaaaatatttttcacatgcataactgcttttaaatacaagatagacatgaaattgttaaatgtataaaatgctttttcacaattggttatgattaattttaaataattcacttgatttatacgtacaaatattttatagtaataattgttcaatgaaagcgcgttcatgttcatgaaaaactattactttttaatttttaaggaggatgaatgtaatggctaaagccgagaagaaaatatcaagtgcatttatctacttcttcggatcatttgggggcatcctatttggttacgatatcggtgttatgactggtgccttacctttcttacaagctgattggcaccttgaaaatgcagcttctctagttggttggattacttcagcagttatgtttggggctatcttcgggggcgcattagccggacaactttctgataagtttggtcggcggaaaatgattttaatgtctgcgattgtattcatggtattctccgttttatctggtgtttcaccagacatgggcgaagcaagtgcctattatctaattattgttcggatgcttttaggtttagcggtaggggctgcctcagccttagtaccagcttatatgtctgaaatggcaccagctaaagcacggggacgtttatctggacttaaccaaacgatgattgtttccggaatgttattatcatatgttgttgacttcctattgaaagaccttcctggtgaatgggcatggcgtcttatgttaggattggcagctgttcctgctttaatcttattccttggtgttcttcgtttaccagaatctccacggttcttattacgtaaaggtgatgaagcgcaagccaggaaagttctttcttacattcgtaaaaatccagctgagattgaccaagaattagcaagtattaaagaaaccgctaaagaagagcgacaagcaaatcaaaagacaagttggtcaaccttattcagtggcaagtatcgttacctagttattgctggggttggggttgcagccttccaacaattccaaggtgcaaacgcgatcttctactacattccattaattgttcaaaaagcaactggccaagctgcatcttcaaacttaatgtggccaattgttcaaggggttatcttagttgttggttccctggtttacatgtggattgctgataaatttaaccggcggacattgttgatggttggtggtgccgtcatgggactttccttcattcttccagccgttattaattggatgataccaaatatgaatccgatgacgattgttgtgttcttatgtatctatgttgctttctactccttcacatgggctccgttaacatgggtgcttgttggtgaaatcttcccactagctatccggggtcgtgcctctggtttagcttcatcatttaactggattggatcatggttagttggtcttatcttcccaattatgacggcaagtatgccacaagaagctgttttcgcgatcttcggaattatctgtatcttaggagttatctttgttaagacttgtgttccagaaactcgtgggcacactcttgaagaaattgaagagcaaggaacaaaccatggtcgagtaaaggccagcaatcctgaaaactaggaggaatactctatgaatttacgtgaaacagcgacacaagtaaaaaatggtcaggcttcactaggaattgagttaggctctacccgaattaaagcagtcttgattaatccagattttgaaacaatctcttctgggagctatacctgggaaaaccaattgaaagacgggatctggacatacccgctggatcaggtttgggaagggattcaagctgcttatgccaagattaaggcagatgtccaaagcaagtaccatgtgagcttggatgaaattagttcaattggtgtcagtgccatgatgcatgggtacctaccatttgataaaaataaccaattacttgttccatttagaacctggcggaataacatcactgaggaatccgcagataagttaactgatttatttgattttaatattccacaacgatggagtattgctcacctctaccaagcaattttgaacaaggaaccgcatgttaaagacattgatttcattacaactttagctggttatgttcactggaaactttcgggtgaaaaagttttaggaattggggatgcctcaggagtatttccaatcgatgatcaaacattaacttatcatcaagactttattgacaagttcaattcattaccagaagttgaacaatacccatggcaacttaagaatattttgcctgccgtccttgtagctggctgtgatgctgggcacttaactgctgatggagcaaaattacttgatccaagtggaactttacaagctggtagtttgatggcccctccagaaggggatgcaggaactggaatggttggaactaacagtgttcgaaaacggacaggaaatatttcggttggaacttcagccttctcaatgaatgtgttagatgctccattaaagaagcttcaccgtgatattgatattgttactacgccaaccggtgatccagtagccatggttcatatcaataattgttcttctgatattaacgcctgggttggattatttagagattttgctaatacaattggagccaagatcgataccaatacgctttacgagaccctatttgattcaacggttcactccgacccagatgctggtggattaattaattatagttatctttctggtgaaaatattaccaagattcaggaaggacgtcccctatttgtccgtactccaaatagtaagatgaacctcgctaacttcttccttactcaactctatgcagcatttgcgccattgaagattgggatggatatcttactaaatgaagaacacgttcaaaccgatgtcatggttgcgcaaggaggactctttgggacaccagttattgggcaacaagttttggcgaatgccttaaatatcccaattacaatcatgaatactgccagtgaaggtggaccatggggaatggcggttcttgctaagtatgctgagacgtacggaaaagaatccctagcagattaccttgacgaaaaagtctttaagaatccagaaagtatgacccttacaccagaacctgctggcgtaaaaggatatgaaagctttattactcgttaccaagcaggcttacctgttgaagcattagctggtgatgacattaaagaacgtgaagagaaagggagtaaatagtacatgttagaagatttaaagaaagaagtttataaagcaaatatgcggcttcctaaactaggccttgtttcctttacatggggcaatgtttcagggattgaccgtgaaaaaggattgtttgttattaaaccttctggagttccatatgaagagatgaagccggaagacatggttgttgtcaacttggatggtgaggtagtcgagggtgacttgaatccatccagtgatactcctactcacacttacctttataatcacttcccaaagattggtggagtcgttcatactcattcaccatgggcagtagcgtttgcagctgcacggatggatgttccagcaatgaataccactcacgctgatactttctatactgatgtcccagctgctgatgctttgacgaaggaagaaattgaagaagactatgaaggtaatacaggaaaggtaatcgttcgttcattcaaggaacggggtttggactatgaagcaacccagcggcattagtaatgcaacatggtccatttacctgggggccaacacctgacaaagcagtttataatgctaaggtgttagaagttgtggcagaagaagattatcatgcaatgcaattaacgcaccaagaccttcacttacctcaatacttgttggacaaacactattaccgcaagcatggtgcgaatgcatattacggacaaaataatgcgcattcaaaagatcatgcagctcacgcttaattaatttggtagctacatttaaaaacttttttaggataaaaggagtgtaatctcatggatattaagaattacgaattttggtttgttactggtagtcaattcctttacggtgaagaacaattaaagtcagttgctgctgatgctgaagatattgttaataagttaaacgaaagtggtaagttgccttacaaggttgtcttcaagggtgttatgacaactgctgaaggaatcactaagtttatgaaggaagctaactacaatgacaacgttgccggtgttatgacatggatgcataccttctcaccagcaaagaactggattcggggaactaagcttttacaaaagccactgcttcacttagcaactcaatacttgaacaagattccatatgacaccattgactttgattacatgaacttaaaccaatcagctcatggtgaccgtgaatatgcttacattaacgctcgtttacaaaagcataacaagattgtttacggcttctggggagatgaagaagttcaagaagaaatcgctgactggcaaaatgttgcggttgcttacaacgaaagctttaacattaagattgttcgttttggtgatacaatgcggaacgttgccgttactgaaggtgacaaagttgaagcccaaatgttccttggctggactgttgactactggccagtaagtgacttagtagaatatgtaaatggtatcagtaaagaagaaattgatgctgcttacaaggacttagcaagtcgttatgaaatggtccaaggtgataatactaaggaacactatgaacactcagttcgttaccaacttcgtgaatatcttggtttgaagaagtttatggatgaaaaaggatacactggctttaccaccaactttgaagacttgcatggccttgaagaattacctgggttagctgctcaattattgatgcgtgatggctacggctttggtgctgaaggtgattggaagtctgccggaatggatcgcttattgaagattgctgctgataatgttgctactgcctttatggaagactacacattagaccttcgtccaggtcaccaagcaattcttggttcacacatgcttgaagttgacccaacaattgcttcagataagccacgagttgaagttcacccattagacattggtggtaaagatgacccagcacggttagtatttactggtcgtgaaggtaaggctgtcgatgttaccctttcatacttcaacgatggttacagggttattggttactcagttgattgtcataagccagaagctgaaacgcctcatcttccagttgctaagcagttatggacaccaactgttggcttaaaggaaggtgctgaacgctggatgcatgctggtggtggtcaccacacaatcttgagtttcagtttgaaaccacaacaaattaaagatcttttcggaatgttagatgttaaagttgattttattgaatagttaattcaaattaaaaatcctcaaaatggttctactcggcaaacctcgagacgagtagaaccattttttatcaggagatggaaaaataaaaactgaaaaagagaaaatgctagcagaggaagcttttaacgtttacgatcccgaattagttaaagagcgtcaatatgcccgtcaattagttgagcgatttaatgctcttggcgagatgaacccgactgcaagcaatactgtgattcgtcaattgtttggacacgttggcgaaaaatgtgaagttcatccgcaattcaaatgtgattatggttataacatttatgtagatgatgattttttcgctaattatgattgtgtcatgcttgatgctagtccaattcggattgggaagcattgtttattgggaccgtgagtgcagatttatactgttaatcatctcttgaacccacgattacggcgcaatggagcttacggccaaagtaaggatgtcactattggggataatgcgtggattggtggcggggcaattatttgtccaggtgtaactttgggtaataatgtaattgttggtgctggaagtgtagtgacaaagtcgtttggtgataatgttgttattgcgggtaatccagcacggatcattaaagagaatccatatgtagaataattgattatttcccaggttatttttaatgcaaaaagggaactaagatatggtcatgtgacggccgttatcttggttccctttatcattcttaatatttaaggttatattcgtaaactagtgctggttctttacctacgcgtgtaaagttatttaagttattaatagcagtcatttcctcgtcgcttaatgtgaagtcatagatgttaatattttgcttgattcgcgcttcatgaactgacttcggaatgaaggcgaccccgctttgcaaatgccagcggaggacaacttgagcagcagacttatgatggttagcagcgatcttattgagggttagattgtcgaggatggttccacgcccaagcggactccacgcctgggtaacaatatcatgttccttatcgtattggagcaatggttgttggtttaggcgaggatgacgttcgatttgattaataacgggcatctcatgcgcttgagtagcaagatactgaaggtgaatcatttgatagttactaacaccgattgaatgggtcagaccttccttttttaattcttcaagggctgcccaagtatcaaagaaagctcgctcaattggccaatgaataagtaaaaggttaacataatcaagcctcaacttttgaagggagtctttaacagaggcaattgtttgcttaaacccttgattaggttcagatacttttgtggtaataaaaaggtcctcacgaggtaaaccaagctcttgtaaggcgtttccaacctctgcttcgtttttatataattgcgcggtatcaaaaagacgatagccagcatcataggcatactttatcgcggaggtaatcgtactttgatcagtaattttatataagccaaatccttcttgaggcattgattgaccatcagcaagtaataattgttttatcttattattcattgatattctcctttgtaataagcgaagtggtcgattgtcccttaattattgttggggtataaacttttgaagtgacttcttcgcctgcaatcatttttaagatcattttcccagcatcttcacctagttgacgtttggggtgattagctgtagtgaggctgggggagataatttgcgccatttcatagttatcaaaacctattactgaaatatcagttggcacttgttttccatgtttttgaagatgactaataactcttgtggcaaggcggtcattatagcaggcaatcgccgtaatatcattattactattaagcatcatgtcgacttttttgataatatcttcatagtcttcgcttgattggtacataataacatttgatttagtagtggggatattgttatcttgataggctttgatcattccagtcatgcggtcaacgccttgctgatcatctatttggaatactcctaaaatattagtatgtccgaggctaaagaggtattttaccaaattctcctctgcttcccggtcttttgtcagtaaagaaggaaaatcaaagccaggataagtagagtgaaataggattgttggaattttatatttctggacttgccgataaaggtctaagttaggattaggcatggcgctttcagtcggctcaataattaatccagcaatttgaagatccaacatatttaagattgtttggcgttcacgtttatggtcattaagcgtatttccaacaatcattgagtaaccttgttctgttaccacactatcaattccggaaatgattggagggaagatatagtcagccatatgagtgctgattacccaatgattttatttttttcgctttttgtccaatcgcgttgccagtcttgaacaaacatcccaccaccttgaatacggtaaatatagtgctcgttttcaaggtccccaacagcgcgacgaattgtataacgggacacattaaaacgtttcattaaggcactttcagttggcagtttttcattgattttatattttccatcaataatttcgtttcgtaaagtttgctttactgtttcatatttcacttccaatgctttgcgctcctatcttaataaaagtagttttgaatatataaaaaatgctccatataattagcaacctgctaacgcctatgaagcatttgattgattttatcttgatatttagaaccgacgcttctttggattttcgattggcttgttatccaaatcggtccgtactactagaacatcgcaaatggctgttctagtaacaaattcggtaacagaaccgatcaaaattcgttcaacagcgtttagcccagtagcaccaatcatgatgaggtcagcacccatttcctttggcatatcccgagcaataattgtctttggagcaccatattcaatggagtaactagcgttttcaacaccgtgctctttagcatagtcgatgtacttgtctaaagtcttctttgcagtttctgtaacttgttcaaccattgaagtatcgaaactagaaatattttggaatgcacgtgtgtcaacaacgtgaagtaaacgtaattcagtgtctgcaccattacgttttgctacagcaacagctttcttaaaagccaattcagcttctttagaaccgtcaacaggaactaaaatgtgtttgtattcttgtgccataattgtagtgccctcctgaaatctttatattatatacttattatacactttttcactattgagcgtaaagcgcctacgaaacattacttgcgatgatttatgcgaaaatcagcagtaattgcgaaagacattaacgtttcgctgacacagccaatgattaccataataactagaaatccagtattgtttgtccatccagaaatgatacttagaataccgacgacggtcatcacaatcccccaattttttaattgtggagctaaatatttgcttttagtaggatcgaaaataagaaatggcttatggatgtgggttaagagaaagactccttcaaaaagagcaattaaaccaaatagagtcattagaagtggtaacaacataaaaatctatcctatctataatgaaattaaaatgagggtgagaaaaagcaaaaatctttctcaccctcactaaatatgtacgaaaactccgttggtgccgttaattgtcattcagtgttgacctgtgtttaagacaggtgggacacggctgcctaatattcaactaccaagtgtaaaggcatgttgtccaaaaggcaatgcactagtcccaaagtaataagactgtaaggcaaacctgcgtttagacaacgcgtacactacagaattttcacttttataatagcatttttaagtggttgatgcaattatttgctcgggtgatatttacctcgtaaagtatgttgctgggccttccgtaattgccaatattgccggcctaaactggcttcaaaacgaccattattttttggctggtaatattgagcatctttgattcggtcaggtaagtattgttgagctacccaatcttggggatagtcatgagggtaatcataatctagtccatggcctaacttagcagctcctttatagtgggcatctttaaggtgagctggaacgtcaccaaagccaccttgccgaacctgagcaagagcttcgtcaattgcattaattcccgaattggattttggtgacaggcataattcgatgacagcatctgctaagggaattcgtgcctccggaaagccaactcgttctgccgtttgaactgccgtaacagctcgttgtacagcaggcatattggcgagcccgatatcttcgtaggctgtgatcattaaacgtcgtgcaataataggcaggtcaccggcttcaattaaacgtgcaagatagtggagggctgcatcagtatctgacccgcgaatagacttttgaaaggctgagatgacatcataatgagcatcgccatctttgtcagcggataacgcctttttctggacgctttcctcaataatcggtagcgtaagatgtattttcccatcttcacttggatcagttgatttggccgcaagttctaacccatttaatgcacttcgaagatcaccattggtcgctgctactagttggtcctcggcgttttcttcaaggactaatggtagattacccagaccgcgttctttatcaactaatgcacgctggatagcggtcttcatttcatcagttgaaagtgagtaaactgggaaaatttgcgtccgactgcgaatggcgggattaatactaatatatggattttctgttgtcgccccgatgaggataattcgtccgttttcgaggtgcggaagaagaaaatcttgttttactttatctaatcgatggatttcgtcgagtagtaagattacagttccgctcatcttagcttcttctgcgacgatttgtaaatccttttttgtatcagttgccgcatttagttttcgaaaagcatatttagttgaaccagcaatcgcactggcaatgctggtcttaccagttccgggagggccgtatagaatcattgaagaaagcatttttgctttaaccatgcgtgagatgattttacctggtccgacaaggtgttgttgaccgaccacttcatctaacgttcgcggccgcattcgataagcaagtggttgttgcatatattagccacgatcctttctatggaagagatggtggaaaaaactttgatgttgatcattgtttttttcagtcatactactatttgaatttaccagattaggatatcgttttttgacgtcgactggtgattggtaaacagctgtttttgccgccacgacaactgctaatgagcctgggtcagttttatattctggatcagttttcaatgtaaattgagcattatctttagcagcagtttgaatgtatggatgaatttcgtcgtgagggagattaccgttgataaaaacaaggttgccaattccacgatctaactcggcagttaatgcctttgtccaatcttgttcctgtagttcttgaacactaattgttagacagacgcgttcacggaatgttccgagatattttcgctgttcatcgggcttgatttttggtgtaccgtaaacagcattgtcaattcgctgttgagcagcacttttttcttgttcagacatattgaacgcctccttatcatgcaattgtaacacgaaatgcagaaaactatatttcttgataatgttataatttttgttatatcatgactatgaagaaacaaaagtaggctaacatataagggaagtgattattatgtttagtgcagtattttgggttttagcattttggtttattgtcaatctagtctggacaattgcgcgccttaataatcggatgatgtcaagaacgtttgcctggataaatgtagtggcagtagtaattggtttttggacgttttacgctgccagcaatggcgggggcggaattgctccttggtttcggttgatgaattggactaacattgtccttgcgatttttcaattttataatggataccgcccacatcaatatagtaaaaaatcaggtggattatagaatgaagttagccacccagttggtggtaaataaaaaacgccattcggcgtgacatcaggtatcatattaagtgaaccaaacctatatgaaaggatgtccgtcaaatgacgcacttaaatgataccatgtctactagtttattaactactcataaaaagaatgctcatcttactaaagaagaacgtgtgatgattgcgactttaaagtcgcaaggactttccaatcgcgcaattggtcgccaattaggagttaatcatcaaacaattaataacgagctcaaccgtggtacggtccgccaacttcgtcgtcaaaaatctaatggtaagatttacgaatattcttactacatctatagttatgaagctggtcaggccacatatcttgaacatcaccgccattctggtcgtcgtcgcttatattattcttcaaagcaatttttacgattagctgatcagctaatgcttggtgagtttgacgaccaccattactccccacaagcggttatttataaggctcgagatttaatgaatgatggcaccctgatcccaaagtcggttgtaactttatatcaatggattaatgagggtgtgcttcgtacgtccaatttagacctctttgaaaaacctaaacgtaagcatcatcgaactcatccgcaagctaaaaggtgcttagggcctaatattgctcaacgacctcaaactgcggaccaacggtccgaaattggccattgggaactagatacagttcagggacagaaaaatgacagtgttgtactagtaatgactgatcgcctttcacgagttaatatcacgagtaaaattgctggtaaaactgcgcatgcagtaaatcagttctttataaatttacgccagaaaatgggcacagatgcttactatcgcatctttaagacaataacctctgacaacggttcagaatttagtgagttaacacaagttcacgatcatgttttctatgctgatccgtattccccttgggaacgtggatccatgagatcaataaccggtttctccgcaaggagattaccaaaggtgaagctataaataactatagtagtgctcagatcatagcgactaatgattggatgaatcactatccacgagctatgtttaatggacattcgtcaatggatatctatcgtaaggccttctaccaagagatatcacagctccatcaaccaataatcaattggtcagtattatttatttgagtccagtggctaacttattcttgaaatttagaatagtaaaaaatcatagctctaattaaaaagcttataaaaaggcgaggctgagagaaaacttttgttttctctcagcctcaactgcttttatgaacaatagtaagataacgtggaaaataaccacaaggctcgagtctaagtacgaacgataatcagcctgtgccgtgctaatcatcgtcctagcttagccaaccgccttgtcgaggaggttattttccactcgcctttggtgttttattttacaatttcacaaaattcgattgtttcactgttaggaccttcaatgttgaagaacttaattcccttatcccagaagtcaaggtgttgaacttcatcgtcctttaggttgaaaccttcagccttagcagccttgaaagccgcgtcagcatcactagtattaagggaaatgtggttaatagcacccgtttcgtgaacggcaccgtcgccagtccagatttctaaagtgaggtgaccatattgcatgaaaacaacttcatttccttggtcatcagtatcaaattcgccaagtttcttgaaaccaagcttttcccaaaaagcaattgtttttgccatatcatcggttggaatcccaatgtgttgtacatcgtcaaagtaacctgctaaactcttgttaaatgccataataaatcactcctgtataaattttaattaccaatatcaagtgcctggtgctttaatttagggaagatatgacggtctgaccaaccagtaattgcaccttggaaggcaagggcaaataaagttcctaatccaaagttgtaaatactgccttgcatgaatgcagcgataattgccataattgttggtggaatgtatgataaccacatcgcaatcgttgcgttaccatggcaataacggaaacgaataatttggaaaaggtcatcagcggggtgtaacacgaggttgacacgctgataaattgaaatggcggttccgatgaaagcaacccctaagaagttaatgaaaacatataggataatcatcggtaaggtagtggcgtccggcataattcggttaaagatgtcagagaaccactggataaaaatagaaaatggcaacatgaaaataaaattaccaccaattcgtcgccagtcccacttatgcatcaaaattgcgttgaggatagaagttaacatccctaagaccatgaaagcccagaaaagggtcattgaattgttccctaaaacggcaatccctaggttgttttctgcggctgtccaataagcggagccaagaaattgtgggtggacgtgtgaacttgtaacaagtgttaggacgttccccattgagttaataacaattgacagtgcaaagtatgcccaactagcagttaatgaaattgttcgctcggcaacttgaccttgtactggaactttttcttgttccatttatattctcccttccaacttgaccaatcatttggtgaagttattcactttctctctacgatgaattaatttacaaccatcaaaaaatcttgtcaagcgcttcacaagttgaaatgacgggatttatcctataccaaaattattgaaacgatttactgaaagcgcaatcatcaagtgggtgtaggaaacataaatctaattagaccaattagctgaaaaagcttacaaaaaaattttgaaaggatgagatatgtgaaaataatcatttctccagcacgaacaatgcaagttgataccgactccttactttacaaagatttgccggaatttcttcagcagacaaaagacattttagggtggatgaggagcttatcttatgatgagttacacaaagtatggggaaattgcagctcgcgtttagcgatgaaaaattatcaatggctccaacaaatggatcttcaacgaaagctgacgccagcaattattgcttttactggtctgcaatatcaatatatggcgccaagtgttttctcagatgatgggttgaaatacgttcaagacaatttacggatattatcaggattttatggtattttacggccgtttgatggaataataccttaccgcttagggatgggtgacatggcgccagtgaatggatataataatctttatgacttttggggagaacaactttatcatgaactctataagaataatgatttagtaattagcttagcttcggtcgaatacgaaaaggcaattactccttatctacaaactcaagatcgatttatcaaatgtatttttggcgaagaaatagatggaaagataaaacaaaaagcaacattagctaaaatggctcgtgggaatatggtgcgatatttagcagaaaaccaaattcaaacaattgaaggcgtcaagcagttttatatcggcggttaccattttcgggaagatctgtctactgatgaaaaattagttttcgaactggtaaagtaaaagtaatcatattatttgccaatctttttgaattgtcttataaaagaattgtatacaaaactattaacagtgcactgattctattaaatttttaatgatagaagggagtcaaattatggtaggcgattctttaaataagacaggtgccaatttattaatcaaggccttgcaagagaataatattaaccggatgtatggaatagttggaatcccggtaaccgatttagcgcggctcgctgaattacgcggaatgaaatattatggttttcgccgtgaagattcagcagttaatgtcgccgcggcaactggttacttaacgtaaaaaactggcgttgcattaactgtttcagcacccggttttttgaatggattaacagctttagctcaagctactaagaattgttttccgttgattatgatttcaggttcgtctgaacgccatattattgacttatcacagggcgattatgaaggtcttgaccaatataatgcggcaaaacccttctgcaaaaaagcttatcgggttgatcgagcagaagatatgggattagctgttgcaagagcaattcggacagcagtttcaggccgccccggtggtgtttatcttgatattccagctgacacaattgttcaagaagatactgctgatcaatctaattttggggtttataagttagttgatcctgcccctaaacaggtacctaatgatgaagcaatatcacgagcggttgatttaatcaagaatgccaaaaagccctttattattttaggaaaaggagctgcctatgatcagaccgaaaaacaagtgcaacaattagtagctgaaacgaatattccatttttgccaatgtcgatggcaaaaaggttaattccagatgatagtcctcattctgctgcagcggctcgttctctttcactacgaaatgccgatgtagtaattgtaattggtgcccgtttaaactggatgctttcatatggggatgccccacaatttaacccgcatgcaaaatttgttcagctagacatcgatgccacgcagtttgatttctcacagccaattagcgtcccgctccaaggagatcttaagtcgattttaggtaaattggttccggcgctattggcaactggatatcaagcgcccgcagcatggttagagcaaattgcgcaagatactgagaaaaatgacaaaaagtttgcgcaacgaattgctaatggtaaagtagcacaaaaatttggctattatggagcgattgcgcctattgctgaatacttccaacaacacccagacacctatctagtcagtgagggggctaatacgcttgacattggacgcgatatgattggaatgcagctcccccgtcatcggctcgatacgggaacttggggcgtcatgggtgttggccttggttatgcaattgctgcggtggttgaaacaggaaaacatgttgttgcgcttgatggcgatagtgcatttggttttgatgggatggagattgaaacgatttgttgatataagttgccgattacggtcgttattatcaataatggctgaatttataacgggatcggccaagttgttcccaatcaacttgggccaactactcttgatccaactgcaaggtatgatttaatggctaaggcctttggtggcgataattattttgtaagtaattacgatgagatgaaaaatgtctttgcaagagctgttgactcggaacgcccaaatattattaatgttcaaattgcaccatcgatgggaaaagaatctggccttattgggaatctaaatccaaagcttaatttacaaccacttgaagaaaatgagaggagccatcataatgactgaacaaagtgaaaatgcaccattaaaaggaattaaaattgtggactggacacgggttcaatcggggccttcctgtacttagcttttagcatggctaggagcggaagtgattaaaattgaacggactaataccggagacccaactcgtaatgagctgcttgatattaaagattcatggagcctttattatttacaacgccgtttgtaaaattaagttagaaaaatagaaaagccatttgtggtagacttttgaatacccctaaacaaaagaaaggaaaccacaaatgacttacacccatcttaccacaaacgagctgacaatcatcgcccattctttcgtgcaaaagcttaaagcgtaccgagtggcccaaatgatcaaccgttgtgccgaaaccgtttatcgcgtttatcgttacctggaaaccggtgcctcaattgctgattatcaagatcactatatgcgcaataagcaacgttgtggccgaaaacgtactcagttgtcactggctgaactcacttatatcaacgacaaaattacccaggggtggacgcctgataccattattgggcgcgctgagcgcccaattagttgtaaccagcgaactctttaccggatgtttgaacgtggccagttcggcttcgatgtccgttccttgccgatgcgaggtaagcggcacccgaatggctatgtcgagcgccgcgggaaggctggccaattggggagaagtattcacgagcgtgccaaggactttccgcactatgccacttaatttgggcaccttgaagctgataccgtccaaggcaaaaagcagcaaggggcggtaatgaccctgaccgaacgccaatcgaaggtcgaaattgtactcaatgtgcacgaaaagacggctgatgcgattaacaaacacttaagtcagtggtttcggaaattcccgcggcacttctttaaatcgattacctttgacaacggaaaagaattcgccggctggcgcgagattgccaatcaatttgaccttcacacttactttgtcgaggttggtgctcccaatcaacgagggctaaacgaaaacaacaacggtcttttatgccgggatggcttaacgaaacagctagatttccgcaatcttcctgatgaattggtaacccaactgatgagtaagcgaaataacctgccccgcaaatcactaggctatcgaactccatatgaagtattcatgtcttacatcactgatgagcaactattttctttctaacttaaattgacatttcgggtaaataaaaaggcattcccaaagaaattgggaatgcctttttgggttgaatcaaacaagtgatagctattgattacttgttgtagaattcaacgataagagcttcatcaatatcagcgttcatatcttcacgtgctggaatgcggttaagcttaccttcaagcttgtcggcatcaaagtcaacgtatgaaggacgagaaacaacagcttccacagcgttcttgatgatgtctaagttcttagacttgtcacgaacggcgatgatttgaccaaccttaacttcgtatgatggaatatcaacacgcttaccatcaacagtgatgtgaccgtggttaactaattgacgagcttgacgacgagtagtggctaaaccaagacggtaaaccatgttatcaagacgacgttcaagcaatgccataaagttggcaccgtgagtaccttccttaatcttaccggcacgaacgaaaaggtttgagaattgacgttcagtcataccgtacataaaacgtagcttttgcttttcacgtaattgtgtaccatattctgaaagcttaccgcgacgatcacgaccgtggtcaccaggagcgtaagcccgacgtgctaattctttaccagtacctgaaagtgaaacgccaagacgacgtgaaacacgccaacttggaccagtgtaacgagacataaataaattcctccaataattttagttggagtaaaataatccgattgtgagcttggcattcgtgcaggctgatttgaatctttcaccctagcagccgggttactaaaaacaccgttaggcaccagtctgttgacgagcttgcccctcactgctgcattattttacacaaagtctagtatacaacggttcgtaataataagtcaatcttttctttagaaacctcgtaacttttttagcagaatgatgaacaatataaaagtttattaaacgaagatgttttttcatatcttttaaagcacgttcattgtggtatgctataattttgaataggattatacggataattattgtgcaagagcaataaacaataaaaagtagtaggtggaaaaagtggtttttcaagtattgattggtattttaattattgttgtagcaatattagcttgcgtatatttttatcaacgacgagctgttaaacagatcaacgacttaatggaaagcgagaaaaagctagcagatcaaaaagttgaccagcagatcaaaaatgttgaagaattgcaactaatcggggatgctaaaaagcaatttgaaacaattaaaaacaagtatgaaaaacaagtgcgaccagcgatcacagcctttaataaacgagctccccaattattagcagattcacggacgagcaagttgctgacaattaacactcagattcgagacctgcaagcagatttggcaaagttaacaacaactctccaacagatccaaaagacttacaacatcttcgtcaacaacaacatacccataagcaagcggtcgagcagattaaaaataaatatcgtcaattccaccggcaactaaatgagaagagcttcgaatatggagacagtgaaaagcagttaaatagcagattaaacgaattagaggatcaattcgctcaatttactgatttaactaataagggcgatattgaagcggctcaagagattttaaccaatttgcaatctgaaaacgataaatttgaacaagaccttaagaagattcctcagctctataagccaattgcaaccgagtttccagaacaattatccgagctaaaaagtggttataagacacttgtaaaacaaaatttccactttacggagaaaaatattgataagcaaattgaacagctccaatccaaactggatcagacgattgaccaacttaacaatttacaattagatgttgtggaacaatctaataaagatcttagtgaccagattgattacttatacggggtaatgcaaaaggaaattgatgctaagaatgaagctgttcatttgattgaagtgatgaaaggctttacaaaacacgctcaacggcaaaatgacgaacttggtgtagaattagaccggttaagtttgaattacacacttactaatcatgaacaagaaaccgtacgtgaacttggtgaacaaattaaagcaattattaagcagtaccgtgatgacgcagaagcaattgctaacaaaacagctgtttatagtcaggttcttgatcggcaaaaatctaatcaaaagaacttaactgaaattgaaaaaagtcaagaaaagcttaacgatgaagttgctaaattgcaaactgatgaacaacgtgcccgtcaaatgctgcaaaaatattccacccagattcgtacaattcatcggcaagtagaacagttgaaccttcctggcttaccaaaagattacttagattacttctttggtgtcagcgatgagattaaaaagttagctgatgaattgaatgagtataagatcaatatggatgaaattacgaagcaactaattatcgttgagtcagacctagacacattaaatgacaagactgatattcttcgtgatagtgcggaattaacagaacgattccaacaatatgcaaatcggtttagtgataacgaaaagattgcagcagcagctaaaaaatcccaagaactttttaagcagtttaactacacggcaagcttagaagcaattgcgaccgttttagaagaaatagaacctggtagctacaaacgaattgaagatacctattatcgtgaaattggtaaaaattaaaaatcaaggtgagtgggaattagcctaccgccttgtggttacgacgcgaagctagttccacgatatcttaaacaatgttcctataaataaagaggctgttgaaaaaatgaagttttttccagcttcctttttttcttattaaatgatagtgataattaatgcctaatagctaattttctgttataatataaaaccgttttaagaagagtcgaaatcttcagcagtagcctatcctatactgttgaaatcataatcagagtaggttacccatttgtaacaaccctgtgtattatttttaggaaggaaattagtatgatctattttgataatagtgcgacgacaaagatactaccggatgttttgtcgacatacgaaaccgtgagccaaaagatttgggggaatccaagcagcttacataattttggtgaaaatgcttggaaccttcaagaacaggcacgccagcagatcgcaaagttattcggggttaagcctagtgagattatttttactagtggtggttctgaaggagataactgggtaatcaaaggaactgcaatggctaagcaccgttttggcaaacacattattacgactagtgttgaacatgcagcggtaaaaaatgcattggagcaactaaaagacttcggatttgaggttacctatctcccggttgataaagagggacggatcaatcccgctgatgttaaagccgctattcgtccagatactattttagtgtctatcatggcagttaataatgaaattggaacgattcagccaattaaagaagtgggagaaatccttaaagattatccaaacattcactttatggtggatgctgttcaggcaattggtaaaggattagatgaccaagtatttagtgatcgtgttgattttgccactttttctggtcataaatttcatgctccacgaggaaccggttttgtttacgtcaagagtgggcgcaagttagagcctttgattgctggtggtggtcaagagcggacactacgaaatggaacagaaaatacacctggtaatgttgcaatggcaaaagcaattcggttagtaaaggaaaatgaagcggaatcagtaaaacgtgaacaagcaattaaagaacggatttacgaccatttaagtaaatttgatcatgtaaaattgatttctggccgcgatcaaggtttcgcttcccatgtactgtgctttgcaattgtaggagttcggggtgaaacgattgttcatgcctttgaagacaaggatatctatatctcaactactagtgcttgctcgtctaagaagcattccgaagccggaacattagctgccatgaaggttccagaagatattgcaacaagtgcagttcggattagccttggggatcaaaatacccttgaagaagctgatcagtttaataaaacatttgatgaattatacgctggctttaagaaaattattgaataaaatctgaaaggaggacataacgtgcaatatacagaaattatggttcgttatggtgagctttcgacaaagggacataataaaaagtcctttattgatcgtttaggggtaaacgtacgaaaggcccttcatagctttgaccaggtaaaggtgcatgcacaacgtgatcggttgcatgttgaattaaatggagttgactatgatcaagtgatgaatcgcttgaagttagtgtttgggattcaaaacttctcgccatcaattaaagttgataagacttttgaagcgactgcagaggcagcagcgcagatgatcgctgaacaagttgacaagccaattacctttaaagtggaaactcgtcgatcagatcaccaatttgcaattgatacctttgaaatgaacaacaagctaggaggatacctcttagataagtttcctgataaattaaaagttgatgttcaccatccagacctaactttacgggttgagatccgtcttaatgggattttcctttcaagtgaaacgattaagggtgctggtggtttgccagttggtactgctggtaaaggaatgatgatgatgtctggtggaattgattcaccagtagctgcttaccttgggatgaagcgtggcgtttcaatggaaatggttcacttctttagtccgccatatactagtccccaagctttagcaaaggccaagcaattaactgaacgtcttgcaaaatatagtggaagtattaagtttattcaggtgccatttgccgaaattcaagaaacagtaaaggaaaaagttcctgaaggttacttaatgacaattcaacggcgaatgatgcttcggttggcagctgccttaatgattaagcgtcatggtctggctatttttaatggtgaatcattagggcaagttgcttctcagacaatggaaagtatgctggcgattaatgatgtaacttcttatccggtattgcgaccagtattgtcatttgataagaccgaaattattaaaattgcccaagatattgatacctatgatctttcaattcttccatatgaggactgttgtactgtctttacaccgccatcgccaaaaacccggccaaacgttgagcgagctcgtgaatacgaaaaacgacttgatattgaagggttaatgcaacgagctcttgatgggattgaaattacggaaattcatcctggtgaagattatttaaaccaaaatgaagatgtttttgctgaattactttaattaggccttgacgaggtttgataatttagctatgatacattttaataagcattgaccgaaagagtagtaaagcggcacctaaaaagcgagatcctgagagtgagagaggattagttaaactttatgaaggtagttcgggagctgatatactgaaattaatagtaggtatgtccggttcatttaccgttatgaaatgataaagtggagtattttatactcaaattaggtggtaccgcgatgattcgtcctatcgattgtgatagggcgttttttagttaatgcacaaaataaaaatgaagattgcgttctgaaaggagtttctgccatgacagaaaaagatatgtcaaccaagtacgatccagcggcggttgaagaaggccgttatcaatggtggattgatcaaggattctttaaaccaagtggtgacaaaaaagctcacccatattcaattgttattccaccaccgaatgttactggtaagttgcacttaggtcacgcttgggatacaactttacaagatatgatcattcgacaaaagcggatgcaaggctatgatgtattatgggttcctggaatggaccatgctggtattgctacccaagcgaaagttgaagcccggcttcgtaaacaaggaatttctcgttatgaccttggtcgtgacaagtttgttcaacaagtttgggactggaaagatgaatatgctgatattattcaccagcagtgggctaagatgggtatttctgtggattatgaccacgaacgttttacccttgatgaaggattaaataaggctgttcgaaaagtctttgttgatctctacaataagggcttaatttatcgtggaacttacatcatcaactgggacccacaagcacggacggccttatcagatattgaagttattcataaggatgataagggtgcattctaccacgttaagtatccatttactgatggaactacttttaacggtaaggattacatcgaaatagccactactcgtccagaaacaatgttcggggatgaagcggttgccgttaaccctaatgatgaacggtacaaggacttagttggtaagaaggtcatggtaccacttgtcaaccgagaaattgagattattgctgacgactacgtaacacctgaatttggtactgggatggttaagattaccccagctcatgatccaaacgactttaaggtaggtaagcgtcacaatcttcctgaactgaatacaatgaatgaagatgcctccatgaacgaaaatgctggtaaatacgaaggcatggaccgttttgaagctcgtgaagcaatcgttaaggaccttcaagatcaaggttatatgttaaaagttgacccaattgttcactctgttggtcactcagaacgaacaggggtacaagttgaagcccgtctttccacacaatggtttgttaagatgaagccattagccgaagcagctcttaagaaccaagatactgatgaccgagttaatttcgttccagaacgattcgaacacacctttacgcaatggatggaaaatattcatgattgggttatttctcgtcaattatggtggggtcaccggattccagcttggtataacaaacagactggcgaagtttatgttggtatggaagctcctaaagatgccgaaaattgggaacaagataaggatgtccttgatacatggttctctagtgcgctttggccattctcgacgatgggctggcctaatactgattcagcagacttcaagcgctacttcccaaccaatactttagttactggttatgacatcatcttcttctgggtttcccggatgattttccaatcgcttgaatttacgggtcaggcaccatttaagaatgttcttctccatggtttgattcgtgacgaacaagggcgaaagatgagtaaatccttaggaaatggtattgatccaatggatgttatcaagaagtacggggtagatgccttacggtggttcttaattactggttcaactcctggtcaagatattcgttttagctacactaagatggatgcagcttggaactttattaataagatttggaacgctagtcgttacgttatcatgaaccttggtgagatgcctgctcctgtccttcctgataagagtaagtgggatttagctgatcggtggattttgagtcggttaaatgcaactgtaaagcaggttaacgaacagtttgacaagtttgaatttggtgaagctgggcgggcactttacaacttcatctggaatgatttctgtgactggtatatcgaaatgaccaaggagaaactcaataatgggactgacgaagaaaagaatgatactaagaatattcttggttacgttcttgatcagaccttgaagatgttacatccaatcatgccattcgttaccgaaaaattatggcaatcaatgccgcatgatggtgaatcaattatggttgcagattacccagttgctaatgccgaacttgatgatccagccgcaactgaacaaatgaatagtttgattgaattgattaaggctgttcgtaacattcgaaatgaagctaatgcgccaatgtctaaaccagttgacattttggtaaaagttgatagtgatcacttggcacagatgttgaatgataaccgggattacattgaacgcttctgtcatccagagaacttaactattggtaaggatgttgaagctcctaagcttgcgatgagcggtattttgactggagcagaagtttacatcccaatggctgaattagttgaccttgatgaagaacgagatcggatggaaaaagagattgctaaacttgaaaaagaagtagaacgttcacaaaagaagcttggcaatgaaaagtttgttaataatgcgccggaaaaagttgttgaagctgaacgacaaaaggcaacggaatggcaacaaaaattagcagctgctaaagaacgccttcaatcacttcaacaagcttagcgtcaatttatagtaggataattaacatttttaataataaatgaaaattatatcattttattaaataggttagactactgtgagaatgctattagctttaatatttataaatatagtttaaaattagattaaaaaggaattggcaattgctgattccttttttgattaatatgaaaaaataatcatgcatcgttcgaaaatgtttatctactgataaggattaaataattgataattaagcggtttatttagagattatttcacatatttaccatttatttattgtaattatttatcacaagtattatgattgattgtggagaaacaggaaacggtttcaactattctttttatcgatatacttcggagggaggtatttataatgactattcttagtctggcacgtttccaatttgccatgacgacggtttaccacttcttctttgttccgttttcgattggaacagcttttatcgtcgccattatggaaagtatgtacgtctcaactaaagacgaaacatacaaaaaaatggcaaaattttggggaaatattttcttacttagttttgcggtcggtgttgttacaggtttgattcaggaattccaatttgggatgaactggtcggattactcacggtttatgggtgatatctttggtgctccattagccctcgaagctttgctatcattctttattgaatcaacatttattggcttatgggtatttacctggaaaaaggttaagccagggttgcaccttttcttcatttggatgacaagttttggctctttaacatctgctttatggattttaactgccaactcattcatgcaacacccagttggttatgaaatcaagggtggccgtgcagtaatggttaattttggtgcattgcttaaaaacccccaattatggtatgaatttggacatgttatccttaacgccatcatgatgggtggtattattattgctggtttaacagcattccaacttctcaagaaccaaaaactttctgaagctaataagaagttttacaagaagtcaatgcgtttaggacttttagtatcattgattttctctattggtggaattgcgttaggggatgcccagatgcaatacttaatcaaagaacaaccaatgaagtttgcagctactgaagacgtattcacgactactggtaagcatgcaccgtggacaattgttggtattgctgatatgaaagaccatgaagtaaaaggcaatatcgatattccctatgccctaagtattttgtcataccacaaaactactggtgcggttaccgggatgaatgagctcaatgcccaatataagaaaaagtacggcaagaatcttgattactacccaccagtaaatacgctgttctatagtttccggattatgtgtgcagtcggtgcttggattttcttagtttcattagttggattaattatgacaagagaaaagagcaagaaaccacttgcacaacgccgctgggcactttggtgtattgcaattaccactttcttaccatttatcggtaatactgctggttggtttgtaacggaatttggtcgtattccatggacggtttatggcttgtttacaattgctgaaagtgtatcaccaaatgtttcagttggatcattgttaacatcaaatattgtttacttcgtattatttacaactcttgcaattacattaatttggttaattgttcttgagttacgtaaagatccatcggaagcaattgaacctaaattcaagaaggttcttgacccatttgacaaggaggcgttctagatgagttttcttcaattattatggtttgtattgattggagtgctttttgctggcttcttcttcctagatggatttgattatggggtaggaatggcggtcgaaacacttgctcataacgaatcagagcgtgatcaacttgtgcggacaattggaccagtttgggatgcaaatgaagtatggttaatcacggctggtggtgcaatgtttgcatcttttccatattggtatgctagtcttttcagtgggtattacttaatcttaatgattatcctagctggtttaattatccgtggtgtttcttttgaattccgtaaaaatagtccaatgtcacaaaagcggatctgggattgggcattagcaattggtagtgcaatcgttccatttttccttggtattatgtttgttagcatgattcatggaatgccaattgatgctaacggcaattttcacgcaggattctttgactatttcaactggctttcagttgttggtgggattgccttattgcttttaacctacttacatggaattaattatattgccttaaagacgactggtccggttcaggaacgcgcccggaactacgctgaatttttgtactggattctttatgctggcgaagttgtctttgcactattattaatctttatgaccgactttatggctgttcacccagttggcacaatcattatgcttatattgattgttggtttctcagttttagcccaagtagaaacctttgctggtcatgaactaattgcctttatttcaagtgggttaaccttagtatctttagttgtattgatttttatcggtctcttcccacgggtactaattagtagcattagtccgaagtacagcattcttattcaaaatgcttcctcaacagaatatacgttgacagtgatgacgattgctacttgctgtcttttaccatttgttttggcatatacaatctgggcttactggattttccgtaaacggattgcaatgccagctattccggaggttaaataaaaagttatgattgatcgactactcttcaaaatcgagggagcagacatatcatgattaagcttgtggggctttatgtcctgcaagcttttcttatccttggtcagggattaagtttggctgctttactaacaggcttatggcagggacattctcttttaagtcaaatatatggcttaggtggatttattgtttgctaccttttgcgtcatgggctaaccgaaattgggaatgattggcttgataagtattcggctaatgctgcccaaaactttcgtcagcaattattaaaaaaagtctttgcgcttggaccggtaattgttcagcgggagggaaccggtaatatggttactctcgctcttgatggcattaaagaagttgaaaattatattcgactcatctatagcaaggtgatcagcatgatgattattccagtcattattttggttgtctgtttttggctcgattggatttctggcattgttatgttgttagtttatcctttgattgttttattcatgattattttaggctatgcagcgaaggctaaggcagatcgacagtttgcagcttttcaaatattgtctaatcactttattgattctttgcgggggattgacacattgaagtactttggccttagtaagaagtattcgcaaagtatttatcggtcaagtgagcgttttcgcaagtcaacaatgagtgtgattaaagtagcgatgttatcaacgtttgctcttgatttcttcactacattagctattgcaatcttagcagtctttcttggcttacggttaattaacggtcacttattgctattcccgacactagcaatcttgattttggcaccggagtattttttgccgattaggaactttgcaagtgattaccatgcgacgttgaatggtaaaaattcatttcatgcggttcggcgaattcttgagatgccattaccaaagaagccgactgttgaattacaccagtggacaggagtcgatgggttaagttttgagaatgttgagtttatgtatcctcaaaatggcagtgaattaacaaaccttgatttaactgttaaggggaatcaaaaaattggcattattgggatgagtggggccggaaagacaactttaattaatcttttaagtggctttttagcgccgacaagtggccaaattaccattcaaggaaaaaaagtaacgactttggatattcatgactggcaaaaacagattctctacattccacagactccctatatttttgcagatacgttaaaaaataatattgccttttatactccaaatgtcagtgaagacaaaataaaagaagcgattcatgttgtcggcttagatgatcttgttgctgaattacctcaaggattagggacgatgattggcagcggccaccgagcattaagcggtggacaggcacagcgaattgccttagcacgagcatttcttgatccagaacgtcgggtaatgatttttgatgagccgaccgcccaccttgatattgagactgaactagagttgaaaaaaagaatgcttccgttgatggaaaataggttagtcttttttgctacccaccgtttgcattggatgaagcagatggactacattttagtgttgaagaatggcaagttaattgaacaaggaacgtatcagcagttgcttgatgaacatggttactttacagaactgatggaccaaacacgcggaaaggagataacccatgaataagattcctttacttaaagcaatgaaacatgatcggtgggtgaaacccttcctaaagcgttacaagtggaccttggtattagcaattaccctggggattgttacctttatttgtgctagtggattgatgttcaccgcgggctatttaatcagtaagtccgcaacgatgccttttaatattttgttagtatatgttcccatcgttcttactcgtgcctttgggatttttagaccggtgactaattattttgaacgattggttagtcataattgggtttttaaaatgacttctgcatttcgtaaaaagctttatgattcgttagagcaggatgccgttttctttaatagtaagtatcgaattggagatattcttgggttactttcagaagatgttgcccacattcaaaatttatatttacgaacgatttttccaatgttggttgcatttgggctttatgccattatcgttattggaatggggataatttctccactaatgggtcttttaatgttaattctatttgggttaatcatcattgctgttcccgtgtggtcagtgcttgttaatggtgcacgccagcaactagaaaagcaatataccaataccttgtatgctgatcttactgataatatcatggggattacagactgggtatttgcggggcgcagtgcggattacctgcagcactataataaaagtgagaaaaacgtactagcatctcaaaaagcgatgaaacgttttgagcattggcgtgattttattcttcaggtaatgattttattggtggttgttagccttattgtatggggagcagcacatttcggcggtcattggggaggcagtgcaaattggattgcggcctttgttctttgtgtctttccccttgatgaagtattgtctagcttgccagcagctgctcaagaaactaatgtatatacggattcattaaagcgattgaatgaattaccacaaccgcctgctccttctaaggttaatattgagattgccgctccttatcatcttaaaattacagatgtttattatcgctatcctaaaacagagaagatgatcttgcgggggattaatcttgatgttaatccaggtgaaaaacttgccattcttggtcgcagtggggctggaaagagtacgttagctagtttaattcgtggagaccggaagcctacttcgggcactgttactcttaataatgtgccaacgggtgaatttggtgatgagatttcgaattatattgggatcgttcaccaatcgccatatttgtttcataccacaatcttaaataatattcgtttgggaaatgaagatgcgacagaggatcaagtatgggatgttcttgaacgtgttgggttggccgctatgattagacgactgccaaaaggacttcatacgatggttgatgaggcagggttacggttttctggcggagagcgtcaccggttgtctcttgcccggattttactcaaggatgcgcccattatccttttagatgaaccaactgtaggtttagatccggtaacagaagaaaaggtaattgagacttttatggagcagctacaaggaaaaactttgatttggattactcaccatttacaaggcatagaaatgatggatcaagttgtttttatcgaggatggtaaaatttcaatgcaaggcagcccggcagaattacaaaaaacaaatgaacattaccgggcgttaaaaatggcagatgagggtatctagctagtttaggaatgttataataaagtaggactattaatgaagggatgaatagtaatgaaagaagttgttgtacttggagctggttacgctggcttaaagacggtcgtattattacaaaaaaagctaaaaaataatgttcatattacactagttgatcgtaataattatcattatgaagctactgatttacacgaagctgctgcgggaacgcaaagtgcttcaaggatcacttatccaattagtgatgttattaatccacaaattactacctttatccaagatgaagttgtaaagatcgatcctgataaaaagacagttaaacttgctggtcatgaagagctactgcactatgattattgtgtattaggactcggctttgtttcagaaacctttggaatccctggtgctgaagaaaatgcattaccgatgactaatgttaaagaagctttagcaatttatgaccatatcattgccaaaatgaaagattatcgtaccactcacaatcctgatgatcttcaaattgttatttgtggtggtggatttactggaattgaattagcaggggcgcttgttgacgctcgagcaagttatgccaaaatcgctggagtttcaccagatgaaattaaaattacgctgattgaagcttcaacaagattacttccaatgtttagtgaaaaacttgccgaatatggggtaaaccttgttaagagccttaacgtgcaattgcttgatggttcacgaattagcaagattgaacctgggaaggtcatctacaagcatggagatgatgatgaagagtcccttaatgctggtataattatctggacaactggagtaagtggtaatccattgatggaagaatgtggctttgatgctaagcgtggccgggtaatcgttactgaccacttaacagatcctaagcacgatgatatttacatcattggggatgttgctgccgtaatgccaccggatggtaaacgcccatacccaactactgcacaaatcgctctagcaatggctgattacacggctgaagacattgttagccgtattaagactggcaagcatgaagctaagccatttacttacaagtccttaggaacagttgcttccgttggtaatacgcgggcatttggtgaagcaatgggtcatgaattacgtggatatcctgcttcagcaatgaagaaaattattgctgaccgttccttgttagaaacaggtggtttgaaagagctatttgctaaaggacgctttgacttatatcactagaaaatgaatgaggctgagaaaaaacttttgtttttcaacagcctcgtttttatgcttatatgctaaaaaggtatggttataataaataaagggtgaaataaatgattaaaacttatgatgaagcattatcttttattcatggacgaacacaattcaagaaaattccaacactcacacggatgaaacgattcttggcagaattagggaacccacaagaaggacttaaatacattcacgttacaggaactaatggtaagggatcaaccgttgcaatgatgcggtctgctttactggaaagtggccttactgttggaagttttacatcaccttttattacacgatttaatgaacgaattgagtataatggaatcccaattagtgatgatgatcttttaagattagttcaaaaaattgcccctgttgtcaaaaaacttgatgatacattagaaacaggcggtccaactgaatttgaaattgatacagcattaatgttttgctacatggctgaaaagaagcccgatgttatattgcttgaagtggggattggggggctatacgattctactaatgtaattacgccagttgttagcgtgatcacgacagttggctgggatcatatgaagtatttaggtgatactttagctaagattgcggctcaaaaagcaggaataatcaaaaaaggtgtcccagttgttttaggtgctctcccaacagaagcgcgcgaaactattctcgcagatgcaaaggagaaaaaatccccggtttttgaattaggaaaagactttactgttcacaaacttaatggtcatcagttccacgcaaaaattcggtatcaaggaaaaaatctgaaaaaaatagaaataattcttgggttgccaggcgactatcagatagaaaatgcagcagttgctttgatggctcttgagctttttatggagaagcgtgggctggcaattgatcgtcgtgctttgatagcgggattagaaaatgctgcttggccggggcgattagaagaaataaatactactcctctggtcttactagatggcgctcataatcttcctggtgtccaggccctggttcatactattaagaatgattttgccgatcgggaagtttacctcttggtagcgattttggctgataagcaatatgaattaatgcttggggaattagcaagcttggggaatattcacttaactgttactcactttgctggccccggtccaaaaagaccaagtgcagacttagcaaaagcagttgctgatattccaactaaatatcccatccagattattaacgactggcgattaggaatcgggcaggtggcaagtcaaatgagtgcggacgatgtaatgattattactggttctctttattttgtttcagatgttcgtagattctttttaaattaaaagtgtaaaagcacaaattttccgtatttaaatatatagagtgtaaaaaggagaattatttatttatggaaaatgaagtgattaacgaatatacaaaattagtctggacggctattcctgataaaccgggaacaaagaagcaggaattatgtcaacgtttcttacgtaagtgtcctactcccctagcaattaaacggctttcacgtattgaaaaaaatgagataaatgaatgggcgccagaaatgcttaacttttttgctgctattgaattagggaagatagtaactaaaagtcatgaagaaattattggccatgcttattcgagtatcgaattaggacgcaagatggttgaccattttcaaagtgaagagcaagaaagtgtttgtattgcctgtacagatatccataatgagataattgattggaaaattttgtttgtaggcggcggatgcgaatgtattctttatcctgataagatttttcaatatgcgctccggtgttcagctcaaggaattattatgatccacaatcatccgacgggagacattcatccttctaagcaagatgaatcttttactcgccgcttagaacgaggatgtgagattattggacttcatttagttgactttatgattgttggtcgtgatacataccatagttggcgtgaagctagtctcgttaatgagcttaaaaagtaaagaaacttttaatttattataataattacgctttctttgttcttattaatgtatattaatgttcgtatgtaccgagtggctatggtataatatgcacgatattaatttgattttaagacgaagggaagaagcagattgctaggaattggaacaaaaaatcttggcattgaccttggaactgctaatacaattgtctaccttgaaggtaagggtattgtattaagagaaccatcagttgttgctcgtaattctaagactaacgaagtaatcgctgttggcagtgatgcccgtgatatgatcggacggacgccagaaagcattgtggctatccgaccaatgaaagacggtgttattgctgattacgacacaacggttgcaatgatgaagtattacattgataaagcactaggaaataatggtaagccatatgttatggtatgtgttcctagtgggatcacggaagttgaaaagcgggcagtgattgatgctactcgagttgcaggtgctcgtgatgcttatgttattgaagaaccatttgcagcagccattggagctggattaccggttatggatccaaccggtagtatggttgttgatattggtggcggtactactgatgttgctaccatttcattaggtggtattgtctcaagccggtccattcgaatggcaggagataagatgaatgatgcaattgttcaatatgttcgtcaacatatgaatttattaattggtgaacgaacagctgaaaagcttaagtgggatattgggtctgcatctgttgaagctgctgaagaaatgggaacaacacaagttcgcggtcgtgatcttgtaactggattgccaaagacaatgcaagtatctgcgaaggatgtttcaacggccctccaagatgttgttgatagtattattacggcaattaaaggaacacttgaagaaacttccccagaaattgctgctgatgttattgatcacgggattgtattaactggtgggggcgcattattaaagcatttaccagatgttattgcagatgcaaccaaagtaccagtatttattgctaatgatccccttgactgtgttgctattggtaccggcgagtcattaaagagtattgatgtaatgaagaaaaagtaaaatgattctctgacagtgacgttagcgatgaatcatcattagtactaactaatgattaacggggctgagtgccaagcagaattgtttggcaggccccgtcttaattaccttgtgtatgcattggagggtcataatgcagaaatttttttccaatcgccgattagttattgctgtgataattctagttgtctgttttggactaatggcaggttctgtttctttacggaatagacgaaatacaccaccgattatccaacaatttggaaatgatattgttggctttgttgatagtgcagttgctctccctgtaaattgggcacagacaagtataagttcaataaatgggttgatgaatacttattctgaaaaccgtgaacttaaacagcaagtaactgaattagcacaaactaaagtccgtgatcagaccttagctcatgaaaataaacaattaaaacaacagttaaaacttaataattcaatgaccgactataatacagttacagcggctgtgttaatgcgcacaccatcttcatggcaacgacaactcgtaattaataaaggtcaatctagtggtattaagaagaatatgcccgttatgagtggtagtgggttaattggtcggattacagaagtaaataaaactaatagtaaagttgaattattgagtgatactagtgaatcatcaaaccgttttgcaattacccttaatggtcaaaatgggaaggtgattaacgggattatcaccggatataatgcaagaaataacgagcttgaaatgggacaagtaacttctaaagctaaaataaaaaagggtacccgagtagtaaccagtggaatgggtggtgtgacacccaagggactttacgttggtcgcgtgtcgcatgtcggtaaagatgattatggcctcgcccagaaaatctatattactccagcaacggactttaatgatattaatattgttacagttgctgaagcggcttcgcaggagtgataaattatgtatcgtttatcacgcttaaaatatatattcccaattggcttatttgtatgtctgtttttggacggagccttaagccatgtgtgggcaccattatttttcagttatccctattcaatggtgagtgaacttgtcttactatggttagtcttatcgtacttctttcaagatgatattgagattccattaattccatttgcaattgctgctggtgcagtttacgatttatacttttcgggaattttaggattgtatattttcttgtatccattagtagtcgaaataactaaaattttatctcgttattttagttcatcatttctttcgatgattatgattttctttgttgatattgtcatttttgagacgtttaattattgggcatattatttagtgaatattactaatgttggttttggcgactatcttatttatacgcttgctccaacgttagcattgaatttaatttattttgttgtcctcttctggccaattcgcgcaatatatcgctgggcattagacgatgatcaaatttaaaattagtgcttgacacaatagatattccagtataggatatttacaacatcataaatgacagtgaacagactagtagagctttaagcattgcaaagagagtccttaatgatgggaagggatcgatgctttggcttgaatcacatctgtgagttggccttctgaaagccatagtaggaagacccggggaagcccgttacagcgcggagtttattttaatgaactcactaaggctattattcgtgagaaaatagcaagatgaggtggaaccgcggaaacgccctcgtagccattttaggctcgagggtgttttttgtttcattaaaatagacttattaaggcaaatattgtgaaatgtttgtaaatatgaggtggaaccacgatgtactcgtcctctaggaggtatctcctagaggatttttcttttcctgttatttctattagtcaagaatttaaggaggcaatagtaaatgtcaatgcaatatataagtgaaattctaccttcattattccaaggggctgctcttacattacagattttcttctggacattagttggatcgctgccattaggaattttggttagcttaggacttacttctaaaattaagcctttgaagtgggtgttagaaatttatgtttggttaatgcggggaacgcctttgctacttcaactaatctttgtattctatgggttaccaattattggcattgtttttgaacgttacgatgccgccctagttgcttttattttgaactatgcagcttattttgctgaaattttccgtggtggtttccaatctgttgatcaaggtcagtttgaagcagctcgtgttttacgcctaagctactggcaaacccttcgtaaaattatcattcctcaggtaataaaaattgttattccatcaattggaaatgaagttattaacttagtaaaagattcatcgttagtttacgtaattggtcttggtgatttacttcgagcaggaaacgttgcaacttcacgggatgtcacacttgttccattgatgttagtcggattaatctatttgatccttgtaggaatttgtacattaattctacggcaagttgaaaaatgttatgcatacttcaagtaaaggagggaatctaaatgttagaagttcgagatttaaaaaagagttttggtgatcggcaaattttagatggggttaatttaacagttaaagatggtgagattctttgtattgttggtccatcaggtgctgggaaaacgaccttacttcgttgtattactggactggaaactcccgatagtggtgagtttttcattaacggtcgtcgctttgatcctcagggaacagatgcagctgaccgagtaatcggtgtggtttttcaagactttaagcttttcccaaatctttcggtaatggaaaatatcacgttagcgccgatgatggtattgaaaaaggataaacaagaagcaattgctgaagcgcaaaaactgcttgaagaattagggcttaataccaaaggaaaattgtacccctaccaactttcgggtggacaaaagcaacgggttgccattgctcgtgcattagcaatgaagcctaaaattttgtgctatgatgaaccaacatcagcgcttgatccaaacctccgaaaagatgtggctaatattattttgggattaaagaaggacggaatgactcaattaattgttactcacgatttagaatttgcggaagatattgctgatgatattttacgagtacaaccacttgatcaacgtcagaataaatagtgaaaggagatatactgatgaaaaaagcgaaagcaatttggttacttattttgttagtagtacctgttctccttcttagtggctgtgaaagtgtaacaaagcgtgctgatacgcaagatacatggaaccggattgagcgccgaaaaagagtaattgtcggccttgatgacagttttgttccaatggattttcgccaaaagaatggcaagctggttggttatgacgttgatcttgcccgggctgtttttaagcagtatggaataaaagttgattttcagccaattgattggtcaatgaaagagactgagttaaaaaatggtacgattgacttgttatggaatgggtattctgttaatcctagccgtgccaaaaaagttgcctttagtcgttactatttagagaatcggcagatattagtaactaaaaagaagagtaacattaaaaatctgaacgggatgacgggcaaaacactcggggtgcagaatggttcaacgggagtaaccgttttggatgagaagccaaagttattaaaggataaaataaagcaccatacaccagtactttatgatacatttcctaatgcatttattgatttaaatgcaaatcgaattcaaggaattttaatggacgaggtttatgctaattactatattaagcaccaaccaaatagtaattcgtatcgcacttatattagcaaagagctgccaatggaacattttgcagtgggaatgcgaaaaggtgacaagaccttaaagaagaaaattaatcaaggcttaggtaatttgcagaaaaatggtgaattacggaagcttaatgaaaaatggttcggtcaagataataactacttgggaccggataacactaaataaaaagagcagggacttaggaaatagtctctgccctttattgtttcctacaaacaaattaataaaaatatgatgaatttacgtaatcggtttgtaatttagtcatatttaacgtatcattattcagtatgataattcgaatgtaactaggttgcagctagtggaacccctcttgctgcattttatattgaagggagaaagagaacgtggattttaatcttgctcgtggcgtggacttgcacattatacccacaaaacaatttaagatgaatcacgtcttaatagattttgcgactccgcaaacaccgacgaatgctactgcacgaaatttattggcaaacctattagagaccagcacgcatcgctatccaacacagacggctttggctcgtcaactggcatctttatatggtgcttatgttaatttatatgttaaccggctggggacattgcatactgttcgattgcgagcaagttttgttaatgatcgctttgttgatgaagatttatttgaaaagattagtagcttaataaatgagatcattttctatcccctaatcgatgacggggaatttgatggtcctacttttaggattcaatctaataatttaaaaagtgcgataaagtcgctttatgacgataaacaatttttggctaatcaacgtcttatggacttgtactaccaaaatgattctgtaatgaaggttcctagtttcggtcaaattgctgatcttgagaacttaaatgctaaaagtttagtgtcaacgtatcattcaatgattaatgaagataaaattgatattttcgtgttaggtgacattgatccgatgcgtgctcagcaagttattgctaagttgccttttaaagatcgcgatattgctaataattcacctttatatcatcaagcattgtatgatcaagttcaaagaaaacagaataccaacaagtaaatcaggcaaagttaaatttggcatattctttacctgtctattatcatgatgctgattactatgctggtttggttttcaatgggctttttggtggcacgccatattcaaaactttttacgaatgtccgtgaaaaagctagtttagcttattatgcctctagccggctccttccatttaatgggattataagtgttcaaacgggaattcaagcgagtgatcaagaaaaagttcaaaatatgattcaggaacaattgactgccttgcaaaatggtgattttactactgagacgctgagtgaagttcaagatagtttgattaaccaataccgtgcaggtcatgatttggcaagtaatgttttggagcaacaattagttaccaaattagtcaatgaatcggataagaactttattactgaaataaaaaaagtaaccatagctgacgtcatgcgcgttgctaaacaaatgaaacttcaggcagtttatttattaagtggtgagaaataattatatggatagagaagtttatcaaaaatttaaccagtccatttatcgtgaacaattatcaaatggtttgaaagtccagctcttaccaatggaaggctaccataagacatatgctattttaacagctgattttggctccattgataatcattttataccgtacaatcaaaaggaggcgattactgttccagacggggttgcccacttccttgagcataaaatgtttgagaaaaaagatcatgatgcctttgatttgtttggtaaactaggagctgattcaaatgcctttactagttttactcaaacaagttatcttttttcgaccactagtaacctccatgagaatttagatgttttgttagattttgttcaagatccctactttactgcagagacagtgaaaaaagagcaggggattattggccaagaaattcaaatgtatgaggatgatccgagttggcggctttacctaggtattttaggcaatttatatcccaaagatccaatgcggattgatattgcgggaacggttgaatcaatcagtcatattacaccagaaattttgatggatagttaccggactttctatcaaccaaccaatatgaaccttttccttgtaggacgcttagatccagaagaaacaatggggtggatcaagcaaaatcaagaacaaaagatttttgctcccgcagagacaccccaacggttatttagcttgaacgatccaactgctcatgatgtaattccatttcgttcattaacgatggatattgttcgtcccaaagtgatggtaggtttacgggggaccaagcaatttgatgatggtaaagaacggctccactacaaattagcaattgatcttttgttagatgttttgtttgacgatacctcagataattatttgcgtttgtataataatgaaacattagatgacacgtttagttacaattttgaaatgcaacggggctttcactttgcgtactttagctctgatactgatcagatggaacgctttgcagatgaaatcattgatattcttgaaagtgctgaccagcaaattgaagcggcgcggacaaggtttgagggaattaaaaaggcagaactagggcggttaattggcttattagattcgccagaagcaattgctaatcgttatgctggaaacctctttgccggtgctagcttgatggatgagatagcgaccttggaaactatcacgattgatgatctttatcaagttgcaaaagagttcattactcctcaaggtatttcggtataccaagttgttccgcaacatcaataaactaaacttttcctatagatttattccgataagctaatatataattgagcatgatataatatccaagagtaaagataaatgaaaatggagatagaataatgagtgagaacgagaacgatcaaaaacgactagaaatcggtaaaattttacgaaaagcacgggaagaaaagggctatacccttgatgaccttcaacaaatgactaagattcaaaagcggtatttaatcgcgattgaagatgaaaattttgatgaacttcctggtgacttttatgttcgtgcgttcattaagcaatatgccaatacagtgggcttagatggtaatgaattattgcaaaaatacgatgatcaattaccacagactaaaacggaagagtattccgaccacttggctcaagcagttgaaactcgtgcaaaccaacgaaaaactgttagtgggagcgtagataaagttcgtaactacatgccaacgattattattgcttgtgtgattgttttagtgttggcagctatttggattacggccattgctcgcaatcatcgcgattcttctacacggattgataatagttcagtatctgtttctggagagagtcgtaagaaggcctctacctctgctaaaaaggcaagtacaaagcaaagcaaatcaacggcaatcaagcttcaagaagcacctaatcggaatgacacaagcgttacttacacagcaagtcaacttactaaagacacaacgctacaaattgaaccaagtgatcgttcttggatgcaagtaagagcaaataataatgatttattaaacagaactttgaataacaatgaaaaaactagtgtgaaaataagtcgtgatacaacttcattaataatcacggttggcaatgcccgggcaacaaaattaaaactcggtaatcaagaaatcgactttactaataatggccgttaccagaacacgcggaatgtaacgattaactttggacgtacccaaacaagcagcagttcagcaagtcagccgtcaaatagctcaagccaagcttcgtcatcctcggcacgtcctaataatgctactcaaccgtctgctgctaataataacagtcgtcctcagacaaatgctagtcaacaaagtaatcaaccaactcgttaattaagaggactaaaggagttagaacattgaatttaccaaataaactaactgttatacgtttaattattattccctttttcttattattaatggtgctgccattacaaagttggggagctgtaagtttttggggagcaactatcccgatggctcagcttattgctgctattttatttattgcagcaacaattactgataatcttgatggacaaattgcgcgacggcaccatcttgtaactaattttggaaagtttactgatccgcttgctgataagttgcttgtcatgactgcatttatcgttttaactggaaatggtgttgttccatcatgggtaacttcaatcattatttggcgagaattgtctgttacgggcttacgtttattgttagtggaacaagacggggtagtattagctgctaaaatgccggggaagattaagacaactactcagtttattgcaattatcttcttactcttaaataatgttatttttgctatttggaatattccatttggccaaataatgttatatatttgcttgttctttactatttattctggagtggattacttcatccagggacgcgatgtcttttcggatggatttaaatagaatatggagggtgagaaaaaacttttgttttttctcaccctcatgttttttatattcatagttttaagattttagtgaaaatgactatactttacgtatatatattaataggggatgaagttttatggatgcagaaattatctcagtaggaactgaaatagtccttggacaaatagttaatactaatgccgcgtacttagctaacagactaacccaacttgacttaccggctacttatcaaacaactgttgacgatcaatcacagagattagagcgggttattaattacgctttgactcgtgctcaattagtttttgtttgtgggggactcggaccaactgcagatgatgttacgatgcctacagttgccaaagtcttagggaaagagttgtggactgacgaagaacactggaaatggattcaaaaaacatttgagcaacggcaaataaaaatggaaccagagaatattcgtcaagcccagtatccacggggaggcgagccacttgccaatcctgttgggcttgctctaggatgttggtatgaaactaagggtaaagttgtggttgtcttaccaggaccacccgccgaatttaaggcaatggttgaaaagagtctgattcctaaactccagcaatattttcaaacaggaaaacaaattaccagtcggacattaaactttttagggcggccggagtcacaattaatggatgaaattgaagaggctactaacgatataccagggataagcattacttcttatgttcaaccaacggcaattcaggttcgactcaccgtgcgtgacttaccagtggttgaagctgaagaaaaaattgatcaggcacaaagagcaattcttgcagttgaagaaccatttttctttggagcgggggatgaccttacacttgccaaagtcgtcgttgaacaattaaaaaatcgcggatggaaattgacagcagcagaaagcttaacaggggggatgttccaaagtactatttgttccgtaccaggagcctcgactgtttttaatggtggttttgttacctatgctgctagtgcaaaagaaaagttattaggaattccccacgacactattgaccaatatggggtagtgagttctgaaactgctgcggcaatggcagaagggtgtcgacgaaaattaaatgttgaagttgggattggctttactggtgtggccggcccagatatgttagaaggacaaccagcggggacggtctggattggactagcaatgaagggatgcccaactaaaaccgttcaattacatcttgcatcctatgttggaagacaggcgattcgtacattaagtgttcagtatggacttcaattaatttaccgtgaactaaaaaaataaacgaacttttgttcacttttttcttgtttttttggctaaaactgttattattagttatcggataaaccgtaaaaaaaggaggaatttgatttggctgaccaacgaaaagcagcattagatgttgctatcagaaagatcgaaaagaacttcggtaagggctctattatgcgaatgggtgacgccactgatatgaaggttgcttcagtttctagtggttcccttgctattgacaaggcacttggaattggtggatatcctcgtggtcggatagttgaaatttatggccctgaaagttctggtaagactactgtagcattacatgcagtagcagaagtacaacgtcaaggcggaacagcagcctatatcgatgctgaaaatgcgcttgatcctcaatatgcagaagccttgggtgttaatattgatgacctattgctttcacagcctgatagtggtgaagaaggattggaaattgcagatgcattgatttccagtggggcagttgacttagtaattgttgattcagttgcagcattagttcctcgtgctgaaattgatggtgatatgggtgatacccatgttggattacaagctcgtttgatgtctcaggctcttcgaaaactttctggcgaaattaataagacaaagacaattgccatctttattaaccaaatccgtgaaaaagttggagtgatgtttggtaaccctgaaacaacaactggtggacgggcacttaaattttactcaactatccggatggaaattcgtcgtgcggaacaaattaagaatggtacggatgttattggaaataaagctaaagtaaagattgttaaaaataaggttgctccgccattcaaacggtgtgaagttgacattatgtatggtgagggaatctctaagactggtgaattgctggatatggcagttgaaaacgatcttgttgacaagagcggtgcatggtactcatatggtaatgagcggattgggcaaggtcgtgaaaatgctaaaaagtggcttaaggaacacccagatagcatgaatgaattaatggataaagttcgtgttgcaaatgggatggaaccgttaaatgaaaagtcaacgaaagaaactgctgatgataaagccagtggtaagaccagtgaaaataaacaagaaacaattgaagaagcaagtaaagaataaataataatatttgaagttgaaattccctaattttttagcattaatagctgaatattagggatttccctttttatactggctgtttaagcaattgataaattcaatagttgacaccttagtgtggcaagattaaaatttaacttgtgtgatgttttttgacgttacacggtgaaattaatttattcataccaacaacataatagttgaagcggaggtgaaatagtgaaaattttaatgttcgccgcgcttgctatggttgtcggaattattgtcggctatgtaattcgcaaggtttcatatgaaaaacaagttgcagaagcacataatgatgctaaaggtattatttctaaagcaaaacaagaagcagtaacggcgaaaaaagaagctattttagaagcgaaagaagagagtcatcaataccgcgagagagtggaagatgagttaaaacagcggcggagtgaggtccaacgacaggaagaccgattactccaacgggaggcttctttagatcataaggatagcgctctagaaaaaagagagaatgcagttggtgttcgtgaacgtaaattagatcaagaaaaagagcagcttcatcaatcaaaggaacaagcagaagccttaattgaacaacgcaaacaagaagttgaaaaagttgctcaaatgtcacaagaagatgctaagcagttattattatctgaagtaaaagaacagttaaaaactgaacgagcagtaatgattcgtgacagtgaacaagaagcggaactttctgcagaacgtaatgcaaagaaattaattgttgaagcaattcagcgtagtgctgcggatgttgtctcagagacgactgtttcggttgttaatcttcctaatgatgatatgaagggaagaataattggtcgtgaaggtcgaaatattagaactttagagacgttaacaggtattgatttgattattgatgatacgccagaagctgtcgtattgagcggctttgatcctgtacgacgtgagattgctaagatcgcgcttgaaaaattaattcaagatggtcgtattcatcctgcacgaattgaagaagcagttgataaggctcgtaagcagatggatactcaactacgggagactggtgagcaagcattgtttgatctaggaattcattcaatgcatccagacctaattaagacggtcggaagaatgaagtaccggactagttacggtcaaaatgtcttagaccactcaatcgaagttgctaagttagccggaattatggctgctgaacttggggaagatgttacattagcaaaacgtgctgggctcctccatgatattgggaaggcaattgatcatgaagttgatggttcacatgttgagttaggtgtagaactaacccgcaagtataaagaaaataaagtggttatcaatacgattgcttctcaccatggagatgtccctgctaattctgtaattgctgttcttgtacaagcagcagatgcaatttcaggggcccgtcctggtgctcgaagcgagtcattagaacaatacattcaacgtttaaagaaactagaaagcatagcaaacagttatgatggtgtcgaccatagttatgcaattcaagctggtcgagaacttcgcgtgattgtcaaaccgaagaagatttctgatttgcaggcaacaactttgtcacatgatattaagaacaaaattgaaaagcaattagaatatccaggacatattaaagtaaccgttattcgggaagttcgagcagttgattatgctaaataaactgatttttcagttcctataaagaggctgggtataaccttcagtctctttattattttaaataacatccatcatttatagagatcttgcagcaaatttagacacaaaatataattagtttattattaagattaaaaaatatattaatggggtgaaatttagtggcaaaaaaaacaacaccgatgatggaacaatatcaaaaggtaaaagatcaatatccagatgcctttttattttaccgacttggtgatttttatgagctatttaatgacgatgcggttaaaggagcgcaacttcttgagctaaccttaacaacgagaaaccatagtgcaaaaaatccaattccaatgtgtggagtgccccatcgcgcagttaacaactatattgatattttaattgataagggttataaagtagcaatctgtgaacagatggaagaccctaaaaaggcgaagggaatggttaaacgagccgttacccgtttaattacacctggaacgcaaatggatttaaatggtgaacaggcacgtgataacaattatcttgcagcgattagtggacaaaatggggtatttagtattgcctataccgacttatcaactggggagcttaaaacgacaagcttaaataatgcaaatgacgcggttaatgaattggttaatctccaaagcaaggaagtagttgtggacggtgagttgccagctgaaataacaactcagtttaagcaacgaaatattcttcaatcacatcagccaacggtccttaaaaatgctgagatcagctatcttactcaagaccttgatgatcaagcccaacagcacgttgttgcgttacttgtgtcatacttattaacgacccaaaagcgctctttggcccacctgcagaaagcaattgcatatcaaccaagttcttttatgaagatcgatcactattcaaaaacaaatctcgaattaatgcgcaatatgcgaagtgggaagcgtcaggggaccttggcatggcttttggatgagacaaaaacagcaatgggcagtcgtcttcttaaacggtggattgaccggccgttgattaatcaaaatgcaatcagtgaacgacaagataaagtccaagagttattagaccactattttgagagaagtaatttgcaacaagagttaattaaggtatacgaccttgaacgcttagcaggacggattgcctatggaagtgttaatgggcgtgatcttattcaacttaagacttccttaaagcaagttcctaaaataaaatacgttttagaaacccttgattcacctgtctttgaagaattgcaaaaacaattggatcccttggacgatgtggcagatttaatcgatcaatcaattgttgaagaaccgccaattgctgttactgaaggtggcgtgattaaggatggctataatgaccaattagaccaataccgtgatgcgatgaataatggaaaacagtggattgcggacctgcaagaacatgaacggaaattaacgggcataaataacctcaaaattggttataatcatgtatttggctattatattgaggttacaaaagttaatcttaataagcttcctaaagatcgctatgagcgtaaacaaacattagttaatgctgaacgtttttctactccagaattaaaagaaaaagaggcattgataatgggagcgcaagaaaagtcaacagccttggaatatgatatttttgttaaaatccgtgaacaagtcaagggacaaattacacgcctgcaaaaattagcacaacaacttgcggaattagatgtactccaaagctttgcggttgttagtgaagactaccactttgtccgtcctaaaatgaatactggtcacgtattaaaaattaaagatggtcgtcacccagttgtggaaaagtttatgggacaccaggaatatgtgcctaataatgttttgatgggagaagataccgatattctcctgattactgggccaaacatgtcagggaagagtacctatatgcgtcagctagcattgattgcggtaatggcacaaattggttgctttgtccctgctaaatccgctgaattgccaatttttgatcaagtctttacgcgcattggggcagctgacgacttaatctctggtgaaagtaccttcatggttgaaatgatggaagccaataatgctttgacccatgccacggatcgtagtttgattctctttgatgaaattggccggggaaccgccacttatgatgggatggcattggcgcaagcgattattgagtacgttcatcagcatgttcgtgctaagacgctattttcaactcactatcatgaactgacagctcttgagaatagcttgacgcggcttaaaaatgtccacgtaggagcaacggaaaaagatggggagttagtattcttgcataaggtaagtgcaggtcctgcagataagtcttacggaatccacgtggctaaactagcgggaatgccatccttattgttaaaacgtgcagatactattttgcaaaaattagagcaaaaggatgtaaaactaccgaatgcgcctaaaccggcaacagataattaccatacagaaccaatatcagcaaagataaatgaagcggcaccggtaaagaaagagtctgcaccagttgttgaagataatggtcaacttgaattatttgctactcaacctgagaaaaaagaatcgagtgttgatcggcggattttacatcaattaaaagaacttaatttaatggggatgacacccatggatgtaatgaatcaaatttataagtggcagcagaaattgaaataaggtgatatttaatgggaaagattcatgaattagataatattttagccaatcaaattgctgccggtgaagtaattgaacgtccagcatcaattgtaaaagaattagttgaaaattcattggatgcccatagtcaccgtgtagatattattgttgaaaattcaggtttagacagtgtgcgcgtgattgatgatggtgacggaatcgctgctgaagatattagactagcatttcaccgtcatgcaaccagtaagattaattctcgccatgacctctttaaggtgcagacgatgggctttcgtggtgaagcgttacctagtattgcttcagtcgctgatgtaacgcttacgactgcgcaagctggtcaagaagaaggaacaatgattcatttgcgaggaggaaaagaattagtagtgaagccggctggtgcgcgtcaaggaaccgatattaaggtaaccgacttattctttaatactcctgcgcgattaaagtacttaaaatcacctcaaacggagctaaccagaattacggacatcattaaccgacttgcccttgcaaatccagcggttgcttttagctttacccataatgggcgggaattatttcggtcggcaggtaataataatttacaacaagtagttgccgcaatttatggcgttcaagcaggacgtaagatgcttgagataagtggtgcagatgatgattttaaggttagtggttttgtttccttaccagaattaacacgtgcatcacgtcaatatataacaatcacaatcaaccatcggtatattcgtaattttgaattaacaaaggcaattactcagggatatgaatcaaaactaatggttggtcgttatccgatcgcggtaattaacattgatctggaccctgttttagttgatgtgaatgtccatccagctaaacgcgaggttcgtttgagcaaagaacagcaattaataaaattgattgctgaaacgattcggcagcgaatagcagttgagaacttgattccggatgtcgatgctgaccaatttattcctaatgatgatgaggtagcggaccttgatcgccggttaaaggaagcatcacctgtttatcacgccgcaccgatttcggcagtgccggcaacagaaaaggcagcaactgagatttcaactccagcagctgataatccagcacatgctgacgcgcttgatagtgagattccagcaccgatcgttatccaccatcttgaagatttaaatacgctcgcaatgcaaaaatttgatgagcgttatcaaaatgaaggtgaagttacgccattttctgctccagttcccactatgactaagaagccagtaaaacctgcaaatattgaattggatgttcatgataaacaagatcagcagcaaaatcggtttcctgatcttcaatatattggtcaacttcagggaacctttttattagcacaagcaggagatggtctttacattgttgaccaacatgctgctcaggagcgaattaattatgagtattaccgccaaaaaattggggaagtgagcgctgatcagcaaaatttcttggttccgcttgttcttaattattcgactgtcgacgcaatgacaattaatcagcatctcgatacgcttgcagcggtcggattagaattagagtcatttggtcaaaatagttttattttgcgctcccatccaacctggtttaaagaggggcaagaagaagacacggccaaagaaatgattgattggttaattaagaatggaaagctaaccgtcaaagaatttcgaatgaagacagcgattatgatgagctgcaagcgggctataaaggctaaccaccaccttgacgaacgggaagctaaagccttgctgaaacggttgccgcaatgtgagaatccttttaattgtccacatgggcgtccggtaactgttcattttaatgatcaggatttagaaaaaatgtttaaacgaattcaggattcacacaccccatatgcagacgattttgatgatcatgaattttaaggaggaactaccttgtacgaatacttaacaggccttgtaactgttgttgcaccacaatatatcgttgttgatgttaatggggttggctataaattattagttgctaatccctatcgttatcaagaggatcggactaagaaggtccaagtatatgtttatcaagcagttcgtgaagataatatttccttgtttggcttcacagatcaaaatgaaaaaaaactatttatgcaattaatcaatgtttctggaattgggccaaagagtgctttagcaattttagcgaaccctgatcatcagggacttgttgatgcaattactaataataatgttaactatttaactaagttcccaggaatcgggaaaaagacagcttcgcaaattgtgttagacttacgtgataagctcactaatgaaagcagcagctcattatttgcaacaactcagcttaccgttgatgcaacagtaaatcgtgagttgaaagatgctttggaagcattggctgcattaggatacaaggaacgggacattaaaaaggttcaaaagacattaatgaaagaagaacaaatggcaactgatgaatacttaagacaagcattaaggttgcttaactaggaggtgcaagacttgtggaaaatgatcatggtattttatcagatcacccatcaggagaagaagaaaaccaagtggagataactcttcgaccacagaaactaagagaatatattggtcaacctaaaatcaagcacgaactagaagtatatattaaggcggcccaatcccgagaagaagcccttgaccatgtattgttatatggtcctccaggattaggaaagacaactttagcgatggtaatagctaatgagatgggcgttaatatcaaaacgactagtggaccagcgatcgaaaagccaggagatttggttgctttattgaatgagttgaaaccgggggatgtcctttttgttgatgaaattcaccggttacccaaagttgtggaagaaatgctttattcagcgatggaagattactatattgatattgttattggtgagggaccgactgcgcaccccgttcattttccccttcctccatttacattaattggggcaacgacacgagccggaatgttatcggcaccattacgtgatcgtttcggaattgttgaacacatgaactactatactcaagatgaactgacaaaaattatttttcgttctgccaagattttccatactagtattcaaaatgaaggggcccatgaactatctcttcgttcacgtggtacgccgcgaatcgcaaaccgccttttaaaacgggtacgtgattttgcccaggtagcagggaaacaaagcattgattcagcaattgttaagcaagcattatcgctgctccaagttgatgatcggggcttagatgagattgatcggaaaatgttgttaacgatgatcaatttctaccatggaggtccagtgggattaaaaacaattgcagcaaatattggtgaagaaactaatacgattgaagaaatgtatgaaccatatttgttacagatcggctttattagtcgtactcctcgcggccggttagtgacaccgacagcatatgaacatttaggaattgaatatccaactgatagaaattgattgaggaaaattatgagtaagttagaatttacaattaatcaaagcgatggccaagcacgaaccggaattttgcagattaatggacgacaaattgaaacaccggctttggttgccagtggagatgaactagcaaaattatcacccaaccagcttaatcaggctggtgtaagtgcagttaagacaagtggattaaagcgttggctaaaatatgattcgatgactgaaaaattaggagacctccaccaactttttcagtgggatggccttttatttgtggatttagaaactgaggaggcctatcacttagcaaagccacgcgggaaaaaacatgatggcgttcgttttcatgatccgataacgggacaattaaaattctggcaaccagaaactgctcttcaagttcaagaagcgctcggggctgatatttttcaaagctttgaccaagcaacagattattatgcgccagttgatgatttaaaagtaggggtaaaacaaactaataactggttatctgttgttaagccccaaaaaggccaagcccttggttcaattgttggtggcggcttaaaagatttgcggacagccagtattaaggcggtcgatgaggctgggttaagcggctatcggttgagtgggatccctagcagcttagatgatcaagagtttagtcgaatcattaatgaaattacgcctaaactaggagaggagaaactgcgctacctccctgctgcactttcttttgaccagctgatagaggcaattttagcaggagttgatttaattgatagcaatctagcagctaaaaaagcggctaatgggattgcattagttaatcaaggagtgacagttcttcatcttgatcgtcaacattttagcttcgattcacaagtgcttgatcgtcaatgtgcgtgtgcaacttgtcgcgcgggctattcaaaagcactactccatagtttaattaccaatcaaagtttttacggtgaacaacttttgctgcagcataatctgtttaccctcaataaattaatgagtagtctccgacaagcaattaaaaatcatcaaacaaaaaatttgttcaagaattattgcagaatcaatagagcatatagctttttatggtaaagtttgttaaagttaatattagttaactttttgaagggatggataaactgtgaatagtttgagtagttttgttcttggtgctgcttcatctaataatgcaagtggttactcaagaattattttaatcatcttaatggtagcattaatgtacttctttatgattcgcccacaacaaaagcaacgtaaagaacatcaagagatgatgaatgaattacacccaggtgatgaagttgttacgattggccggatgcatggtaagattgattcaatcaataaggctgaccggacagttactttagattgtgaagggatctaccttacttttgatatggtggcaattgcccgtgttattaaacgagcagatgcaccagctagtgaagttccccaagataataaagctgttgctagttctgccgctgacagttctgcagatgcttcagcagatagtgctgctagtgaacctacatctgcagcgagtgctagcgatgaacaaaaaggcagcgaagaaaagtaatttaatttagatgaaaatagtcgtaaacaggcgaatattttcatcttttttatttggttgttaatcgcgtttattgctatactaaaagatagtgttaaattttattcgggtaaggagaatagcataatggcagatccattaacagcaatttttgaacaaatcaaaaaatacaataaaataattattcatcggcatcaacgccctgatccagatgcaattggctcacaagttggccttgcggaaattttgcgggcttcattcccatataagcaaatttatgttgtagggaagcatattccagggtttgattggatcggtgagatggatacgattgacaatcagacattcgatgatgcattagtaattgttacggatacagcaaatgcgccacgaattgatgatcggcgctttgataatggggacgaacttattaagattgatcaccaccctaacgatgaaccctttggcgatattatgtgggttgaaccagatgcttctagctgttctgaaatgatttatagtttttatcaacgatttgcaaaagaattaactcttccccagaaggctgcccatgccttatatgcaggaattattggcgatacaggtcgtttcctttatccagcaacaactccacgaacgatgctagttgcaggttcgttaatggcagccggcgcaaatgccgcggaaattagccagcacgaaaatgaaattaccttaccagtggcccggttatcagcatacgtttatgaaaatttgcagatattagataatggagccgcatatgttatcttaaccaatgaaattttagaacaattcggattgactgaagccgggacatccgcaattgtttctttaccaggtcgaattcatgatgttattgcctgggcgatctttgtagaacaagaagatggccattatcgcattcgtctccgttcaaagggaccaacaattaatgaattagctaagcagcacgatgggggtggacatccacttgctagtggcgctaaggctaaagatgaagcagaaattaaacaagtgattgatgaattggaccaattaacacaaagttatgcaaaccaaaaatgaaagggaaatagctatgagtgataaaaaatttgctgattttcagttacaaccttatctgttaacagcaattcaaaaaattaattttcgtcaaccaacaccggtccaacaacaagtaataccagtgattatggctggacgaagtgttgtggggcaatcagcaactggtagtggaaaaacacatgccttcctcttgccgattttttcaaagattaatccagaagatcaaaccgttcaagcagtaatcacaactcctagtcgggaattagcataccaaatttataatgcggcaaagcaacttaataagtatgctcctcatcctcttaccattcacaattatgtcggtggtacagacaagcagcatcaagttgaccaattaagtcgaaaacagcctcaattggtcattggaactccgggaagagtattagacttaatcaagagtcaggcattggatattcacacagcaaaaatgtttgtggtggatgaagcggacatgaccctagatatgggattcttacatgaagttgaccaaattgccagtcattttcctgatgaccttcaaatgatggttttctcagcaacgattccgcagaaactgcgcccattcttaaaaaagtatatggaaaatccagtaattgaagagattcctactgaagcagtaattaatccagatgttgataattggttaatgtcaactaaggggcaggaccgtaaccagctaatctatcgtttgctgactcttggtgaaccatatcttgcattggtatttgctaatacaaaagaacgagcagttgaattaacccagtatttagaaaatcaagggctcaaagtagcgatgattcatgggggactggaagcccgtcgtcgtaaacggacaatgcggcaaattcgtgatcttgaatatcaatatgttgtagcaactgatctagcagctcgtggaattgatattgatggagtatcactagtaatcaatgacgacttgccaactgatcttgaatattttgttcatcgggttggtcgtacagggcgaaatgggatgaaaggaacagccattaccttatatgaaccagcagaagatgatttaattgctaagcttgaggagcgcggagttaaatttgtaccaaaagaattaaagaatggtcaactagtaactacccatgaccgtaatcgtcggaagcattataagcggcggcaaaatgaacttgatccgtcaatgaagggttacgtaaaaaagactaagaagaaggttaaacctggttataagaaacgaattaaaaaggcgattaaagaagacgaacagcaaaaacgaaagctagaattacggcataaaattcggaaagctaagcgtgcacgacaaaaacaacatcgccgtgaacgaaatgcccgttgattttaaagtaattgttcgctataatatgacacgtttgggacatgctataactaatggaaaatttcagagacagttggtaaggtgtgacaactgatttcctagccttagtgctccccattcggataatttgatatttaaccttgggcaaccaagaagtaaagaggtaaacgaattccatcgttgcaagcagagtggtaccgcgtcaatctggcgtctctgattcgcaatggtggttttttgttttagaaggggcgatttgatgaaagagttaaagaagctaaatagtgctcaagtacggcggatgtacttgaagttttttgaagagcatggccaccaagttatgccgagtgcatcattagttccagtaaatgatccaacattactatggattaactctggagttgccacaatgaagaaatactttgatgggaaagttgttcctgataatccacggatgacaagctcacaaaagagtattcgaacgaatgatattgaaaacgttggtaagactgcccggcaccataccatgtttgaaatgttaggtaacttctctgttggtgattactttaaaaatgaagtaattccatgggcttgggaattactaacaagtgatgaatggtttggttttgatcccgaacggctatacattacttattatcctaaagaccatgacgcttacaatcgctggcgtgaagtaggcgttgctgaagatcacttaattgctgatgaggataacttctgggatattggtcaaggtccatctggtccagatacggaaattttttatgatcgtggtcaagaatttaataatttagccgatgatgatccagaaaactatcctggcggtgaaaatgaacgctaccttgaaatttggaacattgtctttagtcaatttaaccatacgcctgaagatacttatgaaccacttcctcataaaaatattgatacggggatggggcttgaacgggttgtttcgatctttgaaaatgcccctactaactttgaaaccgacttatttatgccattaatcaagcaagctgaagagtttagtggtactaagaagtatggtcaaaataaagaagacgatattcaatttaagattatcgctgatcatattcggacaattacctttgcgatcggggatggcgccttgccttcaaatgttggtcgtggatacgttattcggcggttgcttcggcgagcagttgttgctggaaagaagttgggaatcgatgaaccatttttagcaaagatggttccaacagtcggcaaaatcatggaagattactatcctgatgttcttaaaaatgctgactatattgcttcggttattgaatcagaagaagaccgctttagtgcaaccttaaatggcggattaaacttgttgaataacgtgattgctgaagctaaggaaagtaagaccaacgaaattgatggacgaacagcctttaagctttatgacacttatggcttcccaattgaattaaccaaggaatatgctgaagatgaaggactaacagttgatgaaaagggcttccaagcagcaatgacggagcagcaaaatcgtgctcgtaatgcccgtgatatggataacgggatgggtgttcaaactgatttatggacttcattcaaagaagatagcaaatatgttggctacactgatttgaccgttgataatgcaaaagttatcggcttagcacatgatggtcaacaagcggatgaagcacgaccaggtgataagaacattgaactaatttttgatgtaacgccattctatgcagaaatgggaggtcaagtcgctgatactggtgacattattgataactatggtaaaaaagttggccgtgtggttgatgtccaacacgcaccaaaccagcaaaatcttcatcgagtagaattaactgcccctattaaaaagggtgcccgttacaaactagttgttgaccgtattcgtcaccttaagattgaaaagaaccatacagcaacgcacttgttagaccaagcattacggaacgttcttggtggtcatactcaacaagccggatcattagttgaagaacattacctacgttttgactttaaccactttggtcaagtaactgctgaggacctcaagaaggttgagaacatggttaatgagcaaatctggaaggaaatcccagtcaagacagttgaaactgatattgattctgctaaggaaatgggtgctatcgccttattctcagataagtatggtgataaggttcgggttgttaagattggtgactttaacactgagttctgtggtggtgatcacgttaaaaatactaatgagcttggtctcttcaaaattgtttctgaaggaggagttggtgctggagtacggcggatcgaagcagtaacttctagtgatgcctttaagttcctccaagatcgtgatgacctcttaacaaagagcgctgctagtttgaaggttgctcagattaaggaagttcctcaccaagtagaaacattacaaaatgaacttaaagaagctcaaaagcaaaatgagtctcttcaagctaagattgctgctcaacaagctaataatgtttttgaaaacgttcaagcaactaagaatggaagtttaattgctgccgaagttcaagttgctggaatgggtcaattacggcaacttgctgatgcttggcgctcaaaggctctttctgatgttctggttcttgctacagccagtgatggtaaagcaaacttattagtggctgttagtgatgataaaactaaggaaggcttaaaagccggtgaccttattaaggcgattgcaccagccattaatggtggcggtggcggtcggtcaaacctcgcccaagctggtggaaagaatccagctggaattaaggaagccttaagtcaagctaaaggttacctcgataagtaaatcaaaaatgagaaggaaataaccatctcatagtctaagagattgaaagaaaccaatttttgagttctttcaatctctttttgtaagaacttcttaaagtaataaaaaaatactatcaagaaatcctattatcagctataattataaaactaatattactgtttacttacaattgacaaatgtaaattgtgattttaataagaatatagtaaaattgatggttgaaaggaatatctggaggtgacgattgatggctacaaatgataaaacgatgttctttgattttggtcaagaacgtcaagaagatattaagcaaacattaaagacggtttatgaatcattagaagaaaagggatataacccgattaaccaaattgttggttatcttttatctggtgatcctgcttatattccgcgtttgaatgatgcacgtaacttgattcgtcaacatgaacgtgacgaaattattgaagagcttgttcggtcatacctaaagaataacggtgaaactaaatgagattaatgggattagacgttggctctaaaacggttggcatttccgtaagcgatcctctcggttggacggcccaagcagttgagattattccaattgatgaagaaaacgaaatttttgggattgatcgtgttgccgagctagtgaaaaaagaacaggtagctgggtttgtaattggccttcctaaaaatatgaataatacagaaggccctcgtgttgaagcatctcagcactatggcaagctattacaacaacgttttccagatattcctattgactttcaagatgaacgtttaacgacggttgaggcacaccgaatgctagttgaagaagcggacatttcacgtgctaagcagaaaaaagttatcgatgaagttgcagcaacattcattttacaaagctatttggatcgccatggccgccttgtgaataagctaaaatgaggtattaaaatgagtaaacaagaaaataacgaagacatgattacgttaattgatgaaaatggtaatgaacaattatttaaggaattgtttacgtttgattctgatgattatggcaaatcctatatctttatctatccagcggaacaagaaaatgacgattccgttgacattcaagcttacattatagctgataatgaagataacgatggacaggaccttgtcccaattgaagatgataaggaatgggacatggttgaagaagtattaaatactttccttgataatgatggcaacttcaaggcctaattaaaattactggataaataaaatattaacaaaagggagctgtagacacatttgtcacagtcctttttctttacaagcagaatgaaaggatcattaggatgattttaacaacctttattattttgattttaatggggtgctttattaatggtcatcgccgcggattattgacaatgacgttaatgctggggacatatatagtagcttggattgttgctcgccagggagcccaattgattggtggctggttaaaatcgttattaccaagtattggaaccccggcaactttttccgagagcttgcttgcaaatgtaaatagtaatcttttcttttataatgggattgcatttatgataatttttacaattgtttcaattctttgtcactggggaattcgtcagttaaactggataaagaggattccagtggtgggaacagttgataagatcgcaggtgggttaatctcatttttaattggctatttgattatttacgttgttttactaattatgcaattatttccagcaggttggtggcaaatgcaaatagcaaactcggaactagcgcgttttatgattaatcaaacaccaggaatagcgcatttagtaattgatacgctagtacagggaggataaaatgaacaacaaaattttagaaacattagaatttgatcgaataaaaggacaactggcacaataccttgtttctgccgctggtcatcgcgaattgacgcagcttgttccacagactgattatgaggcagtcaaagaacttttgacagaaactactgatggggccgatattttaaggttagaagatgggattcctattccgcaattagctgatatcaaaccgcaattgaaacgtttgaaaattaaggcaaatctgaacggcacggaattagctcaaattactaaagtgctgcaaactagtatgagtgtaaaaaacttttttgatcagatgcgggagaaaaaaattaaactacgggttttaactacccaagttgaccgcctagttacaattccttcaattacccagcggctagttcgttcgattgatcctgatggacggataaatgatgaggcatcagctaaactccatggtatccggcaattaattacccaaacggaaacagagattcaccaacaaatggaaaggtatactcgtgggaaaaatgcgaaatacttaagtgaccctattgtcacaatgcggaatgaccgctatgtgattccagtaatcgcccgctatcgaaataaatttggtggggttgttcatgaccaaagtgctagtggacaaacattatatattgaacctgcagccgttgtggagaccaataatcggttacgacaagcgcaaatagaggaacggcaagaaatgcaacgcgtattaattgagttatcacaaatgattgctccttatcgacatgatattggtcagaatgaagcaattcttggacaccttgactttattaatgcaaaggcacgctgggcacatgatactaaggcaacgctaccgctcttaaacaaagaaaatcatgtttcattacggaaagcgcgtcatcccctgatcgatccccaacgagtagtgacaaatgacattaagattggggaagattaccaagcgattattattactggacccaacactggtggtaaaaccattacgcttaaaactttaggaattattcaattgatgggacaatctggcctatttattcccgcagaagaaggcagtacaattgggatctttgataatgtatttgcggatatcggtgatgaacaatcattggaacaaaatctgagtactttctctggtcatatggatggagtaaaagccattcttgaacaaattacaagtcgtagcttagtccttctagatgagcttggtgctgggactgatcccaaagaaggggctgctttagcaatggcaattcttgataatattggcagtaaaggaaccatggttgtaattactacccactatcctgaacttaaagtttatggttatgatcgtgctaagacgattaatgctagtatggaatttgaccaagaaactcttaagccgacgtataaattactactagggattcctgggcggtcaaatggattagagattgctcagcgattaggaattagtccccaggttattgatgaagcacggacatttgttagtgataatagtcaagaccttaacaatatgattggtgatttagtagagcaacggaaaaaagcacgtgaagaaagtgaaaagctagcaaaactagtagccaaaaatgaaaaagttcagcgtgaccttgataagaaactcacccgctttaatgaacagcgcgataagctatacgaacaagcacgttcaaaggccaaccatcaagtttcgatggctaagaaaaaggctgaccgaattattcatcatttgcgccagttagaagttcagcagggcggaaatgtaaaagaaaatgaattaattgatgcacaagggcaattaaacgctcttcatcatgataatccacggttgcaacacaactctgtattacaacgggctaagcaaaaacatgatttgcataaaggtgatgcagtcttggtgaaatcttatggtcaatatggagaacttttatctaagcgagggaaccacaagtgggaagttcagattggaattcttaaaatggaaattgatgagaataatcttgaaaaagtagctaagaaagatcttccacgagaaaaagatgcaaagcggcgaccacgagctgctgtgagaacgacacaaacacgaaagacctcggctcgtcttgatttgcgcggtcatcgctatgaacaagcaatgagtgagctaagtaactttattgatcatgcattgttgaataatctttcaacggtaacaattattcacggaaaagggaccggtgctcttcgtaagggaacacaacaatatttgcaaagcaatccacgagttaaatcattctcctatgcttcccctaatgctggtggggatggggcaacaattgttaatttataattacttactataaaaagtaagcaaactaaatgacatttaagaagtgatttgttagaatagcgttaagaaaaacaaaggaggaattgaatatggctgtaaacgtaactacagatcaaacctttgaacaagatactgccactggtgtcgatttaattgatttttgggcaacttggtgtggtccctgtcggatgcaatcaccagtagttgatgcattatctgataagatgcccgatattaaattttttaagatggatgttgaccaaaatccagaaactgcacaaaaattccggattatgagtatccctacattaatggttaagaaagatggtaaggtagtagaccaaatcattggttaccatagtgaagatcaattaaagcaaattttacaacaatatgttgattagaaaaaagctggagaaaaactttttgttttcttccagctttttcgtattttaaacttattttttatctttttttcgtcgctttagtagggaatgacgagtttcttttttgagggtgtcttctttttcgtcagggcgatcaacagtaatgaatgttaccatctcagatcgttcattatcagctgaactttgtggatcgttttgaatcaaaatatcaacataatcacggtgccagtcaaagatctttgcctctgcaaccgttccaagttgaaactctacttcttgagcaagaaaaccacactctaaaccaaaggaggtttcctcttcgtctctttgaatccgttcctttacaattacccctgataacctccaaacttgagaagtattgctttttttacgtaaagctaaacggccaaagccaagttgattagtgagatatactagatcctcggctgtagcaacaggatatactcgagcgagatctttaccaatccaatatagcatttcatcggtctctttacccaggatagctggtaaaatcacgtcgcgcattgttccagctcctagtccttgatgaccggctattaattgattatataatttctgactcatatccactcgctcctttttaacaatcattattattatacttaaaattcaagatcttaatagggttaaacctgaaaaacttgcaaaatcttatggagaaacggataatatagtttcaaggttttaaacgttttaataaattaacgaggtgaagagaatggataaacgaccaatcggggttatggattcagggttaggcggcctatctgtaattcgtgtacttcgtgaacaactgccccaagaatctgtaatttttgtgggtgaccaagggcattttccatatggaactaaaacaaaagaacagattcagcaattagcattacgcattggaaaattcttgttagaacaagacgtaaaaatgatgataattgcatgcaataccgcgactgcagcagctcttcgacttcttcaaaacgaattaccaattccagtaattggggtaattgaaccaggagccatggctgctacccaacatcattataaaaaaattggggtaattggcactgaatccactattaaaaatggcgcttatgctaaaacattagctaaacttaatcctgatctaagtgttatcagttctcccgcacagccacttgtctcaattgttgagcatgggcaaacaggaacaagtgaggcacaaaaagctgttgacactgaattagaagtatttgataaccaatcgattgaagctttgatccttgggtgtactcatttcccgtttttacaaaaagaaattcataataaattaggatctaatgttcagttaattgatcctgcatttgagacaatcagacaggcaaaggaattgttaactggcaaaaatcagttgagtgataatttagcgtcaagtatcaacctttattcaacgggagatgctaaagacttagttgctggtgcacaacaatggttaccaaacggatacagtaagtgtgcacatattgaattaaacgaggaaggttaaaatgaaaacaatcgtaatcgcaacaaagaatgccgggaaagtgcgtgaataccaagatatgcttgctcccctaggaattgaagtaaaaacattagccgattttgcaccaatagcaattaatgaaaatggtaaaacatttgaagaaaatgcaacaattaaagctactacagctgctaatcaactccaactaccagttatggcagatgattcgggcttaatggttgatgctcttggaggtgctccaggtgtacactcagcaagatatgctggtgatcatgatgatgctgctaataatgctaaactcttattggcgttaaaagaggtaccggatgaaaaaaggactgctcactttcatactaccatcgtcggaattaagcctgatggaaccaaattagttgccaatggtcgggttgatggccatattcttcatcaactcacaggagaaaacggttttggttatgatccgcttttttatgttgatgaattaggcaaatcaatggcccaattaacagcagaccaaaagaatcaaattagtcatcggggacgcgcattacgatcatttatgaagcaatttaatgattggtggtaataaaaatgaaaatactagttgtaagtgataaccatcgagaagaaaaaattttgacagagattgttcaaaaaatgggggatcaagttgacctaatgattcactgtggggattcagaattagctcctgatcaggaaccgatgagcaattttaaggcagtgaaggggaataatgattatggtttgtcgtaccctaatgagttggtaattaatgctgggcaagagcagctctatctaactcatggtcatttacagcgggtcaatttttctctgacccctctgatacttaccggccaagaaaaaggtgcctccattgtgtgctatgggcatactcatcagttaggagccgtttacgatcatcaaatgctaataattaatcctgggagcatcagttttcctcgtggtgaatatgctaaactcgggggaacttttgcaattattgatgcgcagcctgagcggtttattgttgattattataaccgcgagatggaagctgttcctgaattacattgtgaattcagtcgtcagaaataaaggagtgtatttttgtgattgatcagcgtttgcagactttattgctgaaaaataagcagaagtttatgatccctgccagtttagttgcaacagtaaatcaaagcaacagtttagatcatgcatttttagtccttactaaggatcggtacgctaaaattattgtgattgataataaaaaccgttactgtggtcaagtttctttggcgatgattactgaccgattattggagacaaaacggatcaatgtggagcgcttaaatgaattaaaggtcagggatgtgatgcaaaccgatgcgccagttatccaagatccaactgatatcgaagaaaatttacacctcttaattgatcagtcatttttaccggtggtggacgatcataattacttttgcggaattgtgacgcgtcgtgaagtattaaaggcggtcaattatacaatgcatacttttgggaaataatgaaaagtagttatgatataagtcaagttactttcataaaaaataaatagcgcagtacaacataggcctccagcgtccggtaaaaccgaacgttggaggcctccttctttttatcattcatttttaattaactgattaatagtctgcaagacgccatcatgattattatcaattgttgtggtatgggcagcttgcatttgaataattggttgagcattttgcattgcgtaactttgactcgtcattgctaacatcccgaggtcattttcattgtcaccaaacgtaacaatttcatttgcctttaaattaaagtgagactgtaaaagagaaagagcgttttgtttagttgcagcagcattaccgattaagtcagtattaaagcctgaattttccatgattaaggatggtggtaagtaaccatctaaggttgttgcaactttttttagatcgatatggttagcaaaattaatcgatatcttggtaaaatcttcagttggccgttgagtgaaaatttgtcggatatcagggatacgctctacattttcataaaaaagtttcacaatattgaaatcatgagcactcatcccctgatcaacataagatttttcactagtagagattactaattgattaatatcttgtggaccatagaaacggtcaaggacatgaataacccgggctaaagattcttgattaataggaaaagatttaaataatttgcttcctaaatgaataactgaaccgttttgcgaaataaatcccatcttggcggtgtagtctttaaattctcgttgcaaacgtggaaagctggatccactagcagcgacaaagtagatattatggcgttcaagttggcgaaagacctttgcaaataaagaatgattgtaagtatggtcatctcgtaaaaaggttccgtccatatcagtagcgattaatttaatactcattaggtactccctcccaggcaattggaatattatttgttcgtaattctttaagatatgctgccaaaaagcgactagcaacagttgattgttttccgctgactgctgttatcgtcacacgaaaaacgagcgcaccgtctggggtaacgactggtccgacaataactggttttaattgtagtgcctttatttgtggaactagttttttattaacttgcgtaacaatttcttctaccttactaagaggggtcttcgaagtaatccgaatatcaacgttgctaaccatattatttcgtgaaaggttttgaacaatagtaatgttacggttaggaataaaattaagtgttccgtcagaactagtaacttgtgtagtacgaataccaagagcagttactgttcctttgatttgcccaatttggacagtgtcgccaacgtctaattgttgctcaaggaggatgaaaaatccagtcacgatatcactaacaaggctttgcgcaccaagccccaatgctaaactaaagattccggctccggcaatcagtgtccctactggaacgccaatttctgatagtatggcgtataataagaaaaaataacaagtataacgataaatatttaagacaagggcttttaccgttgccatccgattgctattttttagtacattgtatttttttgattcttgaaaaagatggacaatgataactcgtcctacccataaaagtattaaaaataagacaaacgtaacgataattaaaagaaatttacttaaaagctgttgtgaaatttcgtgccaggataaatctgtaaaagctttttttaattgttccgtttgttttgatgtaagtgaagtggcaccagtgatcataataacctcctaaaaaatactaataaatattttaacagggaagacaagcttctgtcgactacactagattatcgtttttatttgttttatgatattcttagcattgaataaatattttgaaaactaaaggagggattatcagatgacttttggccagttggcagggttaattgcggcaatcgcattcttaatcttagtcatttttgcatgtatcctgttgaatcaattgagtaagacaatgaaagaaacaaataaaagtattacaactttaacgcgggatgttcattatcttagccaagaaatggaggacgtgctaagtaacacgaatacattgttagacgatattaaccataaatcagaacaactagatccggcggttaaagcggttgcagatgtaagtcagagtgtttcggaagtgaatgcctcacttcaagaaatggtcgagaaagcccggttgcaccgcgagaagcgacaatttgaccggagtatttttaaatttgcaggaaagacacttgttttcgatgctttcaacaaatttagacagcatcggaagcaaaagaaaggaatgacaaataatgagtaaaaaattacttgctgggatattattaggtggagtcgcaacatatgctgcatggaagaaaatggcgccggctaaaaaagaggcattgaaagaaagcgttgatgaaaagattaataaggttgctgattatgtgactgactataccttagacgcattagacattgtcgatgaccttatgagtgattctaacttgaatgataaggtgagcggcgctgcgggtgctgttaataatgttaagggtaagataaaagatagcgccaataaagtagttaatcatatgactaatgatgactttgataagcaaactgctgatattcgtgaggaattagcgaagaataaagaaacagatgaagataataacgatattattatcgatgctactagtgatcaaaagccagcatctactgaagacgatgaaacagatcaagatgacgctaatgcagccgataaataagtaaataaaaaagctgagaggtttctcagcttttttattttaatgagggaaagttagtaattctttagttgtatgcgtaaatggttcgcaaccatcttctgtaatatgaacacagtcttcaatccggacgccggcaaaacctggaatataaatgccaggttcaatggagaagcacattccaggttcaaaaactagctgatttccttccatgattgatggaaattcgtgttcactgctacccattccgtgcccgaggcggtgaataaagtattcgccataaccagctacagtaatgatatcacgagcgatcttatctaattcttcagcggtcattcccggcttcgcagcattttgagcggccaattgagcctctaaacataccttgtagatgtctttttgtttgtcatttaactttccgacagccactgttcgggaagcatcgctaatatagccatcaacaattgttcctaagtcaaagaggacgagctgattattttggatcttattactggaggtagctccatgaggttcggcagcatgaggacctgcttgaactagcgtatcaaaactcattttattaatcccatgttgtttaagagcgtattctaaatcggcagcaacttcttgttctgttttaccaatttgaattgcttcgaatcctactttaaaagcgaaatcagcccatttccctgcttcatttaacttagtaatctcatcatcgcttttaatcattcgcatttttgctattaaaggagagagatcagtattaaaatgggcattggggaggacttcttctaaggcacgaagacggtcaacagttagtgattctccctcaattccccagttaattggtgaaccagcatgatttttgatatgttcagcaataagctcaaaaggtttttcgtgatctaaatacccatataccggatatttccaaccagtatcctttattgcttctacttcaagcgctggtgcaaacagaaatggctcactgtcggcaaaaaggactagtgctaatacccgttctactggatcgctgtagaaactagttaggtaattaatggtcattggatcactaatataagcagcatctaatcccttttcagtaagagcgctttgtaattgattaagttttgtcactgcattcacttcctaaaaaagattgcgaatattataacatattgttatgacccgaaagtaaaaaaataatgaagaacgtttgctaattaaaactaaatctgctatattaactaggttatgaaaaaatatgaaaacagattataccaataaagaaagggctatcttatggaaaaacaatcagtaacaatttatacggttgcccgagaagctcgtgtctcaatggccactgtttcacgagtagtaaatggcaatccaaatgtaaaaccagaaactagacaaaaagttttagatgtaattaagcagcttaattatcgtcctaatgcagttgcacggggattagcttctaaaaagacaacgactgttggggtagttattcctaatataactgatccatactttgcggaattagcattggggattgatgatgttgcttcaatgtataagtacaatatcattttaactaattctgattctgatgatgaaaagatcctgaaagtggtgcggagcttgcttgctaaacaggttgatggacttatctttatgggtcatgatgtttctgatgatctgcgaaatgaatttgaaagcacaaatacaccagttgtagtagctggttctgttgttaatgatgatgctttaccaagcgttcggattaactaccaagcagccgccaaggaagcgacagaatttctgctaaaacatggtgatcaacaagttgcctatattactggtccattacgatactcaattaatggcgaagaccggctcaatggatataaagaagcattggcaaataataatgtgccatttaatgaattattagtaattgaaacggacgggtcttatcaggctggatatgcaaaggcacaagaagttatcgaaaagggattaaaggctgcttatgtaacagatgatagtttagctgctggtctcttaaacgggcttacggatgctgatattagcgttccagatgattttgaactaatttcttctaatgacaccaattatacaaaggttgtccggccaacaatcacttcgatcactcaacctctttatgatcttggtgccatttcaatgcggttgttgacaaaattaatggatggcgatgacagcaatgatgatgaaaaaaatgttattttagatcatggctttgttgaacgccaatcaactcgtaagtaggttgtgatttgttgtgacaacccgaagtgaattacgagcacaacgacaagaaaaagttgagaagccaatagaagaaacaccgaaaaagcatcattttctatactgcttatggggtgtaatctgtgtgactttactcgggctaacattactaattaattcgacacttttaaatgttaactttgtaaaagaagaagttacaaattcgtcgcttgaatcagttatgttaaaccaggttaacagtagtctaattcagtacgggatttcaacttctatcttaaagaaaagcgatactgataagctaattaaccaggcaattgatcaggtatatgcaggtgaaaaaattaatcttgacctatcacctatagttaataatgtgggcgcatctgttaattcccaattagctcaatatggtttgtctacttccatgttaccagcaggcagttcttcagcaattgctggtaacattaattcgatggttaacagtcagttaaatgctcccgaagttgcacagttaattaatgggattaaaattgctaaaacggttgttaatattattttagtgatttcaattatcagcctcgttatattgattcttaaggggttatggcagcatcacttaattggtagttttaggtggatttgtctgtggggaactattttatacacaggaatcgttatgactattcatgcgattgcccttcaaatgggtgcaggccaaccagacataagtccctttatttcccaggttgctaatgattttcagcagactggatttcacggttcaatgatgatgattgtcattagtattgtgttatttattctgcactttgtaaaacgaaaatggcaacctcgccaataaccttgaattaacgatgaatatttgctaaaatttatctgtttgtattacactaataaagaaaagaggagtcagtaatgtcaggacattcaaaatggcataacattcagggacgtaagaacgcccaagatgctaagcgtggtaagattttccaaaagatttcacgtgacttataccaagcagctaaagcaggtgatcctgatccagcgaacaacgctcaattacggcttgtaatcgataaggcacacgcggccaacatgcctaagaaaaatattgaccgtgctattgctaaagcttcaggtattggtggagctaagttcgaagaagttacttatgaaggttatggaccaggtggggtagcagtaatggtttctgctcttactgataacaagaaccggactgcatctgctgttcgttcagcatttagtcactctggcggttcattaggtgctagtggatcagtttcatacatgttcgaccgtaagggattaatcgaaattctccgtgatggtcttgataagagcgaagatgatatgttaatggatgctttagatgctggagctgaagatatgaaggcaactgaagaaaagttccaaatcttcacagatccaagtagcatgacagatgttcgtgatgctcttcaagaacaaggctacgaattagatactgctgaagttaccatgatccctcaaaaccggacagaggtacctgcagataaggcaaagcaataccgtcatttgattgatgaattaacagaaaacgatgatgttgctgatatttacgaaactggtattttaccagacgaagatgacgatgaagaataattcaatcattgttattaagaggttaaaaagcaaaacgctttttaacctcttttttagttttaaattttttagtgcatttttagaatttatccgtatttaaataatagggaggttaaaatatgccgagttttgaagaagaattagcaagaatgattcgcaagcaaccgagtgacctatatatcttacctcatgataggtattatcaattatccttagcgataagggggaccctattaccttttaaacaggttacgcgtgactatggtcaacgttttatctcatacttaaaatattgcgccaatatggcagttagtgagcatcgacgaccccagctaggcgcttttaaatttacttatgctcaccaaaagatcaatttacgcttatcaagtgttggtgattatcaagggagggaatcactagttattcgctttatatatcctcttaatgatattaggtttaattttttagttcctcatcagtgggaaagattacagaaataccgtcaacaacgaggtttaattctttttgccgggccaatgggggctggtaaaacaactaccatgtatcagcttgctcgacagctattgccgaaacaaattgtattaacaattgaagaccccgtagaaattgatcatccgggatttattcaattgcaagtaaatgaattagcggggatgaactatgaaagtttattaaaattgggattacggcatcgcccagatgtatttatcattggagaaattcgtgattcacagacagcagctatgtctgtccaggccgcattaagtggtcacttagttttgggaactatccatgctcgaaatgcttatggcgttgtttctcgccttcaacaattagggatagattcttattaccttcagcaagtattaacggcagtatcttatcagcgtttaattccgttggtgaatggagaacaagccatcttatgtgacctgttaaatcgacatcaatttagtggtttgcttagtggcaccaagaaaggaggaatatctgatgaatggtcaaaagctcttcagcaggctgtggaaaatggcgaaattacggagaatactgcacgtcaataccaacaaggttaaattcaatcatcagcaacaagcagattttttccttttattagcagatttattaagtgttggcttttctgtcaaagaagcacttggttttatcaaggctgtcaatccgaagctaggtccttggattgcttctatagataaacgaatgcaaaagggagcgagttttgcccagagcctgcagtcagaagtaaaagacgatttgttttatcaattactattagcagaaaagcatggtaatttaacaaaaacattgagtgaagtaggaaagatacttacagcacgagaacagcaacgaaaaaaattatttagtctcctgcaatatccgctaattcttttagggatgctaggggtggtgatttgtgggttaattttgtttgtttttccagaattgaaagtctggcaaggcgagaggcaaactttgccgctaattcacatgattacgttaggagcaacgtatctttttaccgttatctttattagcgctgtatttcaggggctaagatggcatcaaatgaataaggaacaacggctaattaagatctgtacaataccgatgatcggaaaatgctattgttattattttcaatattatttaactagtatattaggatcaatgttgcaacaaggattatcgttggctgaaatttgtgaaattacccagagctttgatagaaaatcaattctttatatttttggtaacaaaataatgactactattcaacatgatggagatatttcaaaagtggtggctacctactcttttcttcctaatgaattaattgtttttatgaataagggggcgaccagggaaaatatgggacgggacttaattgttttcgcgaatttaaaatttaaggcccttacaactgcaattgaacatttattgatttttgttcaaccagttatctttagcattattgcaatcataattgttattttatatcttagtatcttattgccaatctgtcattcattccaaggagtttattaatgaaaattttaaagaaaaaacaatcaggcttcaccttgctcgaaatgtcaatcgtcttatttattattagcctactagtattgattatgctgcccaatctctctcaacagcgaaagcatgctaatagtattcatggaaaagcgatgacatctgtaattcagacccaaattgatgcatatgaaaatgaaaatggaactgataatgtcagtttagaggaattgaataaagcaaattatctgactgatgcgcaggttcaacaggcccatcacgaaaaaattgtaattgttgatgggaaggcaattcagcgatgaattttcgtgaagaagggtttacgtttctcgaagcaattattgttttaggaataacggccctccttttactaattacgattccaaattttacaaaaacgcgtcaaaaactagctgaagaacaattttggcaatcattgcgtcaagattggcagtgggcgcaattaaagtgtgagagtaaacatcaatttgttgtaattcgccacgacaaaaataacgaaatgattacttttcgtataaatgatcaaacgagagagacaaaagaaatccttattccctcaacactgaatgttgagtggtttggtgaactttatcttacgccaaatggctatacgcgcccctgtacccagcgttttaaatcattaatcgatggtcactattactacatgaagattcaattaggatggggaggataccgaattgagaaacgctaaagtaaaagcatttatgatggcagatagtttaattagtttatttattgtagcgatggggataaatttattttttatttgcgaaaaacaattgtggttacaaaatagaaatcttcagctaaaaatggccgcaacgaggttaggaaaagaggctagtgatttatatgcggttaaaaagcaatcagttattttaagccgtggtgatttaaccgcaaaagcaacggtccaaagggtggttgtttataataataatcgatgcctttgtcgggttgaaagatgaagaagggggcctttactttaatagaagcgacttacgcgttaattatttcttcattagtgattatcaatataagtttagttactactagcatgagacaagtaggtaaaatgaacttagaatcaacgatcacttggcatttgtttttacgggaattagaatcagtcaatcatcgttttgaattaatggaggttcgtgataattggttattactgtacagtcagacaactgatcaaaagtatgaattaagagaaaaccatgctctatacctaacgtgtcagaataaaggtggttatatgccattgttagatagcattaagaatcatgaatactcgtttacgcaacttgattcccaacgcgtattgattaaggtgacaaggaaggatggagagaaagcaagtgcaattgttaagttttatccaccaaaataaaaaagagggttctattttatttgtaagtattgccgtcctacttataattagttcaattttattgtttcaatatcgatattatcaaaattatcaggaaatgggacgagatctttgttcaatttatattgataaaataaaagataatctaagaggtcaatgagagtgttatcttgaatttgctaggaataatagttaaactaataaggtaatgattgtattatttggaggcgactagcactgacacagaaaacaccacagcaattatttgagctttttgataaggccactgaaattttacaagcagcgttaaattgttcgtatttagatgcgctattagaaaacgcagaaaatattattgacaataatactgttcgtgttgatgaaggtgttcctgatgaaaaaactgtaaatgaattgcagaaaatataccaagaattaaatttacaaaatgtgaagccagaaattatccgacaaattatccagctgagttttttgaaagtaattcgaaaagatgcaattcaggctaatcatcaaatgactcctgatacaattggcttaatcatggctttcttaattgaaaaggttacaaaaatcaaggagattaagactgtttttgatccagccgttgggacagctaatttattaacgactgtgatgaatcagcttaaagtaaatggagataaagacatcgttggttacggaatagataatgacgaagatatgttgggagttgcgagtgtaaatacagaattacaacaccttaatgtaaagttgtaccatcaagatgctgtaactgctttagatatttctcaatgtgatttagctatttctgatttgccaattggttactatccgcttgatgaaaacgccaaaaactatcaaacacgggctaaagagggtcattcatatgttcaccatttgttgattgaacaatctatgaattatcttaagcccggtgcatttggggtattcttagtgcctagtagcttattccaaactaaagaatcacaatcatttgttaaatggattcagtctgttgcctatttacaaggacttatcaatttgccagcagaactttttgctaatccgaatgcgcaaaaatcaattttgttattgcagcgccaaggtggagatagcaaacaagcagttaaagttttgttgggtgagtttccttcatttaaggataaagcaaaatttgcttcattcatggatgatatcagtaaatgggtaacaacgaatttacgttaaaggagaaaagtcaatgtcaaaaacaattgcagttaacgctggtagttcaacacttaaattcaaattatttgatatgccaagtgaagaggtagtagctgaaggtacgattgaacgtattggtgaaaagatgggccatgctaagattaagtatggtaatggtcaaaagcatgaagaagataagccatttgttgatcatgctgccgcagttaattatttgttagataagttaattgaattaaagattgtggcaagctatgatgaaatcacagcagtaggtcaccgaattgttgccggtggagaattctttaaggattcaacaattattgatgatgatgttattagcaagattgatgaattgtcagaatatgctccactccatgagccggcagaattggttggtattaaagctttccgtaaagtattacctaatgcatttgcggttgctgtttttgatacatcattccatgttgatatgccagaaatgaatgcattgtacagtgtgccttatgattggtatgagaagtatggtgcgcgtaagtatggtgctcacggtaccagtcaccgttacgtatctgcacgtgctgcggaaatgttaggcaagccagttgaagaacttaaattaatcaccatgcatattggagcaggtgcatcaatcactgccgtaaagaatggtaagtcattcgatacgtcaatgggctttacgcctgttgctggaataacaatggcaactcggtcaggggatgttgatccatccttaattgcttttatgcagggtaaactaaacttatcctcagatgagatgattgatattttgaaccataagtctggtttgcttggtatttctggtatctccccagatatgcgtgatattcttgcagctgctgaaaagggtgacgaccgagcacaacttgcattagatatttatgttaaccgcattgtccgttacattggagcatatattgctgaaatgggtggcgcagatgccattgtcttcactgccggtgttggtgaaaacagtgttccagtacgaaagatgatcacagataagcttgactactttggcattaagattgatcaagaaaagaacgactgccatggtgttgaacgtgatctttctgctgatgatgcaaagattaagacattattaattccaactaacgaagaattaatgattgttcgtgatattgaacgtttaaagaaaaataactaagtactaaataattcgccaaaagctgactagttgacaagaaatgtttgtctctagtctctttttattttagaatttaagataactatattgcctttttaagaaagaagattctctatgaagttttgcacgtcagatactcatttttttcatgatagtctccttggtacaaataaatttgcaccaaggccattcaataatgtcaatgagatgaaccaaacgattattaataattggaacgataaggttggtgaaaatgatattgtttatcatttaggagacattgctctgtactttactaaacctcaacgaaatgcctatcaagcaatccttgaggtgttattacaattacatggacacttaatactgataaaaggcaatcatgataatcgggccctttttaaatatctagaaagtaataattatgagtttaatggacttcctaaatttcagtttcatgatgtgggagtactattaaaatataatcaccgtcagtattatttaactcattatcctcttatgttaggaatagcaccgcaaattattaaccttcatggccatattcaccactattctgttcccattaaagaaaatataaatgtaggcgtggatgctcccgaattagactatcttgaaaataagcctaaatttggagctccgctgaattttcatgaaatagaagaaatcgtagcgcaaaaagctatgaagtatccaggacaaaaataatcaaaagaaggtggaaaagatgaatagagctaagattcaagattatattgatcagcgtgaagagcaacgatctttaatctatcatattgaaaaaaaagaccagacacattttaccgttaatggacatccttacgaattagtaaaggactaccgtgacggttttaattcagaaaaattcgcagaacgatttagcagtgttctgagtaaatatgactatatcgttggggattggggatatgaccaattacgcttaaaaggtttttataatgatgataatcccttatttgaaccagaattgggtgctgatacgattgaggattatttatttgagtattgtaattttggctgtgcgtattttatccttcacaatgatgatgtttgtattccacggcacagttaccgtcagcgtcgaaagaaaactacgccagtcattcatgaacggcgacggcaggttaaacaaccgaacgtgcgtcaacggcataatcagcgtgcagaacgtgtaaaaaacggtcatcggcaaaaatttgtgattcatcaacgaaaaaagaggagctaaggcaaacgatgaaagattatcaaggatattttattgatttagatgggacgacttataagggcaaaaagcaaattccagcagccggaagatttatcaaacgactacaagatgtcaagaaagaggtcttgtttgtaacaaataatagtaccagaacgccagattttgtcgctgaaaacctccgtgaaaatcataatattaatgttacggcggaaaatatatacacaacagcaatcgcaactgctgactatttacggtcaatggcgccgataaaaagtaaaatttatgttattggtgagtcaggattaaagttggctttagaaaagcgagggtttatcttgactgatgatcaacctgaatatgttgttgtaggattagatacgaatgttacttatgagaagcttgaaaaggcagtcttgttaattcgaaatggcgctaaatttattgggaccaatgctgatagtaatttgcctaatgaacgagggatggttcctggagcaggttcgattgtaaagctagtagaatatgcaactcaagtgaaacctgtgatgattggtaaaccagaagcaataattatgaaaatggcacttgaaagagttaaattgcctaaagaaagggtaattatggtcggcgataactatcatactgatattgaagcagcaattaatgttggaatggatagtttattagtttatactggtttatcgcgtccagaagaagttataaaagaaaaaatccagccaacatataaggtgaataatcttgatgaatgggaaatttgaatttattcagtggggaagagcaatcttattgacactacttagtttagttgttgcaattagtattgctctttttatcgttattaatatctcacctttttttataacaattcctaagcacctcctaggattatctgcctctgaattaatagctgattatggaagtgtcattaaatatatccagcttccggcccagcgagtcctcgaactaagatatttaccaattgccccttctgcagttcaccattttgaagacgtaaaacatttgattttattgaatgaagctgtgatggtggtttcgctcccgttgttagtgtttggattgaaaaaacaaaaacggcaaaatcagctctggcgcctgattttaccgtttcagatgttatttattttattgctctttagtgggtttatggggataacaaatttcgatgtcctttttattaaatttcattatcttttctttagcaatatggattggctatttgatccacgaacaacgccaatcatattgttgatgcctgaaaatttttttacagtactatttggattatggttaggatttatattgataatcttacttttgatctggggatggataaagcttatgttaagcatcttctttaacaaaacgcgaacgtaatgctccgacaacggctgggattaacgtaaccacaataattgcaagaatgatgacagagaagtgttcttgaacaaacggaagattaccgaagaagtaaccacatccacaacaaagtgctacccagataacacagccaattacactataacgaataaattgcttgtaggggaaaccagaacctgctgccgcaaatggagcaaatgttctgatgatcggaataaaacgggcgagaataatagccggcgcaccatgcttttcaaagaagacttcggcacgttctagactatctttatcaattaatttaccaaaaagtgagtggttagaaaggctcttcccaatcttatgaccaattaaaaagttaagggagtctccacccaaacaggcgcataagaaaataaaaataaaaatccaaatattaagatgataacgtgggtcagcagctagtgcacttgcagcaaagagaagggaatctccaggtagaaatggcattatgactgcaccagtttcaataaatataatagcgaataaaattaaataagttgcatcgccgaattgattaacaatctgaattagatgaacatcaatgtgtaatataaaatcaataagagttgccaaagtaattctcctttgtgtaataagataatactgttaaagtgtagcaagatagaaaaatgttgtgaaggggcgtttaaaacttttaataatttttgaaaaatatatttattgtaagtataaattagttgtgtgagactagttcattcatagtcaatgacgaaaggatcattgcaccctttttgaaaaggctgaataacgtttattatcataagaatggtaaagcaaacgaaaaaaataaataaaaatcaaaaaaagtgttgacgagggagtgaaatccatgtatagtagttatcgttgtcaaagcagttaagtgctgttgagatggttaacaaaaagttaaaaataattgttgacatctacttgatgacatgatatattaataaagttgctgattgagttatcaatcaaaagaaattcaaaattaattaaaatttcttcttgacaagctaatctaatatatgttataataaccatgttgattggctgcttgattggccaacaggtagacctttgaaaactgaacaaagtttcgacgaatcaaatgtgtagggtcttcaatcacgatgtgatttgaagcaaaacatttgcgaagtcaattcgcttaacaataaagataattgagagctattcaagttcttatatattttatatgagagtttgatcctggctcaggatgaacgccggcggtgtgcctaatacatgcaagtcgtacgcactggcccaactgattgatggtgcttgcacctgattgatgatggatcaccagtgagtggcgaacgggtgagtaacacgtaggtaacctgccccggagcgggggataacatttggaaacagatgctaataccgcataacaacaaaagccacatggcttttgtttgaaagatggctttggctatcactctgggatggacctgcggtgcattagctagttggtaaggcaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttacttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacggggcccgcacaagcggtggagcatgtggtttaattcgaagctacgcgaagaaccttaccaggtcttgacatcttgcgctaaccttagagataaggcgttcccttcggggacgtaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcaagctcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgggagtttgtaacgcccaaagtcggtggcctaacctttatggagggagccgcctaaggcgggacagatgactggggtgaagtcgtaacaaggtagccgtaggagaacctgcggctggatcacctcctttctaaggaataaaacggaacctacacatcggagaaactttgtttagttttgagaggtttacctcttaaaactttaacctataagacgcttatttgggcctatagctcagctggtttagagcgcacgcctgataagcgtgaggtcgatggttcaagtccatttaggcccatatggggaattagctcagctgggagagcacctgctttgcaagcaggaggtcatcggttcgattccgttattctccattatcaaccataaggttgatagagtttgtactttgaaaactaaatactatctaatttctttattaacaaaacaataaaccgagaacaccgcgttatttgagttttaattaacgaattataatcgctaactcaattaatcagacaatctttgattgtttaggttaagttatgaagggcgcatggtgaatgccttggtactaggagccgatgaaggacgggactaacaccgatatgcttcggggagcggtaagtacgctttgatccggagatttccgaatggggcaacccaatcagcttagtcgctgattacttgactagtgaatacatagctagcaagaggtagacgcagtgaactgaaacatcttagtagctgcaggaagagaagaaacatcgattccctgagtagcggcgagcgaaaagggaagagcccaaaccaacaagcttgcttgttggggttgtaggactgaacattagagttaccaaagtgcgacgtagtcgcaacagttgggaagctgtgccatagagggtgaaagccccgtagacgaaacgtcacactctctgttcaggatcctgagtacggcgggacacgtgaaaccccgtcggaacccgcgaggaccatctcgcaaggctaaatactccctagtgaccgatagtgaaccagtaccgtgagggaaaggtgaaaagcaccccggaaggggagtgaaatagttcctgaaaccatgtgcctacaagctgtcggagcccgttaatgggtgacggcgtgcctcttgcagaatgaaccggcgagttacgattgcatgcaaggttaaggtggaaaaaccggagccgtagcgaaagcgagtcttaaatggacgtaaaaagtatgtagttgtagacccgaaaccaggtgacctacccatgtccaggttgaaggtgcggtaaagcgcactggaggaccgaacccgtgtcagttgaaaatggctgggatgaggtgtgggtagcggtgaaattccaaacgaacttggagatagctggttctctccgaaatctctttagggggagccttgaggtaaagaatcgtggaggtagagctactgtttggacaaggggctcgtcatgggttaccaacttcagataaactccgaatgccatcgatttatactcaggagtcagacgatgagtgataagatccaccgtcgaaaggggaacagcccagatcaccagttaaggtccctaaatatatgctaagtggaaaaggatgtggagttgcatagacaactaggatgttggcttagaagcagccaccatttaaagagtgcgtaatagctcactagtcgagtgatcctgcgccgaaaatgtaccggggctaagcatattaccgaaactgtggatgtgcactatgtgcacgtgataggagagcgttctaagggcggcgaagtcagaccgtgaggactggtggagcgcttagaagtgagaatgccggtatgagtagcgaaagacaggtgagaatcctgtccaccgaatgactaaggtttcctggggaaggctcgtcctcccagggtaagtcgggacctaagccgaggccgagaggcgtaggcgatggataacaggttgagattcctgtaccagttaactgcgtttgacgatggagggacgcaggaggctaagcaaaccgtacgactggaagagtacggccaagcagtaagtcaggatgtgagtcaaatgtttacatccgtgttgacaagctgtgatggggagcgaaattaaagtagcgaagttgccgatgtcacactgccgagaaaagcttctaaggagtagttaactgcccgtaccgcaaaccgacacaggtagtcgaggagagaatcctaaggtgagcgagagaactctcgttaaggaactcggcaaaatgaccccgtaacttcgggagaaggggtgctggccgcaaggccagccgcagtgaataggcccaggcgactgtttatcaaaaacacaggtttctgcaaaatcgtaagatgaagtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcgctgtctcaacgagagactcggtgaaattgaaatccctgtgaagatgcagggtacccgcgacaggacggaaagaccccatggagctttactgtagcttgatattgagtgtttgtactgcttgtacaggataggtaggagccgtagaagtcgggacgctagtttcgacagaggcgctggtgggatactacccttgcaatatgaccactctaacccgcagcactgaacgtgctgggagacagtgtcaggtgggcagtttgactggggcggtcgcctcctaaaaggtaacggaggcgcccaaaggttcgctcagtatggttggaaatcatgcgcagagtgtaaaggcacaagcgagcttgactgcgagacagacaggtcgagcagggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacataccgctggtgtaccagttgttccgccaggagcaccgctgggtagctatgtatggacgagataaacgctgaaagcatctaagtgtgaaactcgcctcgagatgagatttcccatttccttcgggaaagtaagacccctcagagatgatgaggtagataggatggaagtggaagtgccgtgaggcatggagcggaccattactaatcggtcgaggacttaaccaaggagcggtaaggtttattggaagagaatagataggatttagttttgagagcacaagctctcgtccgaagggacaaagagtgtggtgatgatggcttgaaggatacacctgtacccatgccgaacacagaagttaagcttcaacacgccgaaagtagttgggggatcgctccctgcgaggataggacgttgccacgcaaaatcaagctttggcacctggtcttaattgtgccagggcttggatattggagagttgtccgagctggccgaaggagcatcattggaaatgatgtatacgggttaaagcctgtatcaagggttcgaatcccttactctccgttaatatgacccgttagtcaagtggttaagacaccagcctttcacgctggtatcgtgggttcaaatcccgcacgggtcacttttggaggattagctcagttgggagagcatctgccttacaagcagggggtcacaggttcgagccctgtatcctccattacaacttaatagttgtatatacccatgacacaatggctcggtagctcagttggtagagcaacggattgaagctccgtgtgtcggcggttcgattccgtcccgcgccatttatggggagtagcgaagtctggctaaacgcgacggtctgtaaaaccgttccttcgggttcggtggttcgaatccactctcccccattttatagggatatagttaaacggtataactacggtctccaaaaccgtcattgtgggttcgattcctactatccctgcttaactgaatattttggcggtattggtgaagtttggttaacacaccggtttgtgggtccggcacgcgtgggttcgaatcccacataccgcccttttgattaagcttattacttaatcttaactatttggtggtatagccaagtggtaaggcagaggtctgcaaaacctttatcatcggttcaaatccgattaccaccttttagttagctgatgcctctgtggcggaattggcagacgcgctggactcaaaatccagttcccgttgagggagtgtgggttcgacccccaccggaggcatattagtactttggtacaaaattgtcagctaagctaatgaaataggagaaagcttgttattgcaggctttctcctattttttagtttaaattttgattttaaagaaatggtataaaatggtgcaaatttgtgatgaaaacacacaaaaatcacacattaaaattgactaagtgcctggacgattttgtcatcagttttacttttatattcatcaatcaagtaggcgtatgtgttcattgtggttgtgatatcattatgtccaagtctcttgctaattgcataaatatctattccgttacttaacagtaaagcaacgtgactatgacgtaaactatggaaatgaaaattcttctttgataattttgtatcactcataatttgtcgaagcgttttatttaatgctgtactagtagggatagtattaaattgatccataaaaacaaggttacttgatgaattattgcgcaattgtttaagtagtaatagtagtttttcattaacttttattttacgtgtagatgattcattcttggtgggtttaaagcgatgtgtattaaaatgttcgtctgtttcgtctcttccttttacctctctccatgctttatcaatattaatggtatgatgaatgaaatcaatatcattccaggtaagagcttgaatttcttcttttctcattccagtatatatcgcagtgactatcatataacggcttgtatatcttctattagtaattccattgattgtagtagttaataatttccttatttcagttacattagggtattctaccttcattgttttgctagtattggcagctaaagtaacacctttagtaaaatctttaagcagataatcatcaaggatagcagattgtacgcaagaccgtattattgaattaagcttctttacacttgctatagcatgagttgctccatacttgttaataaattcttgatatttagaacggttaatttctttaatagaagcttctttgaaataatcattaattagattaccgattataatataacgattcagagttacacttgatattttaggttgcttataagtattaacccattcttcgtaataatcactaaaagcaatttttttctcaatgtgtattccgcgattaagattagtttccatttcagctgcccactttttagctagtgcttttgttgcaaaaccagctttggactttgaaaaacgttttccttcagtatctttccactgaattcttacagaccattttccgcttcttttatatatttgagccatacttgtccctccattattaaattgtgtataatgaaagggttgatagaatttgtttggacgcaattaatatcaacccttggtccactgacagttgccgctgtcggtgggcttttttagtttaaatagctttttacgtcatcaatttagttggacgagaaatttagcttttgtttagcttctttaattgattaataatttcttgattttgcttaattgttatccaattttgctgtttgattattcttaattcatgaaaaagggcttttgtatcattacttgtaaaagtaggataggcacctgttaatttttcggcaactgctatatcttttacagattcgagaatttcgtcatctaaactttctaaacgattttctttaatatatttatctttgtctttagcaaatccatctttaccattgaaaatactcatttttagctttctcctatctttttaatttttacattgtaaagagcgttatttaaatcattacagttcctaagataggaaaaagcgttttttaaaagtttattcatcctttgactccttatattcctaaaatttgtttctttttagcatcaaattcttctttgttaatgattccatcatcaagtagttgttttaattctcttaattgcgaaaggtcattactagaattggattgtgctgatgtctgcttaaaatctgcagctgcctgtttaatagtctcagccatctttttagcagggtagggttgcatattttctatttgagttgtaatagctccgttggttactgcaatagatcccaacattaaacctttagaatatgaaacgccattaatcatatcaaggggaatgtcagttgatttactaccataaatcaggccgtggtcaagaaaaattacgcgcttattagtacaaaccgcaagaatggaattagtttcaacgaaagcattagcagcataaagtattttttctccaccatcgacatctattatgtctggcaaggctttgatttcctttttagtaccgaatagattttctacattggcatcctttaactgttgcttaataacatccaatttttcttgttcgcctttgttgatttcgtcaattgctgcttgtaaagtatcagcttttttaccagcgctatcagcaattgaatcaagtttctcagttactttagatagctttgatttatacaaatcaggatgttctttgtaaggtacggtagaatgaatccctaataaactttcaatttcactagcggtatgggaactaatgaaattgctaagtttaattggaacacggtaagtatttgctggacgtttgggatcaagtctgttggcatctttgccacaaattaaatatccatctttggtaatgcaagaagcctttaacattcccagggcatcattacatatgaagcatctctttttactcatttggatcaccttattccattgtcactgaatatttaactaatttaccaacaattcgacctggatgctcttcatcaagaattattggatcatagtttttattatctggcattagcataactaaattgccttgatgcttaatacgttttaaagtagcttcgttatcatcgtcaacaagaactgcagctatctcaccatcttcaacttcaggttgctctctaataatggctaatgcgccattaggaatggtaggctccatgctatcacctttacaacgaagaccaaaaagtgttccactaggaactggtttttcaaagatttcatcagtataaccttcgatattttcttcagcagtaatcggatcgccacaagcaatttcaccaatgattggaattgaaacaacttctaatccttctttaggataaataatattagaaggtttcttttctctggtagggaaaaagtcatcaacatttacattaaaaatttcagctaatttaaataaaacatcttgatttgcctttctagatcctaactcatatctagtcacagttgctcttgtcgtatcaagtttgtctgcaagttgttctactgaaaggccacgttgttcacgaaaatttctgattttttgaccaatgaatttacttagttccattttatgtacctctcttatgtaactaattatataacttgcgttaccgaaatggaatattttttatctttttcgaaaaaaatagttgcatttgttccagaatggttttaatatataattgttccaaattggaacggaaaggagagataatatgcagtcaagattatatgatttacgaaaacatgttaaaggaatgactcaacaacaaatggctgattatctaaatattagtgtcaaagcttatcgtgataaggaaaatggtaaaaatcaatttactcaagatgaaatgtttgctattagtaaattatttgatcttaatattgacactatttttttgcctcgtaagttccatattggaacaaagggctaagagaggtgacacaaaatgcaagcatcgctagatgaacaagattaccaagtaattactaatgaggttctcaggcgtattaaggaatgttacaacttagtgcctaaacaagatgtccaaactgacaaatgggtcggtatcaaggaattcacgagtaagttgcccgttataaaggacaaggaatgggtcagaatgtttctccttacacttccagtctttaagaactgggttatcaatttgaatgcaggtcaaggtcatcgaactaaggtaaatgtgaccaaggcattgccttggattatgtctcatcaagctgatattgattggaaccagtcattgccacgttaggaggtgaacagatggcacaaccgatatttgtaaaaggaatttttggaagacgaattatagtttctcaatttgaacaaacgtctgattttattttgcaaaagaaaaacgctgacctaataaaagaagccagcggattttcaaaaaacaagaaattgtttactcgttatcaaggtaaagactttcaaattatggagcaattaaagtggcaacccagtgttctttttgatgatgccagtaagaaccgtagtagccacagatttaaggacaccaatggaaactgactttagagtgttagtagctttctttgtttgtttccaaacctcatcatctcgaatggaatcaagtagttcatgcccagaccaagtgatgtcatagacagttaattggcgaaccattttattaataaatggtttggcactaatgaaaccgcctgagtagagctgataaagggtataaacaatatcatttttatcaaaggtctcattagcaataacatttgcaatttgagaatctgtaaaaccttggtaaagcatttgcaattgctgtttttctaatgataaaagaacatacctaacacagtcttgcttcaatttcacaattttcaccacctttattttgaattaatcaaagtatagcagaaagggagagcagttaaatggcgttggtaattggattaccaatattaattattgcaatgtgtttgttatatgcattggtgtacagcttattgtatgagcggaataaaccattgctattgaaagaaaagtatcggaagaaacattgaaaggaggtgatatgaactttggtaaatttatttcttttgttgttttttatctttgttataatgccgcttttgtatcaatttttgaattacatcagaaggcaaattgaaaatttcttttggaaaaaaagccataaaaataagaacgaatgaaatgaaagtagctgtaaattcaaattgttctttggtctgagttattaatagcccagtaatagtagaaagaataattgctatttttgaaagatcatccaagtatttttcgcttatttgaaatcctaaagtttctgtaagccagccaaggataaacaatggaaaagaaaagaagccagttagaaaaagaatagtaattaagcaatcaaatattctgagtttttggaattcaaaaattacagcatctggattagcagcatatgtaatatgtagagctaaataagtaaaacagatgaggcagaagatacaaaccataaagtcggttagtttcttactatagtaattaaatttggttaaaaacttaaaaattttacgcataatgattttccttttgtactgagttaatcaaagtatagcaaatgaaaggatggtagtttaatgagtaaattaattgcgctaatcgttggtgcttggatcatgtattgttcaatgattggctcttatgatggagcgatggcgatcctagcagtttatcttctgctagtggttcttgatccactaaataaaaaaggtacgactgccgcaaacagtcgtaccgataaataaataatctacgaggtaattatatatgaatgagtttaatttatcaaaattaaatgccagggttggcgataattgtgtatttgtatcgaatttggcagttcgctatcaaagcgctgctactcctgaagagcgaatggcaatggccatcaaaatggagaatgctgctacgatgttacgcatttcagctgagcgtttggccactgaaactaagaatgtttacggaggtaagaacaatgactaacgaagaaaagattaaggcaattaaacaaattcttggaccagaatacgaggaggtagccattttcgctgctaaaaaatcagaaattcgtgacgaacgtactaattcattagttgatgcggatcccggaacggtagcagccatgattatgaattggttacatactaatccgatagcagcttcaattgtcaaagcaactattgatactttggaaactgatccaactgctgatttatttgcacagatttttctaggaggtaagaactaatgaatttatttgaattaaacgacaactacaaaacacttgctagtcgggatgacttagatccaactattctaaaggatacattggaatcaattaaggatgatcggaagaccaaattggacaatcttgcttcatgggcagatcatttgaagtcagaaattgattttatgaccgacaaaaagaagtcatgggaagaagaaattacttaccgaaaaaataaacttacttggatcaagaaatatattactgaagttcttgatgatgccggtattaagaaaataactactgaaaatcacttacttagtgcccggaactttaaggcctcaaccattattgatagtgataagaagcttccggataagttcaaaattactgagacgactactaagccagataagcaggccatttaccaagcactcaaagctggagaagaagtaccaggagcacatttaaaagctaaccgtaacacggtgattaaataatgtttgaactccgtgattatcagcaagaaacgattgataacatcatgaattctataagtgctggtcaccgttctatcatggttcaacagccgccacgaacggggaagacagttattatggccgagattgctagacgagcaacggcaaagggtaaccgtatcttgttcgtggttcatcggcaagaaattgtccagcaggttatcaagactttcaaagctaatgatgtaaatatggatttagctaaaatcggcatggttcaaacgattacccgacacgttaataatttggacccaccggcgataatttttgttgatgaggcccatcatgttctggctaaatcatatcgaaggattcttgatgcttttccgaaagcttataagttactgtttaccgctactccttatcggttaggtggacagggttttactgatgtggctgatgatttaattattggcaaatcagtcccctggttaattgaccatcactttttagcaccagttgattattacgctccttcttacattgatactgccaagttaaaagtaaaacgaactggtgaatatgacactgattcaatcaaaaaagccatgaagcctaaaatctacgggaatgcggttaagcactatttgaaacttgctacgggaatgcaagccattgcctatacctataacgttgatagtgcaattaagttagccaatgcatttaatggctatgggataactgcaagcgccgtttccggaaaaacgcccaaagaagaacggaataaaatcattgaggactatcgccaaggaaaaattcaaattgtaaccaatgcagaattatttacagagggcctagatttaccaaatgttgattgtgtcattatgttacggccaactcaatcattatcgttgtacttacaatttgcaatgcgctcaatgaatccacgggaaggtaagactgcaataattatcgatcacgtgggaaatgttgaacgattcgggctgccgactgatgagcggcaatggacattagaaggtagcggaaaaaataaacaacaaccaggaacaacgcttaaacctgtatcagtatgtccgatatgttttgcttcgttttatcgtacaagtgatatttgcccttattgcggggcggcattaggagaagaaaaagaaattgaagtcgttgatgatgttcaactaaaaaaagttactaagtcacggctagcgattattaagaaaattcaatcgtcagcaattatgaataatgttgctggcaagcgtccaaacgaattgaagaatctgaaagaaatacaagcctatgccaaattaaaaggttacaaaccaggctgggcttaccactacgctaaacagcgtggatttattaagaagtgaggttgatattatgagtattttgccaccaaataagccacagaaggcacggcgagttccaagaaattactttatctacggagatacaatgtccggaaagtcatatctagctgaacgttttccaagtccgctatttcttaacaccgatggtaatagtgagatgaacaccgcaccaagtattcaattaaagaatgtccgaaagagcgatggaagcttgaaagagtcagtgattgatcaactagacaagattattcttgctcttggtactgaaaatcatggttacaaaacagtagttattgatgtgattgatgatgtagtaacactaattgaacaggccatctgttatgacaatggagtagaaacgctgggggatgttccttacggcaagggatatgcacaatttaataccgtctttcaagcatttgtcactgagctaaaagccttaccactgaatacggtttacattagccggttaatgatgctaactgatgaatcttctggccacaccgaagaccgaccatcactaaaacagaaatattacaacgtggttaacggaaattgtgatttagtgattgaaactaagcgctatggtgaccgttatatccggatggttaaagatcgacgaattcattatgtcaaagatgatattactgatccggcaatcttacgggtacttgaacatgtaaatggcgtctttgataagccaaagcagactactacaaaagagcagaatgaaattgttaacaaaattaaaaagcaaaatgtaaaggaaggttaatgaattatgagtttacgagatgcaatgaataaagctactgaaggttttgatccaaagaatgattcagttaataaatttaagggactggaaagtggtaaatataccgttgtagttgcaaaagtagaaaaccatgaaactccttggaatgctgaacagcttaactttgagttagaagttgtcgatggagaatcagccggccaaaaagaattcttacaaattggattagatgaattaacttctaagggtaatcccaatccaatgctagaaactaatttacgattggtttctaagttagcagcaattctaggtgttgaaattcccgatgaagtttgggatgacgatactttaatctacgagaacttggctaaagcatttgcaccggcagtaggaaagaccatgattatggatttgaaggttcgaccaaacaagaagaacccccaatatccataccgtaattatgactttgatgaagcggaacagccggaaacgccagaagttacagatgatgaaatgcccttttaagtaaatatttgagtcagtgaacttataacaccgtatggctgggaggccattaaggaggaaaaatgaaaaatctagttaattacgccttagcctatcaagcaaagggtttaagcgtcctcccaattgctggcaagcgtccactaattaagtttgctgatcgtgatccacttaccgccgaagaaataaagaccatctggatagaacatccatatgctcaaattgcgttgcggactgataagttcttcgttgttgatatagaccgcaaccatgctgataacattgatggttttgaatcaattaagcaattaccagcggaatattttccggaaactttaacccaaaccaccaagcatggtggccgacagttattttatttgaaacgttcagatatgcgagttaatcagttaattggttatttaccaggtgttgatgtaaaggcccaccaaaataattatgttgtggttgcgccatcagaaggttaccaatggctgaataagaagccgattgttacggctcctaagtcgttagtagtgaatattaaccaaatgcgagccagtaaccggcgaagttctccagatgatttagtttttaaaccacgtgaacgcaactcaactactgacttacttgagaccatcgcaaatggattgggagataaaggaataagaaataaaaacttagctggaatgattggtgctttattgtttcggggagtagaaccaaagtctgcttatcaattagcgatgatttgtaatgagaatacgcccgatccactaccagaagaagaagtgaaccggacatttcaatcaatgctaagacgtgatttgagaaacgggggtgaaatacgtggcggataatataattcgcaaaccaattgaatttgaattaaatactcaaggcaatcctaaaactaatagtttgaagaatattggtttaatccttgatggcgatccactactgcatggcaccttcaaatataacgagtttgcttattcaattgatgttgttaaggacattccacagctatttattgaaaaggggcaacttgatgatagctattcagcaattatgctccgttacattgaggatgagtatggggtgatgtttcaagaaaaattgttaaatatggcaatcactgttgaagcaaaaagccacccatataatccggttaaagagtatatggaaaagtgctataagaattgggaccacaaagaacgaatcaaagacttcctaccagtctatttaggagtacccagtggtgaagtaacaacgctgcagacaaaattattcttagtcggagcggtgatgaaagtctataagccggaaagtaaatttgattgggtgtttgatttagttggtggccaaggcgttggtaaaactactttacttaaaaagttagcccatggttggtatacagaccaatttacggacttcaaagacaaggataattttgccaatatgctgcgggcattgattgttaatgacgatgaaatgacggccacaaataattctgactttgaaaatttgaagaaatttatctcagctgaagaattagagttccggccaccatatggacgacatacaatccgccggccaaagaattttgttatggcccggactactaacgaatcaacctatttgaaagataaaaccggtgagcggcgtttcttacctaacatggctgataagtcccaagcaatggctaatccggtaactgatcttgatgatacgatggtcaatcacatttggggtgaagctgttggcctctacaaagaaggcttttctttcatattgacgaaggagcagcagaagctcattgaggataatcgaaagatatttatgtacattgatgaaactgaaaatcaaattgaacgggttctcagtacttgggacgatgactggattgaaagctcagaaattgctcatcaattaggtgaagataatctggttaagaatcgttcattagccaaaaagattaagtatgtaatggataaccggcatgattggaaagcaggacaacggcgaattaaaggaattagtcatcgtggttatagaaaagtgcatacagataatacactatgaatatagttaagtgtatgcagaaaaaacctattacatcaacgtttattaaggtttgcatacactactacactattttaataataaaaaataaatatatataaatactatatatgcgttataaaaagttgaaagttagtgtatgcgtgtatgcagtaactaaatccgttgagagagtaagaattaagctgtatacactactgtatgcatagtgtatgcaaggaggaaaatatgaatgaattaaaaaacatcagcacatcagaattacttgatgaactgattgaacgtaatgcattatttcgtgtagattgtggtctttatcggaattgggagttgaagggaaaatatcaatttagcgatattaaattgcctagcgcatatcctatttatgtaggaaattcaattattgaccgcatgattaagtgggagtgtgagcattgacgagtgaacataaaattcaaaacgatatccgggttgcactatcaaaacatcagtgtacagtgttccgggtaaatgtcggttcggtaaaaacaccagatggaagatttttttcagctggtgtacctagtggtcacccggacttatatggatttcgttggtcggatcatcaagtattttatattgaagtgaaaaacgaaaaaggtaagcctagagcggatcaaattagatttcatgaaatgctaactaaacgagaaattattcatggaatcgctaggtctgctggagatgcagtaaaaattgttgaggaaggattgattggttatggatatgaaaataaaaaagaaccaccacaacaagtaaaattagttgaagtaattcaggttataacctctcgtggagctggaacaaaggaggatccgataagaaagattattcagtattggagcaaagaaggcacattattagcagaaagttttggaaactaatttttctttgagtcacgtttctctatgtgctttagttgtttttcaggaagactattataaaacttatcaatttgatttggctgtgttattaaattgtctgtaattatatttaacagatttaaaagacttttcgccatttcttggttatcagttaagtctatctcaccaggatgaacagcattatttccaacaattcttacaatatcaaacgcttgttgtaatttagccggaagtcccttagatactagatcaccaatacgattatctaatgaatgtttattggaaaattcttttgttagtttatctattgccagacgagacaaagcagcagatgctcttggtgaatctctaagtacttttgccgcttcaatataaatttgtttaatatcatcgggcatatctggattaggagctgttaattttaaaggaaaactaggaaagataagtatatcttcattggattgccgattatgaaaccaaatagaatctaaataacatgaagtgcattttgcaactattaaattatattcgtattgttttgattttattttttctgcatatttccaatcaaattgagcatatacatgacaataaggacaaataataggagctttccctgtaaaatcattactaaaatatttagtcattaaattcacctcaaataagattatagcgtaaaggagtagatgtaatgctacacaaatatagaaagttaccaattgtggaagctgaacagtttgatgggtcagatgaaatgattgaaaggtattcagtgcatgtatttaatcctaatttagctaaaaacatcttctttataggtatgaacgttctagctattggtgattggattgttaaggatgaatatgggaattatcaagtggtagctgatgatatattccgtaaaagttatgagaggtgcgactaatgcacatttatgaagtaatcgttgtagctgtatttggcacagatattagccactttgttgttgctaagaatgccgataatgctaagaaaattattcttgattattacagcactcgtgatgatggtatcaggccaactgtgacaatgtatgacctaacaacaaaattaatcaatcttaataactacattgatgaggtgatgcttggatgagattaagtgacaaaattattatgacttcctttttactgttattaattgtttcagtcgtcttatcaatagttacgggaagtaaagtctggatatggatttttctttttctgatgacacttgagatgctttacaaaatttggcgttaggagcgtgactaatgaaagcaagatgtggcgattggagtactgatgtttatccagttgaaccgtttgtttatgaagtagcagctgatggtaagaaagaattttatcaatcagcatgggatgcttttagttctgaattgcatatgaaaaatgtgacggcgaagattatcaaaataccagttgttccaatgagtaatgatgaaattaaagcagagagtgttgcatttgaattaggcgaaaaaaggcattatccacatgtggaagaattcactaatagtaaaccgaggaggaaagttacatttcttcaggttgcggaagcttttgcaattataacgtggattattttaataattcttataataagtacggcgtttatgtaggaggtaagttactaatgacatttgaagaggcgttaaaacatgaagaaaataatgtgccagtattctatagcgatcgaaaatattatgtaatcgggcacaatgagttaaccgaacaatttacaattcgtgagctaagtggtaatccgttatttacggtgccggttgatgtacaagcggaggaattgtcatgagtattaaaattaatgcgcaaacagttgtatttaagggacaaagttttattcctagcaaaagtaactgtgagtattgtcaatttccatttaagaagttaatggttactaaagcatctccagatccatcagttaagacagaagtaccaatcaaagttgacggtgaggtatttaattattgtcctcattgtggacggaatttacaagggtgaggcaatgttacttttaattgtattaatgatgattgtctttattgctgggttcctattgggtaagaaaaatccatgacgaaaaaaggacccaccgtaaaagatgtgtcctcactaaaaatatttaaccataattattatatcagatagcgagggtacgtcatgcaaacaagtttgaatttagatattgattgtctgaaaactgcaagaaaggttactgactttcttgataagaagctggatcgctatctggctttatcggggaagcaacgttttgatttgaagtcaccagggatggacggaatgcctaaagctcccagccatggtaacggtagtgaaaatcgaatgctgaatatctggttggcagaagaggttgttgattgtgtgggttgcgctatgcggaatatgacaaaggaatcacaacggattttactaaatcggtattcggatcagatgttaacgtataacattgctagggagctaagtattagttcagcaacgtatagtcgaaagcaggaaaaagcgctgtgtgagtttgcggaccggtttgaatttcagttagttaagcacggtattcatactgaaattgatgatctacacgtttatcttgacgaggaagattgataaattgatgatagattattgagcgagcaattcatgatagaaatgtgataatagtattgtcgaatgattcgatattcatataataatcttcccaaatgaagtctagctattatggctaggcttttgtattatgtttaattgggtgatttttatatgattgaatacttaaaaacatttttggaggctttgagtatgaagccaaaaactaaatttgttggagttatttttggaatagtacttttatgcttaaaaccatttttaattcaatataatatgaaatggttttacaataagttttcttggattattattttaattactttattttttgtagcctcattaataattgaagtaatagttgaagtatacgaatggggtagaaacaagtataacaaacataaagttgaaagagattacgaaaaatatatcttaggcttgtctgataaaaagttggcaattgtaaagaaactttacgctaatgaacatcaccaaggatatttaagacaaaacgatactaatgttattgaattggttaatatgtacgtaattatgcaacttaataatgaaattatagtaagagaaagccaagttgaagatataaacgatcctgaatttctttttgtattacagccaccggctttacacatcatagaaaagaattcagaaaaatttaaataaatttaattagtttagcttaacggctgactttttactttttaggaggtgagtagcattactcaaaaattaacacagaagcaacaacgatttgtcgatgagtacattatttcgggtaatgctactcaggcggcaattaaagctggatattctaagaagacagctaagcagtctggtgctgaaaacctagcaaaaccttacttaaaagctgcaatcgaaaaacgcaatgctgaaattcaatccgagaaaacagctgatatgacagaggtgatggaatatcttacttcagttatgcgtggtgagcaaacagaatcggttgctactgctaagggtatttatgaagacgttgaagtgtcggcaaaagatcgtattaaagctgctgaattaattggaaagcgtcacggcgcctggactgataaaaaggttatttctggtgatgttcagattgatgtgggaatgggggattatgatgatgaagagtgaagaacaatggagaaaaatcaaagatcatcctcattacttggttagcaataaaggtaatgtttacagtgagtataaaggcggcttgcttaaacagatgaaagatgcttatggatattctcaggttaatttaaaccgccgctccaaaaaggtgcatcgtttagtagcggaagcttttatcccaaacccagacaaattgcctgaagttaatcataaagacgaagataaaaataataaccaggtggataacttggaatggtgtactagcaagtacaacatgaattatggtgacgtggagaaaaggtcaattctttcacaacaaagccatagtacttggaaaatttatcaatatgatttaaacggtaatttggtaaaagtatggaattcagcgagagaagccgacagacatggattcaaccgtagaagtgtgtatcgctgttgtgatggggaaataaaatctttcaaaggatacatatggtcaagacaaaagaaggtgataccatgccaaacatcaaactaaattttcctaaaccatacaacgttttcaataaacaaatttttgataacttgtttgattacagtcatttcgttgaggtttggtactgacttatggcggtgcatcttctggtaaatcgcatggtgtggtacagaaagttgtacttaaatcactccaacactggaaacatccccgcaaagtgctatggctgcggaaagttgatcgaacaattcaagaatctatcttcgctgacgtaattgactgtttatcaaattggcaattgttatcgttatgtagagtaaataaatcaaaccgtactgttcatttaccgaacggtgcggttttcctgtttaagggtatggatgacccagaaaagattaagtcaatcaaagggttatctgatgtggtaatggaagaagcttccgaatttacacaggacgacttcacgcagcttaccctacgtctccgtgaacctaagcataagaaacgacaattgttttgtatgtttaatccagttagcaaattgaactggacttataagcaatggtttgatccgaaagtgaaagttaatccggaacgagtatcaattcaccaatcaacttacaaggataatcactttttggacgctgataacattgcaacgattgagaacttaaaacaaaccaacccggcctactataaaatctatacgctgggcgagtttgctacattggataagctggtctttccagagtttgaaaaacgtcggttaagtattcgaaccttatcacagcttccctcgtacttcggcttggactttgggtacactaacgatgaaacagcctttatgcacgttaaagtggatgagagtacccgtaaaatttacgtgatggaagagtacgctaagcacggtatgttgaacgatgatattgcccgaataattaaacaaatgggttatagcaaggaagttattactgctgatgctgctgagcctaaatcgattgctgaaattaaacgcgatggtatctcgcggattcgtccagctaaaaaggggaaggacagcattatacagggactttcatttatgcagcaatatcacttagtcgttgatgaccggtgtgtgaaaacgattgaggaattggaaaattatacatacaagaaggacaaacaaactggtgaatacaccaatgagcctgtcgatagttacaaccacgaaatcgatgctatcaggtatgctttatctgaaatcaacggaatggctagtccaaaggcaactgtaatgaaaaatatttatatttaggtggtgattgaatggaaacagtaaacggtaaaggacaaattttagatggccatatttttatctatccagctgatgaagaagaacttgatccgcatgatttactgtcgttcatgagaagaaatattcagtatgctaaggattacaagcataatatgcaaatgtatctaggtaatcacgatatcttagatcaacagcggcggatgtatgggccagataatcggctagtagcaaatttaccgcattatattgttgatacttataatggattctttactggaatcccacctaagattactttagatgataagaatgagaacgaagcattacagcaatggaatgacactaattcgttccaggacaaattgagtgaaattagtaagcaaacggatatctacggacgttcgtttgcttttatttatcaagatgagaacgcagacacttgtattgcttatgcttctcctacagatgccttcatggtttacgatgatacggttgctagaaaaccttttgcttttgttcgttactggaaagatactgaaagcggattatggaccggaatggtttattacgctaataaaattaaaacctttaaaggtagtgttgttgaagattcagatcaaaataatatgtataatttagtgccagcagttgaattttatggaaatgaagagcggcaaggtgtttttgataatgtgaaaaccttaatcgacgaattagacagagtgttatcacagaaagctaaccaagtggaatattttgataatgcttaccttaaaattcttggtcttgatttagatgaggatggtgatggtagaccggatgctaatttaattggtaatcaaatgatttattcgcctaatgctgatgctgctaatgccgatgtcgaattcatttcaaaaccagatggtgataatatgcaagaacatattattgaccggcttgtttcaatgatttaccaggtaagtatggttgctaaccttaatgatgaagcgtttgctggtaatagttctggggtggctttgcaatataagttacttccaatgcgaaatatggcagctaataaagagcgtaaatttactcaggcactccggaagttatatcgaatagtgtttagtgctgatcaagtagtcaaagataaggaagcctggcaagacttgctctttgatttcaaacaaaacttaccgattgatgtttctgaagaagctgatactttacaaaaactatcaggggttgtgtcaaaagaaactgcattccgaaatagtcgtttaattgatgatcctaaaaaagaagttgagcgtatgcaaaaagagaagcaggaagaaataaaccaagcgcttcaacattctgcttctgctacagatcaaatgctaatggatgatcaaaaagaaaatgataaagagatagttggtttccggaagaacggtgaatccgatgacgaagaagaataattattgggctgatcgtattgctcgggaacgtaaatggcaagaagagcaattaagtaaagatgctcaatttaatcagcgccttcaacagtattatgatcaagcaattgtccagattaataaagacattgaagatcagataaattctttagctgtccggaataaagtttcttatgctgaagctcaaaaagaagtgtccactaccgatattgctgattatgaaacagaagctaagaaggtagttcaggaagctaatcgtttaagagcacaagggaagcatgttacttacaatgatttctctgatgaagttaatgaacgattgaggaattataatacggcgatgcgatataaccgattgaatttattgaaatctaaaattggtttatcgatggttgaagccggaatgaatattgatgctgatatgcaagctaaaattggtaaagattatactgatgagctaaaacgtcagtctggtattctagatcattctaccgaaaatagttcgttttggacttctaaagatgttgcgaaacaagtaatgaagcaaattaatggagcaacttttagtcaacgaatttgggctaatcaagatactttgaaagctcaacttgatacggttatcaccaacggaattttaactggtaagaatccgcgagttgtagcaagacaattaagagataaagtaaaagtcactgttaaaaatcacagttatgttactgaacgtattgccaggacagaatcagcacgggttcagtattctgctcagattgaattaatcaaaaagaatggttatcaatttgtccactggattgcggagccaagagcctgtgatgagtgtcgaaagattgcgacgcaagataatggctttggtgatggtatttatcgaattaataaagttcctaaaataccagacgatactcatcctaattgtcgctgttcaattagtgagacatgggtcgatggtcaacgcaatatagcattatctgatgatgaacaggcggcattgaataattatattagttcagattcatataagattaatgatgatttgaggcgtaataagatttctaaaaataagaaacaatttattgaaaacttagatgccgcattggctaaaatgccaatttatcatagtagcaagccactccagcgtgattatttctttgataaacaagaagcattggatgattttattagtaattttgaaattggtggagtcttcactgattcatcatacatttcaacttctaaaatttattatggacagggcaaagagacaattcatgttattattaaatcaagtaagacaggaagagatatctctgagtttaattttaatgagcaggaagtattattccccagaaatagtaagtttaggattgatgatgcatacgttgatgataacgggaagatgacaatggtttggagtgaattagatgagtaacaagccttttactgataaacgttggcgagataattctttggaaggcgttaaatttgataattcaaaagtaacgtcagaacaaaagaagaagacagaagaattccatgagttattcaaaaagacgtttgctaaacaattaaaagaaaaacactcacataaaaagtaggtgatccaatgggaaataatgatttctttacggtaacgtacaaaatactaagttatcttaagtattgttatgaaaatggaattaatcctgatcctaatattcttaatgctgatacatttaatattagtaaagttcaatttggaagaactctacaaatgttaagcgagcatggttatatttcaggagtgagatttacacaagccaaaatcgaaggtactgttgttggtggactccacaatacgtcaataacggttgaaggtctgcaatatttagctgaaaactcaatgatgaaaaaagcatatcgaatttttaaagaagtcagagattggcttccgggtttctaagcattcacaaattagtgagtgctttttgttttggactttttacttgttgcagtcgttaaagaacaacccggatattacagtccaccggactataaacgaggtgtatttatgtttgaaaaattaccaatgcgtttacaattctttgctgaagatccaacgccagatccagataatgatggtgcacctgaaggaactgatgatggagataacggtaaaagtgaaaagacatttactcaagcagaattaaacgatattgtcaaagcccgagtcaatcgagccttgaagaataagcaagaggaaattgaccaggctaagagtgaagctactaaacttgccaagatgaataaggatcaaaagcaagaatataagcttcaacaaactgaaaaacgtgcccaagatgctgaagcagaattggcccgttataaaatgcgtgatacagcgaagcaacaattaattgatggcggttatgacaatccaactgatgaagatatcgatttaattgttactgataaagcagaaacaactaaagaacgtggtgaagcatttcttaaagcttataaccgaattaaagaaaatgttcgtcaagaactattaaagggaaagtcaccacgaattaatggtgctcctgctactgcaatgactaaagaacaaattgcaaagatcaaggatcccgtcaaacgggtccaagccattcgggataacttatcccaatatgaaaaataaaaggaggaatataaaatggctgaaactaatttaacgacaagtacagacctagttgcacaatctatcgactttgtagaacaattctctggaggaatccaaactttattgaatgcattgggagttattcgtatgcagccaatgactactggttcacagattaagatttacaagtcagaagtaactaaggtcgatggtaatgttgctgaaggggaagttattccgttaagtaaggttactcgcaagctagctaatactttgacattaggatttaaaaagtatcgtaaggtaactaccattgaagctattcagtcagctggtggtgctacacctgctatcgtggatactgataataagctacttcgagaaattcaaaaggatgttaagaaggacttatttaattacattaccaagtctgatgcaaacaagactaccgcctctggtgacgattttcaaaaggcaatggcggcagctttaggacaactttcagttaagtgggaagactacgacacacaaactgtcgcctttgctaatccgcttgatctatatgcatggttaggtaaccaaactcttactgttcaatctgcctttggtttgcaatacattcagaatttccttggctttgacactattattctaagtgctgaagtaccacagggaacgattgctacaacagttgcagataatatcaattacttctacgctccaatttcatccgttggtcagttatttaacatgacttctgatgaaactggtttaattggtgtaactcatgatgcagttaataacaatttgtcatacgaaactgttgtaacaatggctaatgtattgactacagaacgtttggacggcattgtattgtcaacaatcagtggtgctaagtctgctggtaagtaggtgattgaatggaccagaatacggttttgcaaaacttaaaagtaatgcttgaaattaaaaatgatgaccgtgatgctttgctgaaactaatcattgataatacagaccaagcattgcgatttaagctagaactaactgaagacgaaaatttacctggagaactaggttatattgaattagaagtttcagttcgacgattcaatcgactgcaaaacgaagggatgagtcaatatagtcaagaaggggaaagtattacttttaattcttcagattttgatgatttccttgatgatattgatttgtggaaacgacgacaccagaaagatgttaaatctttaggtgccgtttcttttattaatccttatgcggggatgagtaaaaatgcgaaaaacacagataattaagttttattttcaagatgaaaatggctataatccatatgcagaagaagacacgattactagtcctaagctagtagcacaacggtatgccaatgttactgatgtagggacaaatcgcctagttgaattatttagcaggctagatcagaacgccaaggtaattcgattggagtctccagtaaatgactcttggtcatatctgactattgatgattgtcctatcaagtatcgtcttgaaacctgtcggaaaccattaaaaggcacaacgctgattgtaggtgaagccagtggctaattcttttaaggttgatgttaaaggtactaaagaactagcgaatttcttaaagaagaataaagatttgactccagttaaacggatagtcgcaaaacatggagcaggtctcaaaaagcaaacgcagcaaaatatgaacaatttgtataagggccactacgaatggaagaagggggctgggctaacaatggttagccctaccgggaatactagacggtccgtaacaaatacaatttctaataatggtttaacagcaacggttgctccacaaactgaatatttcccatatcttgaatatggaactcgctttatggcagcacgaccgacattacatccagcgtttgcaattgagtctatgaaatttgctaatgatttgaataagttatttaagtaggtgagaaaatgtcaccaagtattgaaatttatgatgcagtttttgctcaggtccaaaagcattatcagacctacgatcacccaccgcagttaaatgaaccagttacctatccattcgtggttgttgatgatagccagtcgattttgacgaactataaaacagccacaggaatgcgggtaactttaatagtccatgtgtgggggaagtctaaccaacgtaagactgttactaagatggttgatgaaattagtcgtctggggatgcaagcagttcggacgaaacattatgcttggcaaggacgacctaatgagcaagaacaacaattattaactgatacgagtgttccgaatactgtgttaaagcacggttatttaacactcgtttttgatttgaaataaaggaggataaatatggcaacatatccagtattggaagggaagaatgcagttctttttgaacgactattagaaaatgcaaggaaagagccggcacaattgatcccgtatcaaacatcactaagttatgatcctaaacgggatactgattcaacaactacgaagatggggaatgttcctactgcttctaatattgaaacagatttagaagtagagttcctaaatgcaatttccaaagctgcagatgatgtttatgattctttgtactttaataagaagattgaagtatggaaggttcatattgatcgagtccggtcagatggcaaagtttatgccgaatatatgcaaggaattgtgtcagaagactctaatgataacgacccagacgatcattcaactcgggatgtgacctttacgattgatggcgtggccaaacgtgggtgggtcactctaccgccagaaatcaaggaagaaattgactatgtattccgtggcttggcacagcttaaaggcgatgacgacaacggtgaaggtgaagcttttgctgatggcgatcgtggtgctggtgcaaatgaagcagtaacaactgaataggaggaagattatgaagttaaaaattaatggtcaagaccaatcatttgtattcggagttaagtttttgcgaaaacttgatgcttatcggggcgctgaacaagaaatccaaggagttaaggttaagctaggaatggggctagccatgatgcttccccaattaatgactaaggatgcggccgctttggcagacgtgttgtactgtgcggctaagtctagcattaagttagatacaattgatgattatattgataattgcaaggacttggattcattatttaatcgggtaatgaatgaaattaaggcaagtaatgccgctaagccgattgcaaaaaatctaaaagcctagatggtcctgagcttagttcagaacaaagctatcacgaaattcttttgaattcgttggcttatctaggctttcataatatttcagaaattgaagaaatgggattggctgaatatcagctccggatggaagcctataacctccaacgggttagccaggaacgagacttagcattgcaagctttccttaatcagtcggtacaagcgacgaaagggagcgaaaagcacccaattccgaagtataagaagtttagccaattttttgattatgataaatttgttgatgatgttcgtgggcactatgagcctgactatcagccaacaagcaaggccagccttgaaaagaaacgaaatgatctaatcgtcaagcggtggcgtgaattccggaagatgaaacaaaaacagagaggaggtaatggctagtgtcacaatcaatgagagttgaagcggtattatcagcatacgatgagagttttagcgcaaccttagataaggcgcttaaatcgattaataatttaggccgtgaaacccagtcaacctctcaaactgttagtgcaggtggttctagtatttccagtacctttaaatcgatggctggagcaatgggtgtagttgcgattgctggtaaagcatgggacgttgttaaagattcaatgagtggcgccattaaccggtttgatacattaaacaagtatccggtagtaatgaaggctttgaattattcaactaaggatgttgcaaagtcaaccgctatcttatctaagggaattgatggattacctacttctttgcaagacgttacaagtgttgcccaacaattagcgccattaactggtagtgcaactaaggcttctaagtcggcgattgccttgaataatgccttccttgcctccggtgctagtgttgccgatacctctcgtggacttcaacaatacacacaaatgctttcaactggtaaagtcgatttaatgtcttatcgaacattgatggaaaccatgccaattgcattacgtaaagtcgccaattcatttggttttactggtaagtctgctgaacaagacctttataaagctttgcagtcaggacaaattacggtagatcagttgaatgatcgttttatcaagctgaatggtggagttaatggttttgctcaattagcaaagaaaaatagtgaaggtatcggtacatcttttgcaaacttaaaaaatgccgttgtcaaaaatctggcaaatatgttatcggcaattgacaatggttttaagcaagcgggctttggaagtattgcacaagtcctagacaacatgaagggtagtattaattctgcttttcaagttattggaccagttgttactaatgctactgttgtagttcttaattttgcaaaggttataggcggagcgcttaaatctgctttcagtaatgatatttttaaaacagcagttgtgggaatattaggctttgtgggtgcagttatggcagcccataaggttatttcaatatttacaacattaagatctgcaatagttggtttaagtgtgattacaaaagctggtaatttggcaatggcgtttagtgaagcaatgtcaacacttgctaaaacttctaagattgctggtggagcgatgaaagcattcagtgcggtggcctcattaggtccctggggaattattgctgttgcaattgcagctgtggttgcagccttaacttatttctttacccaaacgaaaaccggtagggctttatggcaaagttttactacgtggttatctggagtatggcagagtttggttggagtggctactactgtttggaatgcaattggtaatgctattaatgcagtagttaattttattaaaccttattggcaaggattattaacattctttaccggaatctggacatcaattgtggcgggtgttgctccaatttggcaagggttagttaatgtctttaatagcattatcagtgcaattttagccgtttggcaggctttagctccaattattgttccgattgtagctggtgtagttgctatcattggggcaaccctaattacgattgttaccgtctttcaaactgtgtgtaatatgcttgtacccattgttcaagttgtatggcaattaatttcaacagttgtatctactgctattacgatgctaggtacaataatccaaacaggcttggcaattatcgttgctatttggaatgtggtctggaatacattcagtattgttgtaagtacggtatggaacgttattactactattatatctaccgtgctgaacgttattgcgggaataattcaagctatcactgctgcaatacaaggcgattggtcaggagcttggaatgcaattcagaatgttgtatcaactgtttggaatgcaattgccagtattacttctagtgtattgaatggaataaaaggaatctttgatggtgtaatgaatggtttaaagagtattacttctagtagttggaatggtattaaatcgctattcagtgaaggtgttaatttcattaaatcagttgttcatatagatttaggtgctgctggtagagctatcatgaattcactttggaatggaatgaaatccatttggaatagtattaagaattgggttagcggtattgctgattggattaaagaacataaaggaccaatcagttatgaccgtaagttacttattccagctgggcaagcaattatgaatggtcttaataacggattgattaatggattcagtgaagttcaatcaaacgttagtgatatggctaatcaaattcagcaagctattactaatccaggctttgatattggagcaagtattggtaacttgggttcaattaattcaaattatactggtagcctggcaattcaagatagtcagttacaaatgcagaataatgctttgcttcgtcaattacttaataaagacacgacaatggttcttgacgatggcactcttgttggctatacagcggatcaatacgattatcgcttgggtcaaaatacagcattgaaggataggtggagccgatgaaattcttaaataatgactattcttttcgtggattaggacccacaaaggatgatccagaatacttagaaaatgcagaatatatcgactttgccggttttaattcttctgattatgattggtggttgattgatcgaacagcaactacgccagaagaacaagaaattacagaaagcgtcccttacatgcaaggagaatatgatttctcaatgtatgatcaggaacgtttttttaagacccgtgagttgacttataagtttgtatattttggtgaagtttatcaggatcgtaaagcttacgaagaggagcttaaacggcaattactgccacatggtttcactaaactaattgattctcatgatcctgtttactactggtcagctaagtgtactagtgttgaggttgaggatgaccaagaaaagggaatgctcacagcaactattactttcaaggcttatccttttgcttatactaatcataacgagggcaccgattattgggatgatgtcgcatttgatcattggatttggcaaccagttaaattcaatgttaacggtgatcaggatgttaatgttaagaatatcggctcacgaccagtcgaatgctcatttcaattgacagggtccataactttgaagaacgattcaattggtgaagtaggtttaactcaagacaattttaaaacaaccacgattgtattagagatgggtgacaataaaatgcatctatccggaaacgggacaattgaatttcaatttaagcgtgaggagatgatttagtgtaccgaattattggttataatgaaccaacagataaagcaggatttattgtactggatccccgagttaatcgtcatattagttcgggaaaactcacgcttaaagaatctaatattgatgatttgactattacggttaatcaagcaagtccattatgggacaacgtaaggccttatcatactcatgttaacgtttatgatgataatgaacttatttttcgtggacgagctatcaaacctaaaaagtcgatggaagaaagcggacaattcattcgtgaatatgtttttgaagatattgaagcatatctcatggatagcacccaaagattttatgaaggtgttggtcaaacgcccaaagaatttttacaaactttaatcgatgttcataattcacaggttcctgactataaaaagtttcaagtccggaatgtaaatgtcactaataataaggatgaccaatatcgacaaattgattatcccaaaactagcgatgctattaatgataaattagttaaatctcttggtggttatattgtgactacttacaacgctaacggaataaactacattgactacttaacggatattggggttgatcataaagatgatactcctattcagttagctaaaaatatgaagtctgcaagtatgcaaattgatcctactaaggtgattacaagactgattccactgggaaagacactagaaccatcaaaagttgatgtaagtgatgatgatggagagggcggttctggatcattagatagccctgaagaattttgtaaatcagaaattaatgctacttggggtagtgatattaataatatgaaacaagattttgccgctcgttcttcgagagttcgggcttggggagtggacgttaatcgtttatatgatgtggtgaaaaatgctggagtaagtcctgaatggttctttgcttatgaacttcaagaacaaggaacttactatggatggcttaaccatacttatcgacacggtgatgcgtatagtgatgcgcaatctgtttgtgagtggattaaaaattgttcaaatagtaattccattaatccagcatggagcgcaccggaaggatcaatggcgccgaatcaagcattagcggataaatggaatcaagagtttggaaaaggtactattggccgcgtttatttacaagggactgccgctgctgtttgggatttagctggtcaaacgcctaatccagctattggaaagccaattagtggatgcatttcttgtattaaacgttggggtggtcattctaatgcagctggtggtacatggggatggccttttcctgatgttggggaaggtcatttttctcaagttcagagtttcggaaatgatggcggatatcgtcaaaatagttatcacgatggtgtggattttggatcaatagatcatcctggtagagaagtgcattgtattcatggtggaacggtaactatcaaatcagctatgggtggcttaggtaattttgtggttattcatacgccggaaggattcaatatcgtttatcaagaagcttttagttctccctctaatattattgttagtgttgggcaaaaagtaaaaactggtgatgtaattggatatcgtgatacagaccatgttcatattggcgtaactaagcaagatttttatcaagcagttcgaaattctttttctcctgcaggtggttggctagatccagtaaaactaattaaagaaggtggcgatgggtctaaaccacaagaaggaaagaaagatcaaactgttgataatagtaatgctgcacgtcctaaattaaccattactactgtcaataacggtagagactatattgatattcctgatttacaaaaagaattcggtattattgagggaactgttgaatttgataatgtagatgatccgaatgttttaatgcaacaagctcaaacatggataaaggctcaaagaatacctcaaagttgggaagttacagctttagaattacatatgacaaacttcaaatcttttaaggttgctgataggtacatgtttattaatccaaatgttgcaaaaccccaattattacgaattactcaaaaagaaattgatttactaaagccccatgcgtcttcattaacgattggtgataagacgatggggcttactgattatcagttagaaaatcaagtcaattttcaacaatttaaggaaattcgagtgatggttaatcaggttgtccaaacccaagagcaatctgctaataacaataataaggttatgcaaaattttgctagtagtgctgatcttgcacaaatgagacaggatctaagaaatcttcaagatgataacgatcgtgctcgcaaaggaatggtttccttagaagaattcaataaactaaaggaacaagtagaaaaactaacaacaggaggcgatgataatggcaagtgaaacctatgattatgagtcatttgataatacggatcatactatgaaacaaatcgctgacgctattcgtcacaagggttatggaaaagatgtgcgtgaggcaattgcacagggcttcgaaaacttagataaacatttaagtagtattgaagaagaactgaaacaacaagaaaagaaaaagtcatcgtctatggatgatatttttaattcttttggtaagaaggagtgatgataaatggcaaaagagattagtaatctgattacctttaacacctacaaatttgaacgaggcggccttttggttgatatgtttaaccaatttaatgctcgtgtaggagatcaaggaacggaattagccatccagtgggaaactagtaagactgaaactaaaattaatttaaaagaacgaggattacatttctttgggacaggttcagttggacagtaccttgaaaaattagaagatggaactggctttaagatgtctgcagatgcatctaccgttgaatgggaagataaagatgaagctggtagtttagacgatggaattacggttgttaagttgccaaaacaatttttccctcaaaaaggtattttctttggttactttggcctaaaagatagacaaggtaatatctttactagtgttaatgtttggttccgtgttcttggcggtgttccaacgatgggggctgctattccttactttgttactgaatttgatgaagtattagagcgatgcaatggtaagattattgacgctttagcagaattacgtgaaaagtaccaggcagaagttaagaagaatgaggatatgtctgcggaaacaagagcagcgttgagtaaacttgctgatgctgttggtgcaattcaagcgcagattgatgcaggtaatgtaattacacgtaaagaatataataatcttgctaatcagattgataatcgccttagtaaaatgacacagaacattgagagtttttcatcactcgatgacttaaaagctcaatatcctaatggaaaagatggactctttgttactaatgacaataatcataagtatcaatacaagaatggatcatgggtagatgaaggtatatggacagttactacctttgatccagaaacgcgacgacgccttacataccttgatacatctaattctattttgcaaaaatcactcagtgaattgactaaagaagtcgttgatataaattggtttttaggcgaaattgatgcaaatactggtaaaattacacctcacgaaagttttaatcgtgcatactcatcactcaaagtaattggtaaatcacatgcttttgaatttttgcttaatactgattatttgcaatatattagtatttttgaattcaattcaaatggggagattattaagcacgatagtgttggcgataaagcgatatatacatttgaaaaggatacgactgcggtaaggtttcagattactagtactgctgctactatgaagcaaaatgatttacgcgatactattcaaaatagtgggctaaaaattatcgatcgaggacaccgttcagtaattaatgatattgatcatttatatatccgtgaacatttaatgccgattgaagcaattgaaggctatacaattaacactaatgttgattatggtgaaactgttgatgtatcacatccaatagtaacgtctgcgtttcaatatattaatcaagtatgtaagccgggcgatattttcgtaattaataatctatctggaggctttaacgcaatggcttgggcctttattgatagcgagaaccggttaattcaaaaatctgaagtaaacttatctcaatctcaggttactttatatgcgccaagtaatgctgcaaaattaattatcaataatatggatagtaactgtacagcatatagatatactccggataaagaacatttagctaaaattaatattgctttaactaccaatattcatcgaaatatcaagttagcttatcaaacaggagaaacagtctcattaattcctgaaaaagtaagtaattacaaatatattatattagattgtaattttaatgatgctttcagaataaagggttatggtggattgaatccacgattatatggatttatttctgagcaaaacacattaatgaatgttgcgcctgcaaatgttaatgatcaattaactgatgtctttatcaaaacgccaaaaggcgccaaaaaattagtagttaatttcaatcttgatcaacaagtaaatcccaaacaaattgctgaactttataagcttccagacattaatgttattactgagcaaaaaataaaaaagaatttattgaatcaacaaacagtcgatacattaatttctagttatatgaatggtatattacttggtaaagatttagccaatcatcttgcggattttgctaaaagcggcgataaaatggttcatgtatcaacgttttataaagttaacgatactctttttatgtcttattatgctaatacaagatcggcttacgaagatccaacccagcatacagcacgattagtttatgcaccgtttgagaatctaaatcaacaaacgtacatcgatgtagccgacattggacaagaatataatggtcaaaagattgaagcaatatacgattctttgcttcttaaaacaagtgatgattcatatatgatctatgcctttactgctaaggtaggtggtaagttctatatgctttaccgtcgttttgatcctaagactaagctgttgagcgatattcatacaatgaattttaaagttggagtaatgacgtcgacatttgatacagtaagcgttcatgatttgttagctaaggcaggaattgactatgattatgaagatcgtgatatttcctttgtccaaaaattaagtccacggattgaagatggcgtagtgcaatactatgcaggtatcggaatcttacatttttgctttgtagtaaaatcaagcgacttaatcaactggacttttgtcagtactccagactttatgtacaagccagaatttgaaccttctgtatatgttaagggagacaatgtttattatttttgtcgtcagcgagggacagaaggtaatgcagttttagctaagtataatatccctaatggtcaatggtcgaatccgattcttgtaccagatactcaatcacgctatgactttttcgagaataatagtcagttgtaccttgttcattcaccgctagaccgtaatcatattagtttgatgcagattgatcagaatgttctggaaaagagctatgaagtagcaacagcagtagtacaagattgcttctacccatttactcaaaatattgatggtcagatgtatatgagctttacacaaagtaggcaacatatttggctaaataaatttaatccccacagtctgctagatagtgatgtagcaactattttcagtaatttaattgagtagcaaaacatagtcgccttataaatacacaatacatagaaagttgcattgcttaaatggaaacttaatgggcggcttatagacttttattatttaaaagagtatactggaattattctttttattgggaggaaatataaaagtgacaactaaagtgagagataaatcgcttgatattatccgggggagcatccttctagttgtcttgggtcatatatctgggataccttttgagttaaaaaagtacatatattcttttcatataccactgttcttttttgtttcgggatatttgttcaactttgctaaatacaggtatttttcttataaagagtttataaaatataaagctaaaaaatatatcctaccttatttcagaatggggttgatatgtttgcttctatttggcatagtttatccactatttgctgaagggtttagtaaacagtatatgcttcaatctacaaaatatgttttaggtttactatactcgcgtggaggtcctaattatatggcctggagttcgccactttggtttctaacagccttatttattgcagagattattttttttgtggttctaaaatttaattttaaatatccattaatagtgtttggaatcttagctatattgagttatatttactcgattacaattaaaattccgttaccgtggaatattgatgttgcaatgtttgcagtgttattcatgtacctaggctttattacacacaaatataatttaactaagcacattaacttaccggttttcttacttttgattgttatttttgtattatctgtagcttacaataatgagattgacatgaatttaagaaactatggcaatggatttttaacaattattagtggaacaataggtactgttatatgcttgcaaattgcgcgattgttaaaagagaataagatattagagttttatggtaaaaacacattatttatcatgggctacacgtatgctgtgtttaattgtattttggctttaagcagccattttagtactgtaaagaatgttgtagcttcgtttttgattcaaattataattttaactttattaatagtactgaagaatttattcaaacaaataaaaaagcccatttatgcatatactaggaaaattaacaattaaaaaaactaatacgtcctactcagggcgtttttattttaccttcaaaggagatgatcaacattgccctatcatttatttatgctgcaccaaatgcagacattagttgatgataaactaatgtgggcttttacaatcgtgatgattgtagatttaattacgggaatgattaaaccgtattatgcaaagaaaacaattaagaaaactaatagttcagttggaatccctgggataattaaacacacagtaatttatttagtggtagtaattgcttatccatatctttatacgattggagcaagcacgatggctaccacttttttaattgcttggatttatcaatatttaatttcaattgtagaaaattggacagagatggggtggtggttgcctaaaccaatcatggatttctttgaagccaaattagctaaggatcaagaagattatgacccatctaagtacaattttcttggtaaatataaaggaggtaaaaagtaatgacagaacgaaagacagtaattgatttagctagttttcagagtcacttaacagttaatgattacaaaaacatcggtgctgactatgcaattgttaagacaacagaaagcacgaactatgttaatccttacatccggtcgctgattgatcgaagcgcaggtggtggaattaggggttatgctttctatcactttggccgtttccataatgatgcacaagcggtagcagaagccaactactttatcgccaattctaaggcacaggcaaatgtgcaacccggtacattaatgattcttgatgctgaaatttctaacatgccaacatcatcagtaaatgtgttcttaaataccttacgcaacgccggttatcacactggtttctatacgtataagtatctgttgcctaactttgacttagagtcaatccatcaccatatggatatgttctggttagctgcatatgtatatcgcaatggaacgccagcagggaagaacccagactttaattacttcccgtcagctaactatattgatatgtggcaacataccaataatttgcttggctacaatgttgatggctctatcacattaaccgataatgcaatcaacctatttaatccaagcgaagcaccagccccagagccaaacaaaccaattgaacaagaaaagccagcaattaccactgaacttccaactaaccattgggttgatgatcttggtgatcgttggtttgctgaaaacgggacatttattactggcactgcaattaacttgcggtggggtgctaagactaacagtgccttaatcgctaccttaccagctaatagtgaagttaagtatgacgcttggtctcgccacgatggctatgtatggcttcgtcagccacgaccaaacgctcagtacggttatcttgtttgccgtgatgcaaataataaccagccgttcggtacgtttaaataggtaaaaatttaattagccctagtggttattgcataatttgcgatagtcactagggctttttttacgaacacacaaaaatcacacaaagaccagttaaagcctaatataataggaagagttttgcccaccggaggcatattagtactttggtacaaaattgtcagctaagctaatgaaataggagaaggcttgttatagcaggctttctcctattttttgtgcgcccggcatgggtattagctaggcggtgagagtccgctatgggccgtagtagtcggaaccatgagctgaggacaagggtgtccactgtgaggtggaatctgaaggaagtctaaggcaaagtactgcaccgatgaacaagaagtagctataaggctggaactaactggataagactgcatgacaagttaaagtccaacactactcgaagttactttcagtaaagctaccggtgacatggtacgaaagttaatatccttacccggggagatctggcctacacgtttccgacaagaggaataagtttaatttccacagaaacaagcggtgcagtgatgtagcgttgagtaagccagaagtcagccgaggtcatagtagtctgagtaatcagatgaaggactgaacgacaataacttgtaacttatatcggaggtgtaatcaggtgcgacaatcgcagaaaacagaacaacaagctgaccgcttgtcgaggataggtttggaaaaccgaaagtacacaagggcgcgtagtaccgattatggtgaaggtaaaggtatgagtgtcactatccaagacttagtcttggaccgcaataaccttaatcaggcttatttgcgagttaagagaaataaaggggcagcaggcattgacgatatgacagtcaatgaccttctgccatatctcagagaaaataagacggagttgatcgctagtttgcgtgagggcaagtataaaccagcaccagtcaaacgggtagaaattccgaagcctaatggtggagtaagaaaactcggaataccaacagtggtggaccgaatggttcaacaagctgtggcccaaattcttacacctatctttgagcgtgttttctctgataatagttttggcttccgccctcaccgtggggctcacgacgctattgcaaaagtagtagatctttataatcaaggttatcgaagagttgtcgacttagacctaaaagcctattttgataacgttaatcatgacttgatgattaagtatctccaacaatatattgatgacccatggacactaagactcattcgtaagtttctaactagcggagtcttagaccatgggcttttcgctaagagtggaaaaggaaccccacaaggagggccattgtcaccactactggcgaacatctatctaaatgagttggacaaagagttgactagacgtggtcaccactttgtgcgctatgcggatgattgtaacatttatgttaaaagtcaacgagccggagaacgagtaatgcgaagcattacccagtttcttgaaaagcgattgaaagttaaagtgaacccagataaaaccaaagtcggtagcccgctacggttaaagtttcttggcttttcgttgggtgtagaccacaatggagcctacgcccgtccagctaaacaatcgcaacaacgagtaaagaaagcattgaggttattaactaaacgtaatcgtggaatatccctgacaagaatgtttgaagaaattcagcgaaaaatgcgtggatggcttcagtactactcaattgggaaactaactgactttattcaacgccttgacaagtggttgagggtccgaataagacagtatatctggaagcaatggaagaagcttaaaactaaggtaactaacttacagaagctggggctgtcccagcgtgatgcatatgtcttcgctagtacccgcaagggctactggcgaactgcacacagtaagaccttgagctattctctaactaatagaaaactggaacaactcggacttatgaatatgtccaagacgctccagtcaattcaatgtgattaagttgtcgaaccgccgtatacggaaccgtacgtacggtggtgtgagaggtcgataattgaactaatcaattatctcctactcgattgtttaaattttgattttaaagaaatggtacaaaatggtgcaaatttgtataaccggtgcacggtaagcagtccatattgacacgttattgacagacaaaaaatccccgtagaaccgtccttgatggcttcacggggattttctattcgcaacattcttcttgtacgttttttgaccacggcaaaaaagctgccagatcttgacaattgctctctggtaggtgatcaaacaagtattctaagtaccgctggacgttaagctggtttagtttagctgtctctactaagctatagtagacggcgttcgccttggcaccttcttcggtttttgcgaatagacaattctttcgaattagtgttgatggccgaatactttgctcaactgaattgttgcttaacggtaattgtccatttttttcaaatacatgatacactcgtgattttaactggatggcgttctgaattgccttacgcaactgtccaatcggctggctaatctggctaatgtaattgtaaaatttatccattagcggtttgacatggatttgccgctgcactaacttctcattggccgtttgataactcaactggttttccgaatggaaaacctgactaagaagagttattgcttgttgcgctttggacgccttcattgtttttggcagtgctttgaccaatttgacaaattctcgtcgaatatgcactaagcacgaaccaaattttgcttgcggatagagttgattactataccctttatacccatcgcacatgataatacccggataattattaccgactatttgtccaatgattctaccagaacgcgtattggcgtgatgaaagactacaatcggatgttgggcaaactctttcgttgtccgcgttacccagaaatagtcttgggatttaggactatcaacgactttaaaaggtgtttcatccatatgaatgactggttcttgtctaactgtattgcttaaatactgatacaacggctctaagtacgtttgactaactttaataatattcgaggccatttgcttggcgctaacaggtaatcccaacccttgtacaaagctttcttgccgatggaaaggcaacgccagattaaattttaaataggcgataaatgccataatactgcttgaaaagtaactatgtggtaataaagccattggtgccttactagttaccaatttatcatttccatcttgactacagtgtttacacttatagctttcctcatataagttggcacaatacaattcaggctcttttagtctagcttcccgtcgtgctaacctctttccaatgtgagccattttgtgctgacaatctggacaggtggtcgtttttaaagaaacaacttcctcgacttgaggaagttggtctaaaaactcttgacgagttagctgtttcttcgctggtcgatgacgtacgatcttagtcgttgttgttttaactacttcagtaatctcttgatccaagttcagatcatcaactggatcaaacagtgataattgtccatcagctacctgctctaaaacttcagttttttttccaaaaattatttcctgcagttgcttaattgtaattgcttgttgttcaagttgttcttgagctttcttcaactgcgcacgtagtgcttcgttttctttctttaatgactcagccattgtacgtcacctccaatctaataaacttttgttattatatcagagctaaaacagtttaaaaagagcttagtatagatttcctggtttgattgtatgaatacgtcgctcgggaaatggggatagacctgtaaataaggcatttagttgctctggttttagttctttaacttcacttttgttcttaggccatcttaaactaccattttcatatcttttatatagcagaatgaaaccttcatcatcccaataaagggctttgaaccgatcattgcgactaccacaaaataaaaagagcgaattattatataaatccaatccaaagttttccgcaactaccatcgctaaaccgtcaattcctttacggagatctgtcttaccacaaacaaggtaaacatgctccggtgcctaccaattaatgagcataacgaataaccactttagctatatcagtcgcaagactgggattagctcccttaaagatcgttaattcaatgttatcagcttgtagttttgcggcgggtcgaggaataaattcttccttattaactactgaattcttggtcttaaaaattggtgctacaatatcgtgttttccttccatagaaaaagcctcctgtactaagattgcttttagtataggagactaagtttttgatggctagacgtgtggatacggactgcttacagactatcatcagtaaggagatttttaatttatggcagaacaaaatgaaattatcaccccagttttcaaaaatagaccacttaattttaagaggtatgttttgctgtaaaaacatacatgcgaaagagcaagatttcattgaagcttaattaaaattaaagctagtctcttttttcttgtctggtaagttttttctaggtactattacatagatggagggatttttaaatgattaaagttcgtcaaatatctacaaattcaaatgatttcaaaaatatcaagcgggtttataataccgtatttccacaaaatgaacttttaccattatctttacttaaaatgcgtgctaaagcaggaaaagcagaattttgtagcatttataatgaagagggaaaatgggttggctttttctacacagtctacaacaagcgcatcgcctatattttctttctggcaattgatcctcactatcatggacagggcttgggtagtgcgacgctaaccgcgatcaaagaacggtatgctggaaagcagattacccttagcgctgaacgcccagatcctcaagcacccaataacgaacagcgactcagacggcatcgtttctacgccaaaaatggttttggcaaaacgggtctttataccgttgaaaaggataatgaaaaatttgatcttttaagtatacaatcaagcgtgaatccacaattttaccaacagttaatggatagttatctgactaaccatcgccgccattacttgccgtataaaattgttaaagagtaaaaaaatccccactacctgcatgagtagtgaggatttatttagtttttctgatctttaattttgaatgataagagcagtgccaccacaattaagataattgcaaagtaaatgccgtagtggaaaccattggtaaagcgaatagcttcggatccactaatagaagaactaccccaagccaagcaaccagtagctaaggctgttgcaagcgcaccgataacctgttgcattgtattcatgatggtactgccgtcaccagattctaatccagaaagcgtacttagagcactagtttgtgcaggagacattgctagaggacaaccaatcattaaaatgatatgggcacagattacataaagaagtgcactatgtgatgtagtgaaggccaacatcaaagcgccaaataaagcaaggacaaaaccaattaaaacaggacgtttagccccaatactatcgtaaaggcgacctgcaactgcagaagtggctgcattaataattccaccagggagcattactagtccagtaagggcaacggaaactaagagccctcgttgatagaataacggtaaaagatacatcgtagaaagaataattccaaagtcaagcatcacgattgaagaaccaattgtgaaagccgcatacttaaagatatgaagatttaaaattggttcttccagatgaagttggcgatgggtgtaaaagattaagacaataattccgattattaacgcactgagaactgtaggtgaagtccaaccatcttcactagccaaactagcaccaataacgagccctgaacaacctactgccgattcaataattgagagcacatcaacatgcggcttagtaatttcaccaacattttctaatggagtgatagcaaagatcaaggcaataaataaaaacggaataaataaccagaagatccattgccatgataatttagcaagaattagcccggttaaagtaggaccgattgcaggggcaaacataatcacgagggcacacattcctagaactgctccaatttgtttaggtgggaagatttgcattaccactgcaaacattaatggaagaattaaacctgttccgatcccttgaatcattcgtccaatcaacaaaatagtaaaattatgcgctaaggcagaaatacaagccccaaccatgaagtcaattaatgcaaaaataatgacttggcgggtcgtaaaccatttagtaataatactggacagtggcaagataatcccaataattaacatatatccagtgactaaccattgaattgttgacgtacttacttgaaaagcagccatcaattttggcaatgcaatgtttaatgaagtttcactaaacattccgacaaaagctcctagtagcatactaaccatcatcaatcctggatgcgctacttgcttacgagcttgtaaagcattttccataaatataaaaactccttttatcctaaaaattacacaaggattagtctagcaaatcgtgctatatgctcgtaagttattttttaataactaataatcttaagtatattgattaagattattaagttaggtttagcgttttcaaattcaagcttttcgggataaaaaattctatttagtgataataggaatttaaaaataaatgatttaaaaggtctcacaataatctcaaaatagcgtcgttgcttgtatcctcattttattcctggtagatcagaatagaatataaacagaatatttaaataaataatttgaccacaacatatagtgtttcgaatgtcaatacttcctataagttgtattttgagctatgatagataacgttaattacgagaggggaaataaaaatgaaagtgcaaataattgataagaaggatcttcaaagtttaacaagtgttcaagtagttaaacgtgatggaacagtaacaccattctattcctataagattaaccttattttaaatgcgctcaatgctgatgagcagactagccaaagtgtttatgttaccttattagatgccttgcttaatcaaacaactgtcactactaaaaagattgccgatctctttgttcaaggactggttaatgctaatcatgaagaattggcaaaagtttaccgtgattatcgccaacatgatgaagaagcatttgccgaagctactaatccccaaaataagttagagcagcttttcgaccgaaactcacggattgttcacgaaaatgctaataaagatagccatgtttttaatactcaacgggaccttgaagccggagtcgtgagccgtgcattggggttacggatgcttcctggtattgtagctaaggcgcatcttcgtggtgatattcactggcatgaccttgactattcaccggtaacacctgaaactaactgttgtttaattgactttgatgagatgtttaagcatggatttaagattggtaatgcttgggtttcttcaccacgctcgattcaaacagcaaccgcgcagatgtcgcagattattgctaacgtggcgtctctgcaatatgggggatgttctgctaatcggattgatcaattattagaaccatatgcaaagctaaattacgaaaagcatatgaaggatgccgaagagtggatagtaccagagaaacgagaagaatttgctcgtaaaaagacaaaaaaggatatttacgatgcaatgcaggctttagaatatgagattaataccctttattctagccaaggtcaaactccatttacgaccattaactttggcttagggacaagctggattgcccgggagatccaaaaagccattttgaagatccggattaagggtcttggtaaggaacatcgtacagctatttttcctaaattaacttttactattaaacgaggcttaaatcttgaccctaaagatcctaattatgatattaagcaactagcgcttgaatgttcaacaaagcggatgtatccagatcttttgatgtatgacaagattaaggaactaacggggagctttaagacaccaatgggttgccgttcgttcttacagggatggacagatccagaaactggtaaagaagtaaactcgggacggatgaatttaggggtagtgacagtcaacttgccacggattgccttggaggctcatggcgataagcaattattctgggaaatttttcaagagaagatgaatatttgtaagattgccttggattaccggattaagcgtactaaagaagccaagccagaaaatgctccccttctttatatgtatggtgcatttggtaaacggctaaagaagactgatagtgtcgatgaagtctttaagaatagtcgggcgaccgtttcactaggttatattggtttatatgaagtatgtacgactttctatgggtcaaattgggagcataataaagaagcacatgactttgcaattgcaattactaaggcaatgcatgatttatgcgctgaatgggaaaaagaagaaggatatcactttagtctttattccacccctgctgaatcgttaacagatacattctgccaagatgatttgaagaagtttggtcgggttgaagatgtaacggataaggaatactacacaaatagtttccactatgatgttcgtaaacatccgacaccatttgaaaagctatcatttgaagaggcttttcctaagtatgcggctggtggttttattcattattgcgaatatcccaacttacgccaaaatccaaaagctttagaagcagtttgggactgggcatatgatcatgtcggttatctgggaacaaatacttcaattgatcagtgctttaagtgtggcttcaaaggtgaatttgaagcaactgctcgcggctttaagtgtccgcagtgcgggaaccatgacccagcaacctgtgacgttgttaagcggacatgtggttatcttggtaaccctcagcagcggccaatggttcatggacggcatgaggaaattattcaccgagttaaacatatgaatgctggaatgatcaagaatgcagctgaatttgaacaacagcggcaaatggataataaggctcatgctcatattattggtgatcaaatttaattaattatcaaaaggccagttgcccgtaaagctaccggccttttattatataggaggaaaaagaaatggcagaaacacgattaccccgcaatcctaagttgcaagagtggttagcaaaagatcattcattacaatatattgcagactataagcccttcaattttgttgacggggaaggggtccggtgtagtttatatgttagtggatgcctttttaactgccccgaatgctataacaaggcggcgcagaattttcattatggacagccatatacccaggatttagaagaccagattatcgaagacctttcgcagagttatgttcaaggattgactttattgggtggcgaaccattccttaatactcaggtttgtctgaagttagttaaacgggttcggaaagaattcggtcacgaaaaggatatttggtcttggtctggttatacttgggaagaattaatgaaggagtcgagcgataaacttgaacttctacactacctcgatattctagtcgatggtcgattcttgctggctaaaaaggatcttacccttcagtttagagggagttctaaccaacgaattattgatgttccgcaatcccttcaaacggggaaagtggttatttgggataagcttgttcattagaggagaaaatgatggcaaaaatttggaagaaagagccagcatggttagagaaaaaacgtcaactagcagttatactgcaatcacggtttccgactttacctggtcaagaagaatggatagatcactggcaaaagagaacaactggtgtaagtaggggttggctttctttacaggaagatagcctaactgcgatgcctcttgaacaagcggttaatgaatactcaacactattacaagaaaatttaatggagaaggccatcttttggcaggataaccagttagcggccatgcatcttgcaaatattgactgtggacagtttatatatttgcgtccacaaattactcaggagcgtccaattgtctttagtccccatcttaactctgcaaacacccataatattattgtcatcagtgcggaggtgaatgcggtaattgaagaacggatggttaatgatacgttattaccatcatatgaaggaacggagattttagttggagctaacgcgcacgttacgtaccggcaggcaaatcgctcaactagtaaaaatatctatcggacaatccatgcataccaagcccatggttcaacgctgcagtttgaagtagcgagtcaagttcaaactaaagctactgtcgatctttatagttttctggatggtcaaaatactcagtggacccccacaattgctttaagcggaacgcagcagttaaccgcaatggttgatggttttggtaaggaaacttctgccactcttacccaatatcgggattcagaaatggtcactggagcaccttttaaagtaaaagccggcgaaccactcccaattagcgaagatatccatccattaaaagaattagctagtagtgagcgttggctaaaacaaataatgactgctgaatagggctaaagttaattacagcaatgttacaattaaacattaataacgaaaaataagtcgttgaaattcttctttataagaaaaattcagcgacttatttattattatgttacaaattttggctaattctggggaaaagttagccaaacctaagttactatcaggacgtggccgaggttgatttgcttgacagactattaaaatttttattacaaagtattacgaaaatcaactgaattgatatttcggagtaatccgcatgtaattttggggagtatagtaataggtgttgagagatatgaggactcaacaacttaaactaaattaaactaataaataactaattaataaaaaagtattttatgaaaaggatgggatttttctttatgaagttaactaaaaacatcgcgaaaatcactgctgccgttgcaggtgctgttgccttgggaacattcgctactgcaactactgctaatgctgattctgtttacacggtgcaaagtggtgataccttatcaagtatttcctataagttaggccatgacttaacttatgttgactctttagcttcaactaatcaaattgccaataagaacttaatttatgttggtcaaaagttagtaattaaagatgacggtgaagtaacccaagcaactgctcaacaagctgctactttacctgaagcatctcaagctccagcatcagctagtgttgaaagtcaacaacctagccaagctccggtggttgctagtcaggctcctgtagcaacaagccaagtacaatcatcagctgcaccggtttctgctcctgctcaatcacaggctccagtacaatcagtatctccacaacaatcaactgtttcagctgctgcacaacaaagctacagtgcaccagtacaagcacaagctactagttcaaactacagctcaaatgttagtggtaatgatgcggctgctaaggcttggatcgcagctcgtgaatctggtggtagctacagtgctcgtaacggtcaatacgttggtaagtaccaattatcagcatcatacttaaatggtgactactcagaagctaaccaagaacgagtagctgatcaatacgtagctaaccgttacggttcatggagtgctgctcaatcattctggcaatcacacggttggtactaaaatttaataattaattgttaaagtaggaaattgtctcaataaggggatggtttcctattttttgtaaaatgaaaaaaagttaatattattttcatcctaatcttaaaaaatatattataatagagttattcaagtgatgaaaggatgagatccatgtcaaaagagagtaagattattgatacaaaatcattatatgtaaatcctgaccgcggtgttgcaacgttaaactatagtcaaaattactttactgatattacttcattaattaatagtgatgaagtaaaggaaattgtccgtttatatttagcttcacgtaaccctgataatgatgatgatgcttttgataatgccactgttaacaagtttgttgatatcttaaagaaagttctttttgaggatgatagtgcatttgatgaatatgaccctaaagatattcttgagagtgttgaagaattatactcatactatcgttcactattacgggtatcggtaattaatcttagtgataataagattatcggtaacgagttccggactattgatacccaattcaacgacttagtgcgtaaagcataccggatcctcgaagaaaagctccaaggttttgaaaaccggacttatcgacaagttaatgcggcaactaacgcaacaattttagttcaacaacaagattggaaaattccagctggttatgaagaattaaaggatattgattttattaataccgtgatgcttcgtccaccaatgatgatgcatactaagagtaacaaacgggaaggggtcttttctgaagtaaaagataacccaatcgaacgttttcgtggtgaacgtggtaagtggtattgttacccagcaaagattggtgaaagtttagcctttatttacttcaatgttgattacttggtaaacggaatcgctctttcaaacttatttgaaattgcatcccctgatgagattaaggggcaaaaacctgatatgattcttcttttcggtctaaaagaaacagaaggcatggtttctcattactatcgtgacgaaaagaatgatttgtgggttggtgaagtaccttacacagataagactacttactttggttacatgaagaagatgtgcttgacgctccataaccttcatcaaatttacaatggtcgcctgccaattcacgggtccatgttgaagattaaatttactaatggtaaagaaaagaatgttgttttcttcggtgattcaggtgccggaaagtcagaatcaattgaagcattacaagaattagctgacgataagattgtcagcatggagacaatctttgatgacatgggaagctttacccttactgatggtgaaccaggggtatatgctcaaggaacagaaactggtgcctttgttcgtcttgatgatttgagtagtgccgtggccttcaataacatggaccgtggtgtttaccttaatcctgaacagaagaatgcccgggttattattcctgctgatacttacgaaaatgtaatcaaacatcaccatattgatatgtggctatacgctaacaattacagtgatgaagttggtattcatcgttttgatacagaggaagaggccgaaaaagtatttattgctggacaacggaaggcccttggaacaactgatgaagttggaatgagcaagacattctttgctaacccatttggcccagttcaagaaccagaattaactaagccgattattgacaaggtctttacaaagctatttgaccaagatgtatacgttggagaaatctttactcaccttggtaatgacaagtcaaaggatgctttgaaagaatcagctcaagaattgcttgatgttttgatgaataattaagattacgattaagacaattttgtcatcgccctgtaacaaacagtccgttacagggcgatttttgtgtcgtcaagaaaaaatgagcagtttttttgaataatttttacatgagataattctagttataattttacaagttacttaaaagcgattaaatcaacgtttaagcgactataaaaaaatcagcgaacgtttgttacaaaaaattacagaaataacgaaatttgataagtcctagtaacccgctcgtaaccctaatcctgtatagtagttatcgttgaaatgagttatttgattaattaagagaaaaggacggattgaatttataatgaagttatctaagaaagtagccaagattacagcagcgattactggtgcagttgcattaggaacagtagctactgcaacgactgcaaacgccgacagtatttacacggtgcaagcaggtgacaccctttctgggatttcttacaaattaggtcacgatctaacttttgtagatacattagcaaacaacaataatattgttgataagaacttgatttacgttggtcaacaattagtgatcaaggatgatggtgaagttgcaccagctactcaagaagaagttgctactttaccagccgcaaatgttgcaccacaagctacacctgctgaaaatcaagcacaacaaaaccaacaagtacaatcaaaccaagaagcaccagttgctcaacaacaagtacaaactccacaaacacaaaatgtacaacaatctagtgctcaagcatcaactggctataactcaaatgtagttggaaatgatgctgctgctaaggcttggatcgcagctcgcgaatcaggtggtagctacagtgcacggaatggtcaatatattggtaagtaccaattgtcagcatcatacttaaatggtgactactcagaagctaaccaagaacgagtagctgatcaatatgtagctaaccgttacggttcatggagtgctgctcaatcattctggcaatcacacggttggtactaaaacaagatttaataaaatagataatcaacaaatttcaaacatacgataaaagaggttagaaaaattttagtttttctaacctcttttcgtttaactattataaaatttagctcgtttttcttatacttcaacattagcaacaagttcaattggacagtgacttgaacctttgacatctgaaagaatcttggcttcttcaattcgttctttccatacatcagaaactaagaagtagttgagacgccaacctacatttcgttcccgtgcgtcataacgataattccaccaggtatatgcaccatgcaaattagggtggagataacggaaagtatccgtcaagccagcattaagtaatttaccaaaatcagctcgttcttgttttgtaaagccggcttcatgatgatcttctgttggctctgctaggtcaattggttgataggcaacgctcatatcaccgccaatgattactggcttactactttgcaaattagtaacataatcaaggaaagcgcgatcccagtcgagacgataatcaagatgttgcagcttttcacctgaaactgggacgtatacatcaatcaaatagaagtttggatattcgagcgtgattagtcgcccttctttatcaaaaattgaattattcattccgtatataacgttttctggcttatatttagtgaaaatggcggtaccagaataacccttcttttctgcataattccagtattggtaataatcaggaatttgaatcggttcttcgcctttatccaatcgtgtacattgtagacagaagaagtcagcatcttggcgtttaaaatcttcgacaaatccatgattaatggctgacttcaagccattgacactccaagaaataaatttcatgttaatccttctttcaatttaaccaaaccatgtctctgtaataattgtacaaggaatttgatttttcattaagtaataagactctttttgtgatttttgatacaaaaactgttgtagatgttaaataaaaatattcatattatatatacgaaaatatcaactttaagaataaacgatgcaatatattaaggggatcgcctacttatatcgaaagcgtttatataatattatttatatataaagttacgtttatcacaaaattgtcaaagagtcacaacttagaggagggtgtctaatgacttcaaagtatgaaacagagtcgaaaggttacacgatgacaaccgtaatgcaggaagctgcacgatgtttattatgtcatgatgcaccatgttcacaagcttgcccagcacatactaatccagcaaaatttattcgaagtgttctttttcgtaatgttaaaggggcagctgaaacgattcgggaaaacaatgcgttaggatcaatctgtgcgcgtgtttgtccaactgagcgttactgtgaaaaggcatgtacccgggctaaaatcgacggaccaattgatatcggtgggattcaacggtatgtcactgatatggagcgaaagatgaatatgaagattcttaaagctggtaagccaaacggaatgagtattgccatcattggtagtggcccatcaggtttacaggcagccacgactcttcgtgaaaagggctatgcagttgatatctatgaaaaagctgctaaggctggcggttacttgacctacggcattcctgagtatcggttgccggaagaaattgtggattatgaagttcaacgaattgtcgaccttggtgcgcacattatctataacacaactgtcggaaaagatatttcaatggatgaccttaaagctcgttacaatgcagtaattgttgctattgggacaagtgaagcaaagatgcttccaatgtttgaacacaatatctgtactgaatcagcaatctcattcctagcccgggcaaaaaaaagtaagggtaatttagaagatcttccgcaaaatgtccttgttattggtggtggggatgttgcaatggatgttgtaacaaccttaaagaagcttaatgttccttatgttaccgatgttgtttatgagcagtttgatgaattcaaagcttctaaaaaggaacttgccggtgctcaagaagctggtgtaacaattgttgatggttacgttccaaaagaagttcatcagaatcgtgctacctttactcaccggaagattaagagtgaattaactattactgctgataagattattttagcagttggtcaaaaagcgaatgcagaaggactagacattgacttacagcataatgaaattccattccgtgaaccacgattccggacaaaagatcccaaagtttttgcgactggtgatattgttgccggagataaaaccgttgtggtagcagtacagaaaggaaaagaagtagcagaagaaatagaccggttgttaggaggacaagaaaatgattaaaaaagatttatctgtagactttttaggcgttcattttgaaaatccattttgcttgtcgtcctcacctgttgggaactgttacgaaatgtgtaagaatgcatatgacgctggttggggcggtatcgtatataagactttatcaccaacacactttaagattgatgaagtttctcctcggttcgacgaattagccaaggaagacatgcattttgttgcctttaagaatatggaacaattatcagaacaccccttggagcaggacttggctgatatgcgacggttaaaagaggaatatcccaataaagtcttgattgcttcaattatgggtgagacattggaagattggaccaacctggctaagttagtaactgaggcaggggctgatatgattgaattaaacttctcttgtccacagatgacttctcataccatgggttcagatgtgggaactaatccagaattatgtaagaagaattgtgaagccgttaaacgcgggactagccttccagttcttgcgaagatgacaccaaatattacgacgatggttccgattgttaaggcatgtctagaaggaggggcagatggcttctccgcaatcaatactgttaaatcaattgttgatgttgatctgaagaagaaagttggtttaccaaatattgatggtaaatcttctgtttctggattatctgggaaagctgttaagccaattgctttacgtttcttacaacaattacggtcagcagccggccttgaacaactaccgatttctggaattgggggaattgaaacctgggaagatgctgctgaatttattcttttgggtgccactactctccaagttacaactgcgatcatggaatatggttatcggatcattgatgaccttactaatggtttaatgcattacatggaagaacagcatgtagaccaccttcaagatcttgtcggcttagctaataagaatattattcctactaatcagcttgaccgaaattacaaggtttaccctaagattgattgggataagtgtatcggttgtggacgttgctttatctcatgtcaagatggtgctcaccaagcattaacttgggatgatgaaaaacggcaaccagtttttgataagagtaagtgtgtcggttgtcaactgtgtgcacttgtttgtcctgtgggggctattaagttaggccttgttgagattaagccgggccacaaaggtaatccagcagaaatcgatgtaggatctcaacgtcttcatcgctatcacccggtaaaggctaatcaagaaaattaattattagttttcctcatatatgaaaaatcgaactgcaactttgtgaaatgcaaaattgtagttcgatttttagctttattatgtcacattgtaactcttaaattactgcgaggggtacttttttatttggtgatgggaactctttttgtaaagcaagtaactcatcatcacttagttcaatgttaccagctgcaacattttcttcagcatgttttgggctgctgctctttggaatagcaaggatatttccaattcttaagacccatgcaagcatgatctgactaacggtcatatggtggtttgcggcaatttcttttagtagcggattctcggttaactttccagatagactgtcaccctgtgcaaggggagagtaggctattaatggaagctgatgctgtttcattaagggaaggaggtcaaattcaattccgcgactatcgagattatagagatcttcgttggcaacgcaatcagtgccatttttaaggcgccataattcttcaagatcactgacgtcgaagtttgagactccccatgctttaatctttcctgcctttttaactctctctaattcgttgactgtttctgctaacggaatcccaccccgccagtgtaaaaggtaaaggtcaaaatagtctgttcctacggcagctaaactttggtctaaactatgctcaagttttgtcttgctggcatttgaaggaagaactttatcaattaagaatagcttttcccgactatatggtttgatggcctcagcgacaagtgcttcagaacgaccatcgccatacatttccgcagtatcaatagcttgtgcgccaacgtcaattgcagtttgaatggctttaatttctgtggaccgattgacgagagaatttcccatattccatgttccgattccaattgcgggcattgaaacatcattgattgtgacttttttcatcttgcgcggctcctttctattttcctacttctattatattctttttagtcaatggtccctagcatattagttgcattttagttgaaagcgtttaacatagacaatgaataagaaagaaaggaagcattctttatggctaatgaattacaaaaccgtaataatttattcgatagtttgatgaacatgcgtaactggatgaacgatgatttcttctctaacctaactccggttgctgatcacatgaagacagatgttacagaagatgacaaaaattataccgtaaagattgacatgcctggatttgataagaaggatattcacattaattatgccaatgatattttgacagttactggtcatcgggatatctttgatgatgatggtgataaggatggcaatgttctgcattctgaacgtcggtatggccaaatgagtcggcaatatcgtttaccagatgtaaataagaaggatatcaaagctcaatacaagaatggtgttttgacaattactcttcctaagaaggatgagactgatgacgatgaaaatcatattgatattgaataattaaattaaactgagtaaagagttgtggaaaattactttctgcaaccctttatttttcatccgtttcttgaacatatgtttgattgaagatataatagtatttactgaagtgctggaggtattctcatgatggggcgaacatatatggcaatcgatttaaaatcattctatgcctcggtcgaatgtactgagtgtgggctcgatcccttaaacactaacctcgtagttgccgatgaatcgcgaactagtaagactatttgtctcgccgtctcaccagctttaaaaaagtttggcgtttctggtcgcccgcgattgtatgaggtggaacaacgggtagcgtacttgaataatcgtcgtgccaaagaaatgtctcaccagcgattatcaccagttgtttcaatttaccgggatgaactattaaaatcaccggaacttaaaattggttatagtattgcgcacccacgaatgaatttttatcttgaaaaaagtgccgccatctatgaaatttatttacgctatttaccaccagaaaagatccacgtttattctattgatgaggtaatgatggatattactgattatcttaataagtaccatgttagcgcccgttctttagctaaggaaatcatccaaacaattaaagcagagacacaaattactgcaactgcaggaattgggaccaatcttttcttagcgaaagtagcgatggatatagtagctaaacggattccaggggatgaagacggggtccggattgcacagatgaatgaacatacttttcgtcgttacctttgggcgcaccagccactaacagacttttggcgaattggtcctggatatgcgcgacgactaaaaaagctaggtcttcatacaatgggagatattgctcgttgttctttgggaaagttatctgatccaatgaatgaagaagtattataccgcgaatttggaaaaaatgcggaaatcattattgaccatgcgtggggatatgagtcagccaccattaaagatatcaaaaattatcattcatcagatcatggggtgtattctgggcaggtgttgcctcgaccttataactttacagaaacccggttagtgattcaagagatggttaattcattagctctccagttaaccaagcaaaacttagtaactgatcaagtagctttaagggtcgcctatgatgtttctaatatatcggaggattaccaaggaccattagtgacagacttctatggacgccaggcgccaaagccaatgcatggaaaagctaatctttccttaccgacttcatctggtacagaattgatggaggcatttatgaagttatgtgattctggccttgaccggcgattgacagctcgtaaaattacggtaatagcgaaccaccttctctcaccacggcttgccagattggcgaattataatgagcagttagatttatttacggattcaacgaaaaaacataagaatcgttccaaagttcaagaaaaggatcaaaaactacaaagacttgtccttgatttgcaaaatgagtacggtaaaaacgccattattcgagcggcggatttgaaaaaaggtgctactcttttggaaagaaataatcagattggagggcaccaagcataatggaaaatgaagatttgctgaaaatagaaaaaagcttgtttagtgatacctcaaagtatcgtgatattatcaacacccctcggcatgtttctcaagctcatacgccaatgaccaccgaagatcgcgctgctcagttttctccttttgcggccttgaccggctaccatcaattattagcaaaggtaggggaaaagtatggtcataagacttatcccacagctgagatgaggcatcgaattagagtccaacttgccatgattgaacggggccgatcacatccgttaataaaagttgaattctttaatggtaagactggtttttatgaagaatacacggggcaattaaaacgaattgatcaccatgctcaccacctaatatttgatgacggaacaaggcttataattcaaaatattcgtaaaattaaaagaggtcagcaaaactgatctcttttaatataaggtatacgttaaaatgcttgaataagtttcatgattccgaacacaatcaagaatgttgaaactaaccataccactgtaatagcggaaagtaatgggctaaataaaagaataactcctaataccaaactcaaaattgctagaattacaatgaaccagtagtatccacgatgaaattccttgaaaaacttcgcactgatcaactcagtgatagaatcaaggataaaccagatagcgaagatgatagcaatgaagagtaccccaaagcttggttggaaaagaaaaataattcctaaaatgatatctaaaattgcagaaaaaattaaccaacctgaggattctcctaagattcgaccgattcgttgacggaaccataattcataaattccgcggaaaataaaagtaattccggcaacaatggctaagaagtgaagggttttatctggccgcgtgaatgatgcaattccggcaatgataaataagaccccaacaattaggctaaaccagtcaaagccctttttagtttcttcaaacattgaaaaacctccctaaaaataaaattattaatatcatagttcaaatgggttaataaaacaagaagaaaggaaatctcaacaaggtagtataatacatataggatgaaatagtaaacaacctaagattagttcaggataaaaataattattgtcctggacttttttgttattctgaagatagagctaagatcgatcatgctcccagggacttcgagtccgtattataaaatgatctccgctatctttgatttgatattttgcttttaggttgtggaactacgagttcgagtatttaggaaatgaagtacaaatctaggatagcggttatatctagctctatttatagaaaggaagtttttttatggctgatatatttgccttggatgtttcaatggggaaaagctactgtgtctggtatcgagggaaacactgtttaaaggagttttctttagtacacacgaaagcggggtttaatgctctacgagatatgattaagaaagctcagaagtcaattatctactttgaagcgactggaatttattcgcgagtaattgaacatttctgtgagaccaatggtctccgcttttgccgtcttaatccgctagaacttcatttaaagtccgagagtctacgacgagttaagaccgatcagaaagacgctcaccggattgctctcactgtccaggaaaatacttttcgattaatagttccttggaaaaaagactatcttcagctacatgagcttagtcggttctataatcagctcaatgctgattggaactatcgtctaaatcatcttcatactgcacttgaacaagtttttccagaacttaagcaattatttgtaaatagaacatctaaattagcgttgaatatcgtggagctttttcctcattcagcactagttaggccttattcgagagttaaattaaagaatattctaatggcatctacagataaacgaatatctaagatgaaagcttataagtatgccgatcgattaatcgatctcgcccaaaaatcatatccggctgtttctggtgatgccattcaggttgatgaagttcgctactatgctcgccaattaattgccttaacccgtaaaagggaagaggttatcaagcggatggaatctattgcccagcgcttaccagagtatatcctatactgctcttttccgggaattgggaaacaaactgcggctcagttaatgggagaattgggcgacattagtcgctttgacaatgccaatcagcttaatgcctttgtcggaattgatattcgtcgttaccaatctggaacctatttaggtcaagatcacattaataagcgtggaaacccgattgcccgtaagctcttatattttactgtaggtaatatgatccgccaacaacacgctaattctaatcatatcgttgactattactatcgtttaaaagaaaaacgacctcatccaaaactgaacaaggtcgccatggtagcttgtatgaataaaactctgaaatgtctcttatccatgattaagcaccatgaaaaataccactatcggtatacggactcaatggtccctgtgaaggcataatcacctcacaattttaatataccactaattctcgatttttgaagaagaaccgagttggtttagtatactcttcttttctaaatatttttcttgactaatcgtaggaaagggagcgagacagaagttacttgtgactttgttttttgatgcgaagctagcctctgggagcccccgcaagcaacaataggccttcagcgtccggcaaggtcgaacgctgaaggccattgttatactgcgctgttcgtattttgtggaagtgacctaacttatgtcacagctccttttgtcgtaatttcccgggaaattaaaggtgctctttaataccgttgggaaaatccttatcaatctcctttaagattggtaataatgaattgacatattcatgatatgcttcgattggctttagatcttttgctcgggattgtagtaaggtaagagcaatatcatgcgctctttgttcatttgtaatcatcttttaccacctcagttattcagtttatcagattttccacctactagcataaattgtttaataacttgatgaaaaatcgtttgatcaagtataatcattactgcaaaaccaattgtagttccgatggtattgctaatcaaatcatccacatcggcaacccttccaatatggaaaagaaggtcgcaaacaaattggttacactcgataaataagctgaagaaaaagccgtaaagaatagcacgactgaagggcatttggtgattaattaaataaagataaactcctagtggtaaggtcatcacaatatttaagaaaaattcttggctgagtccttggagggggatgatattaaatggtacgccgtgaaaataaaataaaagtttgttagcagaactaaaattaaacattgaaggggttagacaaagccagtcgatagcagttaaatagataaaaaaggttgcaattgtaatatgctggctgaagttaggaaatttttcccaaaggtgattatgggtaacgaggacagatcctgcaaaaaaataaataaaaaatgggatccagtgaactaatgcgtacaatgtaatttctccttctacgaaaaatggtatacaataggttttcaatgttatatatcatagttgatttttttagtaatgactagtaaacctaactaggattaataaaacttcaattattgagaaagagagaggatcatggcagaaaaacaagaatttacacgtaagcttaaaagccgtcatattcaattaatggcgcttggcggaacgattgggacaggattatttcttggatcggggaaggcaattcacgctgctggtccagcaatccttttagcatatttaattactgggattatttgttttggaattatgcgggccctgggagagttgcttctttccgacttacattatcattcgtttatggatgcgattcgtgattatcttggtaatcgcgtgagttttgtaatgggctgggcttattgggtgtgttggctagcattggcaatggccgaagttaccgccattggcttatattttcaactatggtttcctcaagttccccaatggttacctggattaataactctcctaattttattgggattaaatctaatgactgttagtacgtttggtgaactcgaattttggtttgcccttattaaaattttggcaattgttattttaattgccgttggtgtcattttagttttacttcattttcattcggtaagcggctatctcgctactcctgctaatttagttaatgatgggggcttttttgctaccgggacaaagggcttcatgctttcttttcaaatggttgtatttgcctttgttggaattgaaatggtaggggtgacagcggctgaggcagagaatcctaaagttgttattcctaaggcaattaatggtattcctattcgaattatgctcttttatatcggtgctttggctgtcattatgtgcatttatccgtggagtaaactttcaccaagcaatagtccgtttgtccttgtttttcgcgacatcggtcttccgggggctgctagtatcgttaattttgtagtaattactgctgcggcttctgcttgtaatagttctctatatacaactggtcggatgctagctgagttaacctctactgctcatcggcctgttatccgtaagattagtcgcttatctaagcggtcggtgcctgcaacagcggttattatttctgcagtcgttattggaattgccgctatcttaaacttagtaatgccagaaggagtttttacttttgtttccagtattgctaccacgagttttctctttgtatgggctgctatcatcttggcacatttaaaatatattcgtcagcatccgcaatcaaggacttttaagatgccaggcgcaccttttactgactatgttattttagtttttctttttattgtgctaattgttttatgtatggagaaacaaactttaattgcgcttatactgacattggcttggtttgcaattcttgccgttgcttcattaacacaaaagaaagcataaaaaattccccgagttttcggggaattttttactaacgattcaaatgtaatttacgttgacactcgggacaaatgccatggacttcgatgttatttcctgtaactagatagccagtcttttcatgagtcataaccgttaattctttcgtgattgcagtaaaatgttcatcaaaaacatcagaaatcttaccacaattatcgcagacgacatgataatgcgggtggccgaaataatcaaagtgggtactgccgtctccattttttagctcaattacgagattataatcaacaaagagttttagagtattgtaaacagttgccatactgatattgtcaactgtgtctttaaggtcatcataaatcatttcgacacttggatgagtatgatgattgattaagtaatttaagatagttttccgctggggagtaagacgaaccttgttttcacggagatggtcaagagctcgatcaaattctgcttctgccataatgtcgtcccctttcttaaaataattataatctattgacattataacatttacattcactaattcaaaacatataataattaacggtcagataataactattctaaagaaggagagaatgatatggatcaaagtatcgcacgcaatggaaaaagttatagtcgcttttggtttatttttactttactagttggtacctttacgatgtcgattagtcaatcatcgttgtcaactgcctatccaactttaatgaacgcttttgggatttcagcatcaaccgttcaatggctgacgactggttttatgctcgtaatgtgtgtcagcatgccaattagcccgtggatgctcaataatatgagttttaagacaatgttcattggggcactgggactatttgatattggatccttgatgattgttttaacccccgcgtcttggggaattaatggtttctggtttatgatgattggacgggccatggaagcttttgccgttggagttttattcccatcataccaaactgttttgcttgagattacgcctaaagaagagcggggctcaacgatggggattgctggtttggtaatgggatccgcccttgcctgtggaccgattgtttcaggaattgttctaaagttctttagctggaagagcctttttatcctcttcatgcttgttatttccataattattttaatggctgctagcggactgatccaagatgtaatggaacgccatgaaacgaaccttgattggctatcagtaattttactagttggattaattgggattatgtacgttgttgaccaaaccggaaaaaagaatcttgcatgggaaataaatgcagggatttttatcgttagtcttattgcggttatctggttctgcattcggcagcttcacctcaagcacccgctattggaattacgggtattgaagacttttaattatgatttagcaattcttttaacgtcgatttcatatattgccttaattgtaacgacaattatttttcccctctattatcagggagtattaaaagttagtccatttgtttctggaatggccctagtgcctggagctgtttttcttagtatcctgaatcctttgtcaggaaaattggctgataaaattgggtttaaaccgacaatgctggtgggaatgtttatgattatcattggttgggttgctggattaatcgtccttaatcatctcagcttattgggaatgatcctttgcgcaatggtgattgaaggtggaaatgcctttgtaatgatgccggccgtcacactgggagcaaatgccttacctgatgaattagtacctcacggaacagctgtaattacaacagtccggcaagttctcgggtccgcgggtgttactatttcaacactgatcttaacggttgctactacaaatgcacttcaacggggaagttcggcgcaagtagcttcccttcacggctatcatttagtatttattggcatgatcgtcactgaattgattggtctcgtactagcatttatgctaaaaaatactaatactaataaggaaaaaagtacaaaataaccaaaaattcgtatataaatagggagaagaaaatttctgctccctatttattttgaaaacaaaaaagaggtattgataatgacacttaaacgaccacaatgggcaaatgcgacaccagaaatgcaagactattatgatcactactggggatttccagttcatgatgaccagcagttatttgcaatgctatctttagaattatttcaggctggtttaacttggcagacaatctggcggcgacgggaagcatttaatcaggcattcgataactttaatattgaaaaagtggcatcatttaccgatgaagatattaatcgattatgcgaggatgaaactattattcgtaatcgtcttaaaatattagcggtaattaataatgcacaagtgattttaaaattacggaaaacgggaaagacgtttgataattatgtgtggcgctttgttgatgatcagcctcaagacttggggttaactaccgatattgaattagctcctaaaacgcctgcttcggaagaaatagccaaacaaatgcggaaggatggatttaaatttgttggtccgacaattatttactctttcatgacagcggtggggatggtcaatgcccgtttaaagtaagaatgtaaggattaacattgattgttggttgacaattatgctaagattattctcgttataaagcaattcccgataggattcacgtctgaacgtgaagatgccttgtaaccgcaactacaaactatttgaaagtttcaatagaatatgggggaattagaaaatggcagaacgacatttatttacatccgaatcagtatcagaaggacatccagataagattgctgaccaaatcagtgacgcgatcttagatgaattgcttaagaaggatcctgattcacgggttgcagttgaaacctcagttactactggactagtattagtctttggtgaagtttctactaaggcctacgttaatatccaacagattgtgcgggacacaattcgtaagattggttatacagatggtaagtacggtttcgatgctgataattgtgctgttatcactgcaatcgatgaacaatcaccggacattgcgcaaggggttgatgactccttagaaacgcgtgaaggtgaagctgatccgcttgataagattggtgccggtgaccaaggattgatgtttggttacgctactgacgaaacacctgaatatatgccattaacattggttttaagccataagttaatgcgtaagattgctcaactacgtaaggatggcgttatctcttaccttcgtccggatgcaaaggccgaagtaactgtagaatacgatgagaatgacaagccgttacgtgttgacaccgttgttttaagtacccagcatgatccagaggtttcgcttgatcaaatcaagaaagatattaaagaacaagtcattgaagcggtcattccagctaagtaccttgatgatcaaactaagtacttcattaatccaacaggtcgctttgtaatcggtggaccgcaaggggatgccggcttaacaggacggaagattattgttgatacttatggtggggctgcccatcacggtggtggagccttttctggaaaggatgctactaaggttgaccgttctgctagttatgctgcgcgctatattgctaaaaacattgttgcagcgggctatgctaagaaggccgaaattcaagttgcttatgccattggtgtagcagaaccagtatcgatcatgattaatacttatggtaccggtacccgttcagaagaagaattaattgccgctgttcgaaaagtatttgatttacgtccagctggaattattgaaatgctcgacttgaagcggccaatttacaagcaaactgctgcttatggtcactttggtcgaactgatgtggacttaccatgggaacaccttgataaagttgatgaattaaaagaaattttaggctaataatttagttacacgcttgcaatcattaacggtggttgttaaaataggcgttaaatatttgatcgtaatagaaatagtagtttttgacgagggcagcagagatcctgtggtggtgtgaacaggagactggtcatttacgaactcatctaaatgtgattattactgaatcttagtaggtaatgacgtttaccgcgttaaggtcctaagcgccatggcttccatggaaaacgggtggtaccgcggagttatttcgtctcgtagattgatttctacgggacttttttattacgatcatcaaaatcagaataaggagtagaaaatatggcttacgatcataagacgattgaaaaaaagtggcaaaagttttggaaaaagaatggaacttttaaagcagaccttaataaggatcaaaagaagtactatgcactagacatgttcccatatccatctggtcaaggactccacgttggtcacccagaaggctataccgctacggatgtaatgtcacggatgaagcgaatgcaaggatttaatgtcttacatccaatggggtgggatgcattcggtttaccagctgaacaatatgcattaaagactggccataaccctaagaactttacgaacaaaaatattgatcatttccgtgaccaaatccaatcacttggattctcatatgactgggatcgtgaagtaaatacaactgatcctaagttctacaagtggactcaatggatttttgaacagctctacaagaaggggcttgcttacgaaagtgaaattatggttaactgggcccctgattttatgggtggaacagttgttgccaacgaagaggttgaagatggcaagactaaacgtggtggctaccccgtttaccgtaagccaatgcgtcaatgggttttaaagattactgcttatgcggaccgtttgattgatgaccttgaccttgttgactggccagaaagcgttaaagaaatgcaacgtaactggatcggtcgttcagaaggtgcttcagtatttttcccagttgtgggggatgaagatactaagattgaagtatttacgacgcgggcagatacgctctttggtgcttcttatgttgttcttgctcccgagcaagaattagttgaccaattgacaacaccagaacacaaggcggaagttgaaaagtacaaggaagaagcgtcacggcggtctgatcttgagcggactgacttaaacaaggacaagactggtgtatttactggttcttacgttattaatccagttaacggtgaaaaactaccaatttggattagtgattacgtgcttgcttcatatggaactggagcagtaatggctgttccttccggagatcaacgtgattatgactttgctactaagtttgacttgccaatcaagcctgttattgaaggaacagatgtgtcagaaggtgcttttgatggtgacggtaagcacattaattctggtttccttgatggcttgaacattgctgatgcaaagcaaaagatgatcgattggcttgaagaacacgatgctggtcataagaaagttaactaccgtcttcgtgattggatcttcagtcggcaacgttactggggtgaaccaattccagttatccactgggatgatgggacaacctcattagttccagaagatgaacttccacttgaattaccaaagactgataacatcgaaccatcaggaactggtgaaagtccattagcaaatgttgaagattgggttaacgtttatgacgaaaatggtcgtcatggtcttcgtgagactaacaccatgccacaatgggccggttcatcatggtactggctccggtacactgatcctcataatgacaaggaatttgcctcaaaagaagctcttgattactggtcaccagttgatctctatgttggtggagctgaacacgctgttcttcacttgctctatgctcgattctggcataaggttctttatgacctcggtctcgtaccaactaaagaaccattcatgaagcttgttaaccaggggatgattcttggttcaaaccatgaaaagatgtcgaagtccaaaggtaatgttgttaaccctgatgacattgttgaccaatatggggctgatactttacgtctttacgaaatgttcatgggaccacttgaagaatcggtaccttgggatgaaaaaggacttcatggtgctaataagtgggttcaacgtgtatggcggttgttgatggatgataataaccacctccgtgaccgggtatccactttcaatgatggtaagcttaccaaggtttacaatcaaactgttaagaaggttaccgaagactacgaacggatgcacttcaacacggctatttctcaattgatggtctttgtaaacgaagcctacaaggttgatgatttaccagttgaatacatgaaaggctttgtaaagatgattgcaccaatcatgcctcacatggctgaagaactctggagtcaattcggtgagagtgatacaatcacttaccaatcatggccaacttacgatccaaaagctttagttgaagatgaagttgaaatgatcgtccaggttaacggtaaggtacgggctaagattaagatggccaaggatactgaccgcgatgaagcacaacaacttgctttagcaaacgaacatgttaagaagtttactgacggcaaggatattaagaaagtcattgttgtccctaacaagatcgttaacattgttgcaaaatagtaaattaagaaagggcagggaatttatgttttcctgcttctttttatttgaggagcagataagttatggaaatagtgagttatccagcaatttttaccccgaaagataatgaaattcaagttgattttccagatttgccggaagcatttacccaggggaaaacaatggatgaggcgatgaattttgctaaattgggcttagcgattacccttaatgataaacttggccactttgaagatgccccagctgtaagttcattagaggcgttaaagcaacaacatccagatcaaatcattaaaatggtaactgttgatttggaacaatactagattaaagaaatattaaaaacggtaaatcgaattgcaccaactttttattcacgataaaatgaaaactcgattaaaataaaaaaggtaggattgcaacaaatcatggaagaaaataaagtaaatgatttgagcagcaccgcagtcaaaaaagattcgcaaacaaaaatgattacaggatcagcttggatgacagctggtagtattacttcgcgaatcttaggggcgctgtacattattccgtgggttacatggttaggagcttatagtaacgaagcgaatgccttatatgctcaggggtacaatatttataatatgtttttagtgattgcaacggcgggaattccttctgcaatttctaaaatggtcgcgcattataacggaataaaccagtatggcgttagtcgccgactgtatcattctggaatgtacgttgcaatggcaatgggtgtaatttgtacgacagtgatgatgtttggagctcgtttaatggataatggagatccaaatatgattccggttatccgctcattggcttgggctattttgattattccggggatgtcaattacccgaggctttttacaagggtataattggatggcaccatcagcaatttcacaatttgttgaacagcttttccgggttatttatatgttggcggccacttatttaattatgaagattcaaaatggtaattgggttagtgccgtttctcaatcaacatttgcagcctttattggggcaattggtgcagtgatcgtcttagggattgcctggatgcgtcaccaacgcgaaatgaatgacttagtggcacaaggtgaagtaaacactgaagtttcaacccaaacattaatttttaagattatttatcaatcaatcccgttcatcattattgaatcaggggtaacgatttttcaattaattgatcaatatacttttaagcggatgatgccattagttggtcactttactaagtaccagatggatgttacttatgccttattcgcgtttaatgccaataagctttacatgattgttatttcattagcttctgcattagccgcaacagttattccgttgcttgcgacagcccgggctcagaacgatcaagaggatatgcgaaaacagattcaaaatgttctcttgttattctattttgtgatgatcccggctgctcttggattatccgcggttgctcagcaaatctacaccgtcttttaccgttatgatgcggcaggggtcgtagtactgcaatttgcggcatacatttcgatcatgttgggcttgtatactgtagccgcagcaatgatgcagggaatttctgagaataagaagatgatgatgtttttagccatcggaattgtaattaaatttatcctccagttcccatgtatttggatctttgaaggattaggaccactggtttcaaccgggatttcaatgtttgtgattaactatttgatcttgcattcctttaatatggaattccacctacgttttgataagatggccctgccaactaaccagattttggcttactccttagtgatgtttgctgggacaaagattgtaatgttaatcattggtcattttattagtccgtatgggcgttacactgctttcttctccttgattccgggggtaatagtcggagcaggaatttatctctatctctgcttaaagtcacgattagccgaccagctcttgggaccacgagtagcaagattacgaacaattttacacattaaataacaatgcatacaaaaaggttcagagtgagaatttgctctgaacctttttaatatccttaaattcttaattcaaaaatccaatatggtgatcttcattcatcccatctatctttttcatgaaggctgggagagcacggctaatttggtggggaaggacgatgtattggctttcggcgatcttttccgcaatcgcactgtgcgcataaacggcagcgaggacggctttatctgccttctcgttaaattcagcagtgaaacctccaaccattccagcaagagtatcacccattccaccaactgcttgggcgggggtaccgattggcaattgatatacttggtcatcagtataaatttctgtgtggtgcttctttaagacaacggtagcactaagtttttcttgggcttccttgttcttatcttcagtttgatcgccaattttaattccagagagtcgttgccattccatttcatgtggagtgtaaatgatatttccttgtggctgttcaagcttttccatcgccatcagggtaattgccgacccatcaatgatcacattttgtttctcggttgtatgagcaaaaacattcttcaaaattcgtaaacttgtttcatcatttccgaggcctggcccaacgaccacactggtagcagctttagtaaggtcagcaactagggcatcatcagtaaaatcagcgaacatcgcttctggcaactgcgcatggagggcactagcgttgatttcatcagttgcagttgttacaagcccagctccagcacagacggctgcggttgatgccatgataattgcgccaccaaaattacgattgccgccgataagggtaactttcccaaaagtacctttaaaactgttttcaggacggggagtaataacatcctttaagatttggtcagtaagttttttcacagttaagactccttattattttatttaatagacaatttaatggtatcattaaaattagtcaaagtagaatattttggagggattaatcttgactgattggatgaaagccgcagaggcgcaaaaagaaaattatttaaatgatctcgtagcattaatgaagatccccagtgtccgtgatgattcagcggcaacagatgaatacccgcttggtcctcgtcctgctcaagcgctaaaagcatttttagagatggcagaacaagacggttttaaagtaaagaacatcgataaccttgttggatatgctgaatggggtgaaggtgatgagacacttgccattttagcccatcttgatgtaatgcctgctggtaagggttgggatacggatccatttgacccagttatcaaggatggcaacttatatggtcgtggtgcttctgatgataagggacctggaatggctgcttactatgccttgaagtatttgaaagatcaaggcgtaaagtttaacaagaaagttcgttttatcgttggaactgatgaagaaagtaactggactggaatgcaccgttactttgaagtcgaaccagcccccacacttggtttttcaccagatgcggaatttccagtaattaatggtgaaaaaggtcaagtatcactcttacttgatgtccctgctggcaatggggatgcttcaacacaactagttagttttgaatctggtttgcgtttcaacatggtaccgcgggaagcagttgcccttattcggacagataatcctcaagaagttacgaatgattttggtcactttattgaagaaaatccggttgaaggtaatattgaatcaacagataaaggtcttaagattactgtcatcggaaaagctgcccatggaatggaaccagaaaagggaatcaatgcagcaacataccttgcaaagttcttaaatcgatatgactttggtgggggcgcaaagaatttcattgaattcttagctgactatcttcatttagatacgcgaatggatggttttaatggtgcttacactgatccagtaatgggcgaattaactatgaatgctggaatcttaaacttcgatgcggacaagggtggtcacattgatatgaacttccgcttccctaaaggcatgacaccagataagttagaggatactgtaaaggcgattgccgataaattacaaattaaagttacgcaaggcccatctcaagctccacattatgttgatccagatgatccaattgttaagacattaatgcaagcttatattgatcaaactggagatacagacgcaaaaccagaagttgttggtggaggaacttatggtcgtttgatgaagcggggggttgcatttggtgctttaatgccacatacgccaaatacaatgcatcaggctaatgaatatcaacctgtgaatgatttaattacatcgatggcaatttacatggaagcaattaataatctcgttactgattaattttgtgctaaaataaaggcagaagatggaggtgtcaagaatgagttatcaaaatattcttgttggtgtcgatggttccaagcaagctgatatggcttttgaaaaagcggttgacactgctaagaccaatgatgccaagttgtatttactaagtattatcaacggtgaacgttatccaagtactggtcctggtggatacggctttgttagtcatagtatttatgattcagcaatcgaaacgatgcaaaagaagttagctgactacaagaaaaagcagaagccgctggaataaaagatgttaaaactgatgtaaaggttggtaacgctaaggttgaacttgcggaacgttatcctaaagaaaatgatattgatttaatcattattggcgcaaccggattaaatgttgtcggacggctacttgtcggttcaactgctgcttatactattcgtgaagcaccatgtgacgttaccgttgttaagacaaacttaaagaatcaaaaattggatatcaaggaaacgacatatcctgaaatgtaaaacataaagactagtggaattttcttctagtcttttttagttttaaaaatgcaaattcataattttcgcgtatatatactataggacattatgaaggagtgttttattgtgttaaaccgccgtgttattactagtgcattaattgttttaacaagccttagcgggcaaccggttaaagcggacgttatccaacaagcacaatttgatgcaaatgaagatgtaaaacgtgcaaagccgattgacgaagaggccttagttaatcatgatgaagaatatattgatgcttatttaacagaatatgaaaatgctgctcaagcaaaggcaagtgagcaaaataatgctttgacaggtacagaggaagcgccagagcatgaaactattcaatcttcaactgaaaactctgctgaacaaaggcagctgctagaagaagataaaaaagatgagcaggtttatcaacctcaacaaccatccgcagtccaagcacaatttattaatcgaatagcctcagctgctcaacaaattggtcgggagcatgatttatatccatcaattattattgcgcaagcggccttagagagtgattggggatgcagtacgttggggaaggcgcctaataataatctttttggggttaaggggtattttgcccggcaaacagttgctcaacccacgactgaatatgataagcaaggccataagtttcaggttattagtaattttcgacagtatgcaagtgaatacgaagcgttaagggattatgcgcaaacattagaagacccactttatcaaggagttcaccgtcaaaataccaaaaattatcgtgaagctacacgggcacttcgcggacgatatgcaacagatcccgagtatgatcggaagctaaaccagctgattgatacttaccaacttactaaatatgataatcaagttaacaccagcaatgaacgggctaatcctgttccaatgactgacaggaaagaggagagtgaggcgatgccaattgttgccaaacatcccgttcaagcgagaaagaacgatgttaatatccctcaatatgttcctttgctcggtggggtagggacggcaggaatgattgaaatgtttcgtcgtttgttgaagaaaaggaaagagcatgattaaaaggcaaacctctaatcatgctcttatcaattatttagcgtaatgacttcaaccgttcatcaatcattgctaagaccgcatcaacgttcttaggatcttcaaggtcataacgctctaaatcaattttcatttttggactagcatcgtaatccttgtaccattgcttgtaggcactccacatcttgtaatagtaatcctttaactctggattagtatcaatttgctcgtaatctcgcccgcgctttttaatccggtataagattgtttcaaaatcagtttcagaataaaccattaagtctggtgcgcgcttaggtaactgttggaggtcactcatcatattgtcgagaagctttaagtatacttctaattcagtatcagtgatgttaccctcggcgttattttctcgcgtaaacaaggcatcttcgtaaatggaacggtcaagcacgttgttatcatcagtaagtgcttgtttaatcattgagaaacgcttgtttaaaaaataaatttggagtaaaaagccgtactgttttggatttttataatacagtggtaaaactggattttctccgactggttcaaaaaatgcttttgtatgtaagtgttcggcaatcttcccagttaaagttgttttaccgacaccaatcatccctgctgtaataatcaccataatggcccctctttacttttttgtcacaaaaaatatcttactacaaaatattgtggaatgacacacctaattttacaatatttggtggttaccagatttaacttatcgtggtaaaagttatcacatctacattgttagcgattataataaaagtagagatatgattaaattttaaaaatctaatcatgtgaaaaattaatattaaggaagtaaagatgagaaaagaaagtgaaagtgagaatcgcgttcaattaacaatggccaagcagcaaggaacattgattgaggttcataacttgccaaatgatgattattttaatgtcggatttgtcgttgctctcgatccagtattttgtttgatgatcagtattgactgggatggtaaaatcaacggcttaattgctattcggattaagagtattctttatacagaacgccatagtgactacttaatgacggtttctgaaaaaactaaagttgcccatgatcacaactattttgatatttggcaagtacaaaattttattgataaccatccagaaattacccaggggaacctattatcaaatcttatcaatgattcctatgagaaccgtcttccagttgtgattggcactgaaaagtataagggaagtgatgattttacaggaataattactgatctcacacccattaaagtaacaattcattactataatgaccatgacctgtcatcattgtgggaatatgatattttgcgagcaaagattgactatctccgtgttcgtggtactcagatggcaaccgggaaacagatttttaatgatatttttaacgaaatgtgattgcaatatgagttgagatagtttaaattaattaaatattattaactagataaaactgtttactaaagaggttgaacagccatgaaaaagaaaataacaattcgtgatttagcaaaagaagctggtgtttctgtaaccactgtttcgcaaattttaaataataaaggcgatcgattcagcacagcaactcaggaacgagttttagcattacgggacaaatataagtacgttcctgacttcaatgcccgaaatttaatcttaaagagtgccaagacaattggggtattagttcctaatattgctaacccattttttggtacttttgtcgagggagtgcagagtgttgctcgtgaagcagaatttattccgctcgtctttagtgccaaccgtgacccaaaattggaaaaatattacctttcccagatgattgaacgatcaattagtggattagtgattgctagtgcaacgatgactacagagacaattaaagaagttatctcctttaatgagattccttacatcttgtttgatcaaaatcatacgcaggagggtgatcgagttcaaacgaatgattaccttggtggtcaaatcgcggctaaacacctcattgaacttggtcacaaacatattgccgttcttacctctgacaaccctactgaaaatttaaatcaccgaatgaatgggttcaaaaatattattaaagaaaataacctaagtttagatcctattcacgatgttattcgggcacctttgacgaaggatggcggatataaagcagcaaaagatgttttagcaactggtgcttctgctgtttttgcggcgaacgatgagatggcaattggattattgcgaggattacatgaattagacgttaaagttcccgaagatatttctgtaattggttatgataatatctactgggacgactatgtttatccacgattaactacagtacaacaaccaatttttgaccttggcgctggagctactaaaatgctcattgaacagattagtcatagtagtgcggaagcccgcgttcaaaactttccagtaaaattaattaaacgagatagtacaagttcctatcgtccaaaataatatggtatgatgatattatcaattagatgccaattgtttaaggaggaaataaacaaatgacaaatcatgtaacaattgtaggcagtttaaatgttgatacaacaatgaaagttaagcggatgccattacctggggaaacaattgccgctttaagtaagactaatgctgctgggggaaagggagcaaaccaagccgttgctgctgctcgttcaggcgctgaaacagcttttgttggtcaagttggtgatgacgctggtggtaagatgatgatcaatgacctcaagaacaacaacgtcgacacaacagggatccacgttgacgatcaagcaggtactggatctgcagccatcttgcttgatgaaagtggtcaaaacagtatcttagtgtacggaggagctaaccaacaattaagcgttaaggaagtagaagatgctcgtgatcaaattgccgctgctgattttgtgattgctcaatttgaaactccacaagaagctactctacgggcattccaaattgcaaaggaaaatggtgtaaagacaatcttaaatcctgctcctgctcatgaaattaaccctgatttattgaagttaacagacttaatcattccaaatgaaacagagagtgctgctttaacaggaattattgttacagacgaaacttcaatgcttatgtcagctgcaaagtttgctcaaatgggtgtccgaaacttaattattactgttggtgcaaagggtgccttctactgtactcaagatggctacaactttattcctgcttttaaggttaatgctgttgataccactgccgctggtgataccttcatcggtgcgctttcatcccaattaaagcctgatatgagtaacattgaaaaggcaattgtctacgctcaacgtgcaagttcattagctgttcaaaagcttggtgcattaccatcaattcctacttatgacgaagtagttgctgcatcaaagaataactagatttacttaaacacaaattaacaatggggaggctgaggaaagcgaaaacttttctcagccctcctatttttttcagtaaccttgcgcttaacgtaccaatttagtaaactgttgaacaaataataatggaggttttctttgtgaaagcagaatttattcttaaggtggttattccaccatttatcatctttgcgatcctcgtatggctaactgccgaacattatatctctggctgggtaatgtaccttctctgggtaattggtttcgtggttgcaaacatcattgtgacaaaaatttctacccggtggagtattcaacgaatgcgtgagaaacgggcaaaggaagagaaaaataatgataaaagtaattaaacaatcgtggatatttagggtgattttaattgcgctgatgttaattgcaattgagattcccccgattgcagttaattttgctttacgttattcaaagaccaaccagcttatcgtggacgggttcatggtcttattcatctgtttaatgctagcgattatttggtgggcacaccggacatatgaaacttataaccaattaggacagccggcgggaataaaggttggctggattatcggtggttatctagcgattattttgggaatggatgtccttagctaccttaatcaacttatctatcatcaaactgaaacagcgaacaatgcagcactaggaagcatgcttggtcataatgaagtaattacgatcgtattttgtttttcggcagttgttctaagtccaattgctgaagaatttatttttcgtggtacattgacaaatatgttctttaagcgtggcaacatctggccgaaagttatcttctcgggggtaatcttttctaccggtcatatgagtaccaaccccattagctttttgatctatgcttatatggggatggtcttagcatatgtttatttgcgaacggatgacattcgaaattcaattgcaattcatatgattaataatgcgattgcgatgtatgttctcttggttcaagttatctaaagttgcttcttgaaatcgcttacaattggtggtacattataagtgtggaaagattagaatggtaagatctcctatatcaatctagcaccgaagaaattaatagtaggctagaagcaacctaagtgtgacatgaaattttagactgaatatttatgtaataaggtcaccagggtgcactaggttgatgatataaatgcgactttgcggaagttagaatcaaaatgaattaataattagttccctagcaaagtagcagattctttccgcaataaacaaaagaggctggaaatgttccggcctctttgttatttttaaatggtaaagaatttagggacgtacaataccctttagggttgacactttaaataataaaagtgccaattctagggggtgtttttcgtttctagttattccacaacagaaaaattaagattactaagtaattatcaggattcagattgctcattaggaatattcgctgactatcacgaagtgagaacagcgaacatgactaaatggattaaacaatttttattagcaggactggcaggattaattcgtcctaaacataaccaaaaatattcacttaagacaaagattgccgcggtgaaagattatcagcttaacggactggctagtcgtgaggttttaattaagtacaaaatacgccatatttctcaactaaaacaatggattatccagtacaatagtgacaaactaactgttgcttacgcaacaagaaagcgagttaagaaaatgggtcggaaagtatcctttgatgagaaaaagcagattgtgcagtggacgattaaccaccagaacaactataaagaagcagctagtaagtatgatattagttatcagcgggtttattcgtgggtacgtaaatatttgcacgatcataattgggaagtactaaaagataatcgtggcagaaataaagataaagaaccgacaaatgagctcgaacggttgagaaaacgagtacgtgaattagaagctgagaaacgagaaagggaggtacaaattgcgttcgcaaaaaaattagtcgaaatacgcaatcgggaggtgcatcgaccggacgatatcaagcgattcaagaaatgattaaagacggttatacagtatcagaactagttaaagcggctaaagtaagccggcaagcctactataagtggctaaaacgagaattaactactaaggatatccaggatcaagagatccttaatttgattaaagaaattgagaaaactaataagcaaagtattggctatgggaaaatgactcgtcttattaagcgcgcaggtcttggatatttggtcaacaaaaaacgagttattagaattatgaaggaacatgagattaaagctgactatcgtcaagctaaaagaaaacgcgacaaggaacgtcaaacctatcaagctgaaaatatacttaatcgtcaatttaaacaggaagcagctaatcaggtttgggtaactgatacaacagaactcgcctacaatattcataattataaagttcgtttacatgtggttcttgatttatatggtcaatttccaattagctggctaattaccccaacagaaactagtgagggagcaattcaagtattcaagaaagctcagaaacaagaaggtgtattagccccacttattcatactgatcgcggagctgcttatacttctaaggcgttcaatcaatatttaactagcaataatagtcaacatagctattcagctcctggcacaccagcagataacgcagttatcgagcactggtgggccgactttaaagcaatttggctagcgcattcatctaagccacaaacacttgatgaacttcaaacactagtggctgaaggaattgaatactttacaaatacatttatttcagctaaaagaaatgaccttactgcaacggaatttcgttacggcaaagccaattaatttttattatttagtgtgtaaacttgacagggtacagtaccggaggataatagatgtttttatcaactgagggatttcctcaagcccaccgcattttagggattgtcaatgccaccagtcatttagcgatgcctaccgaagcaattgattcatttgagtccatggaccaattatttagtgatgttcaagaaaaattaaagcggcgggccagtgaaaaaggtgcagatggtgttgttggggttcgttttactacggatgttgccaatatgcaggttgcacccaaattcttggtcctaaccgcatatggaacaatgattcaatttgttaaataagggcaaattgaggattgtaaataaaaatacttgtaatttttgatgagttcggtatacttaataatgttacaaaatagttagtgcctcagtggcggaactggcagacgcgcaacgttcaggtcgttgtatggttatccatgtacaggttcgaatcctgcctgaggcattttttgtattttaaatacttttcgatagtgtctaaatcgttgatatatcagcatttttaattttaggtttacactatagaacactatttttaatcaaatccacgacaatttcacgacaaaataatatatcttcttgccaacgtgagccacctgtttttaggtggttttttattttgcttgtggaaatatctgcggaaaattcagccattttccttttagggtgtctgaattgtcggaattattgataaagtgtctctgattaattgctaaaaaggggatgttttagataatttaatttttatgattgttgatatatcaaaggctagggaaggacagcccctctaccctaaaattttaaaaattatcgtttgcacgcaagacgattgaaatgtgtgcgctcttttttgttcaaagataggggcgggggatgatataattatttttggttttatttatatctcaagggcgctctcacagcagagcgccttttttaacgcaatttaacgcttttaaacgctataatatacatatgaaaagcccctaagagttgagctaccaacttgcaactcttagggcggtgattaatcaccacttgatttcaagttttaagtctagcgatataaagattttgagctttaatctaatctttattttgctaggctttttatttacttttaagcgcaatttaactccaacatttcccaacatctgctagtagaaaatgttagcatttgctagcatcatgcttttataaattcctagcatttcctagcatttctgagcattttaacactaataaaatcctaggatttactaggttttaacagtaaagctagaggctttcaagggctatcaaaatagggtgcaacctttctcgtttttgtatgcacacttttttggaaagtacgcatactttttaatgagggtgcgcactaaattatactcaagataatatgctaaaatacctatggggcgtgaaaagtaaagttgttaatttttcgacaatatcaagggtagcttgtgagggctactctttttttatcctaccatttcctaccatcgtgccatcatttgccatcatttttaaactgggttaagcgattttttgaggttagcattggttaacattcagtatatccaaagtgataatattagattattgagtggtgcaaaataaaagggcggtctaggtgtctaggtcgtcctttagttagttaacttgtttttttacgggtaagcgcaattttgcgccctcgtcacttaatcgcttggctttttgctcttgtgctagtgatattaatttgtctaggtcgtctttatctgcatagtgtttaataaacgttttagcatttgaacgatattgatatagtttgtttttctctgggtgtcgtttcttgtatcgtttagtagcttctgcctgtgcaagtgtaaccatgaaaacatccccttaaattgcatatagtgtaatatagtgtcttatagcgtaaagttatatcttgtatagttatatgcacatgttataattgtttatgtaaaaaggcgctaggttgtgctagaacctaacgcccgacgttttcttgctagacaggtttacttcaaagcattagtagttagtagctattaatgcttttttagtaggctgattgcaataacaactacaaatacaagcattttatagcttgtaaatgttaatgttatgctcaccgccagaacctccctagcagtcaagaaacaaacacataaccaacacttccgtttcttgctgtgcttgtaaaaggctggttggtgtctagcttcttttccgccttgataagtgctaggttaattactcctattacttatcatgcttatattatatataactatcataagcatattcaacaataggggaacttctaatattgaatgctaactgatagaataaattcataccctttttagggtaaataaaatcatgtgatataatgaattgctttaagtttgtatctaaggggcgctctcacagtagagcgtctttttttattggaatttgttgcacaaaaaagtcgatgtgcgttcccaaagtatcaataaaccaacccccgttaaaagagaacgggggcttttttagtatggtctattttgatagcaaaagaggggcgaatattgctctttcttgctttcagttttgacgttaaatgtgattatatcaacgattacagctaatcactcataagcaataacaattaactacgaattagctaacgagtataagtttttccgatattgttttaactacaaacatccccgaaaatgtgcaatttttggcaatggtttttaattaagattgctgttatatcaaccttttagatgaattgataaattgcacattacatggaacatttactgtttcacaattccaatgtttttatatgcggttgttaccttgttaccgtaatagccaacataaaagcgatggtgcttttgataaacaaagcccaacaattccatgttttgcttaaattggcgattacttaatggagttatggattgttgttggcaataatctaaatagcaattgtaagccgtacggcaagcggtatataaacgcctgtctttattgacgttctcagaaaatacaaaattaacgacggttgggtctgctttatctttgttcttaactctaaaatgataatctttctcactttcagccatccactgtgctaaggatcgcttactaaatacataatgcccacgataccaactcatttataatcatcccctttgtactggtctttcatgtagtgggtgaatagccatataaccgcaatatcagcaaaaaggcttgccaaactacatgcaattgctccaattaacagacacgatacagcgaacatttaaatcaactccatttttctatatatgctaattttagttttaaagccgtctgagccgttttaacttgcaaatgataaattatatttaaaactaattatcgcttttaaaaccgcctttaaattaaaaataaacactattctaaatctgattagtatgtttattgctatgatcctacgagtgatattttggcggtcagattttaggctgtcaatttttgatagctgaattttaagccaccaaattttagataatattctcgtgtactgtaaggcgttttaagaagttttaactaaaagatgatgatttaccctaaaaagtaattaacgataaatagcgacggtcacgatgtggatctctggaaaataaacgggtgtttaagcataacctctccgccaatccaatatctttagcttttccgtccaattgataacgaaaaattacagttgagctattgatatatcagcatttgggctagtaaagcattgcacgctttttgtttccttttccgccgaataaattaaatcatcccccgattatcgttgatataacagtaattgggggatgtttattttcatcgctctagttgatcgcattcgtccaatttttcattaattgagtagttactgaaatagctatcaattaacttcttcttagtttccctattcttgcctgtactatgtgagtaatcatcaataacggctttaaggtgattaactatctgcccctcgagttgttgcgcctctttgagctttttattgtacttggtaacaagctgcttattttgctctagcagggtaggaacatggtgtttaattatacccatgtcgtccagtatctttttatgggcgaacggtattttgattaggctcttattcaattgtgcttcattctctgcaatttgtttgtctagttccttaatctgggtcagcttgatgttgttagtatcaagccccagtacaacgctagacagatgatcttcaatttcttcacggttcatagtaattacctctttttatagtccgactaatctgtcattacttttaagggtgcctaatctgcccaaactgcttcaaatatttattagctaatttatcttttgctttgctttcctcaccattgcttcttagataatcgcttctaatggtctttaattgcttttgaagcgaactagaaagtttcttggcttttattagctttcgattgtatttaattattaagtgcctgttttgtttgagtagggtaggcgtttgatgtttgaaaatacctagaccatcaacaaaatacaagtgggtaaatggtatcttgattaagctatcgtttaattgcttttcgttggcttggattaggttgtctaatcgtttaatgtcactcatcaatttagtataggtttcatatccagtgcaaaagttagaaaggcttttctcaaattctgttaggttcatgaatgtatcacctctgcgtcttaatcattactagaggatcgttccaatgtttgcttggtgtactcgggtaggtgctgtattaatagcttggctaatgattgttcgttttgatattgtggcatttgattagcaacgttcataatgttatcaattcctaattggatgtcctcaatttcatagccattatggattaacatatcaaaaacatcagcaagtcttttattatctttggggatatcagtagttgatataccgtttaagtagttgaatagactgttaatgttatcttggttggctccactatctactgcactgtttcctccattctctgtagtagcattattctctatagaggaagtagagctgtcgtcgttaagaagaatttccccatacccccattagaagaactatttatatacttgtagttattttctttattgatcttttctttgctgttctgagctgtactgtactgttctagtctactcttatctatactattcttatctatactaggtgaccctttagtaatctttttgtttacgttagatttaccgttcgttaccttttgggttaccacacctttcaaacgctgttgttgcaaggctttaagatttatctgtctgttgcgattttttctctctacccaatcatctaatggcaaggcaatatttctatcttctgcgtttattgtgtatttaaaatcaattctgataaataccttactggataaatcgagaaaagaagttctagaatagtgatttaataattgagtatttagccagtcaacaatcaagtaaactccctcaacattaacaataagacccgcatgttctaattcgctatagttttcagcggttgctttatccatcaaattaattaaagaaacatcagaacaaaagccatcatcatcagcatatagcactaaatcatcgtaaagaattttacttacaggcgataaagtcaaaaagcgtccgtcttggtgtattgacttactaatcattcttctttgtgccattactttgatcctcctcttggtaaacattagttacacggatagccttaaaaggaattagcaagtcatcatctttacttagataataaggggtactatcacgccaatatatccgcttgctaatttcatttcctgtcgcaaagtcatttaatatcaaatttccatcttgattagttgcttgaagcaatttcattactcatccctccatattcttatagcttaattgaccatcaacaaatagctttgttaaagcgataaggcgtttaagcatttcaacatcgttatttgtgacttgttcaatgcgttcaacaatcttttggcgttctcgctctttctttttgttgtgcgctaagtaatttggattgttaattgacttcatgatgaaataaaggcgagtggtgtttttatcatcgttgttcgttagcaaggacaacttagaatataagtcaccattgaagccgtctaagtaaactaagaaggtgtgaacttgcttaatatcattcccaacgaacttactaatacgggtagcgagttccgttggttctttgctgttctcggtgtttttaagatatgaataccacgagagcagggcgaggtaagtagttttcatgtcccaacgttcacggtgtccgtctggtgctgtaagagtaactagttgcattctgtatcaccgcctttgagttcaagagttgctaattgttgcaatgcttctaaatcattatcatttaggcgctctaagcactcatgtaaagcgctgataatatcttgctgataattgaccgttaagactaggctagttaaatcattgtgggtgtaatcatcctttaagcatggagctaaataatcattgagcctttcgtgataatcaattagggatgaaattaatccgctcatggtttcgtggtctgctataagctcatctattttttcagtcattacttgttaccacctttataaaagtcttcagcaacggttttaatttgattttgagcgtttgtcgttgctgtaattgttgcttttgctaatgctagtagtttggttactaaacgatcagcttgccacttcacgcccttatgtgtacttggatattcagtgaataaggaaacattgtcctctaaaaggtcgtttattgtttgtgctagtcctttaacagtatctaaagtaacgttagtgtcctctacttggtcgatattaaatttcttcatgattgattattcctccatttgttggggatattccccgttttaaatactgaaatatgttagaataagcaagcaacgggctttatccgttgcgcttattcttttgttgctgttaaatgctaactactttggtcggtgagtagcatttgacggcttttttattttgtcgaaacattattcttcactttctaaatctgcgttactgattgcctgcgctcgcttactcatcattgttatttgtgaggtgaggggagctaaggcttgttgtcgttctttgtcattggtgatgatgaaatatccgttgttaggatgttcatacttagcaccaattggctgatggtgaattacgattaagcgattaataattcctctaactctgcgattgctccatccagtaagtttcactaattctttgagtggtcgagggcgttcaatccctttaggcaacaagtccaatagttgttgctcttctttgtctagttgtttcatcggcttcattcctttacttgattaactgagcgagtaaattcattgctacgagtacaacaggcaaggtaacaaggtaagcccaaactctttcacttggtgctgtgtcccagtagcttaatatgtgtttatcaatagttattaaaagcttcatgataataaatcctccaatatccacgctggcaagctgatattatttatttttcgtgctggatcaaaaactcatctagggctttacgtctgaaacgactaacgccctcaatcttaattgtggggatgtcatactttttaagccaagcattgaagacaccccgtgatacaccacaataggcactagcttcgcccttattcagataaggtgggaagctatttttattttgcacatccttaatcgctttattgagtgcatccccaatcattgctttggttgcttcctgtaaatcatttggcaactgcacttgtaaactttccatgttctcaactccaatcattaagctaatagcaaaacgccttttacttcgtcccacgtcttattgaggccaacaaggccaatagcgatattctctaattgctgataccgttcttgctctttgagtgttagaccatctaacgcaactttgacgtgtcgctgtttcttaatttgctgtgctgttagaccagtagcacgctttaataaaagctgtgtcatattgcgataactccattgagtaacgtgtggccaatccttgacagcgtccatcaaagacttacgctgtggcttttcaatagctcggttgatctgtcgttgattaagctcttttctcatacggtagaactcatgaacaaggtttttcttgaattgatttacctctggtgtgttatctaggtaggtaattaagagcgtggcttgttgttcgttaaggtggtaggtcttttgtggtcgtccacgtccatttaatttacggatttcaaatcccaaaactccgaactcttcaaagtctcttttatgattacggattaggtgcttaacattatccaattgattattactgcattctgaaatgatcttatctgtggtatacggctcttcattcaagccgtgcatgaaaactagattattcattcaaaacatccccttatttgtcttgcgtttttgagaattcttttattgatgtggataatttatcgaattaattagttgatgtctggctttgtacatctgtatgtacgttactcaaaaatgctggcgttttatttaattcttgcaagtgatttttttgtgcctttgttaacggtgattttttccgaatagtaactttcccgttgtctacatcaccctctagcatgattaatcgacctgttgagttgtaccctttgcgctggggatgagttacatatttctcgtacttcctagcatgtttgggttcgttcgtgtaaatgtgccatatccctgttaaacactcgtaagaaataatcgtctcacgttcttcttgtggagctactttcatatttcgtttaacttctgtcattccttgtcacctctacttgtcttgtgttgctactgcggtgctgtctttaatatctgctgtggcgtactcgtcaataagccaatcactcaacttcttataagttgctggcgttaccttgcgatggttacgcttaaagatattgtctagcgtccatcgacttaaaccgagttcacgcccaagtgctacagtagataaattaagttcaccacgtttgcgtttgatagctattacttgcttatctgttagaaacattggcatttaatatcacctctattcacacaactgtgagtaaatattaattcacataactgtgaatgtcaataaaaatgttcacagttatgtgaaataatgatattatttaatcaagtaaagaaggtgataatatatgagtgaatattcctatcatcgctataaacatcacaatagaatcaaagaattgagaaaagaaaaaacctaactcttaaagagctaggcgagaaagttggtatgcgagataatacgttaagccaatacgaaaacgaaaaaagaaatcctaacgatgaaatttggagaaaactcgctgttttctttgatgttagtacagactatatcaaaggattgagccacgaaagaactgatccttatgaaagtataggcagaattattaataaaattaattttaccgatgataaagataaaaacgataagataagagaacaattatttgaagcctttgctatcgtcctagaaagtacagaagacaaactagtagatttagaaagtcgaattgataatgttgaccctaactatcatgacccttcatggtatttatagttaaaagctactaggagagacactataaaaaactttattattaacgcatttgattgcatatcaaatatcgttgttgaagttttatgtatcgtacttccttaggctaaatagagctaatttatcagaggttttcagaggtagtgtcattgttcgatgtgatattttgtagtaattaatctgctgtttttctgcactttttacgttgaaacccttgctgtgcttggcttctttctgctgatttattgctgatatagctaatatatagccgtttaatgttaggttttgtaaggttctatactgcgaaaccaatatacacactaatagcgccactgttatcaccactaatagcaccactgctatatttccccagttttggggacatctgctaagaattaagccaatgttcaatcggtcgaaaactcggctgattacatccgtccaaaatcggacacatcttactcacctcaattttggggtaagtacatctgcacataattgcgtgcgtctttactcggctcaaaattgagcccggcaaaattgcggagtgaatatcactcagccgaaaacttggctcagtacatccccttttgacagcgcaaaattgcgccacgaaaactcaaatacatacctccaatatccacgttggcaagctgtgcgattgaaagaggtaattttatgagttatgtaagaaaagcgaaaaaaggatactacggttatgcaagctaccaagataacgaggggaagtggcatcagaaatcagccggctgttttaatttaaagcgtgaagcactgcaagaagccaataaactagaagcagagttagaccaagtgaaccttgatttaaaagatatgacactagctaagtattattggcggtggtatgaactctatgaggaaaatggtattactgatgttacgaaaaaccgttataaggttatacggaaagccattgaaagctactggaaagatacacgactacgggacatcaagcgctctgattatcaagcctttattaactggtacggtgctaatcatgctagggacagcgtaaacaagctcaataatgctatccgttcatgtgttggctatgcgattgatgatgatattatcagcaaagacttcacgcataacgtcaaggtggtagctaataaagagcgagagcgcaaagttgaataccttagtcatgatgagttagtgacactaaaaaatgaggtcaacaagaagctcaatcactataatacaagccgttacatgatactcacggcaatttatactggaatgcgcaagagtgagatacaggcgcttacgtggaatgatatagattttttacattcaacaattagtatttctaagtcgtgggacgaaaagaaaaaaactttcaaaccaactaaaacagaatctagcaagcgaacgattaaggttaaccgtcaactgttaaatcgtttagctgaattgaaagctaataatagtattatggtgtttcaaaacgtgttagggacaatcccaacaagtaacgcattgaataagtgtttgcgctctattatgaatgactgtggcatcgaaaagcaagggtttcactttcattccttgcgccatgttcatgttgcctatttgttaagtcaaggtgtcgatatatacgccatcagtaaacggctaggacattcaaacatcactgtaaccttaaatacttattcttatctggtggatgagtacaaggctaaaaatgacacgctaatcattgataaactggctgaattatagagttcacgacaaactcacgacaaaataaagctcaaagcccgttatatcaatgtttaatattcctgcctgaggcatcatcatagctcggtaaacattgatttgctgggcttttttctttatattgaaataaaactgcaaaggaagaccaaaatgaaagttttatcaattcatcccgaatatggaatggaaatcttaaatgacacaaaaacagaggaataccggacatggacaactaaatatcgtggtgacctcctaatttgcaatagtgcaaagaagacacatggggcggtagctagtcatgcgttatgtgttgctaagattactggaattgaggaacgatatgacggtgaacaaaaatattatgcatgggtgattgcaccctttgaggaaggtggttcttattggattgaaccattaaaagttaagggacagttaaaattgtttaacgtcgatgaccgcttgattaaacctgcgccgtttactaatcctttctcaaaagctggggaacaatggtaccaggaaaagattgcgcccttaatctattaagatattttcaccaactaacttatgcgttatgatagaaaataaaaaatgaaggggcaatagcttatcggaaagattagaattaacaacatggcatttaatacttacaatggtgtgtttgcggaagagaaaaagcttggtcaaaaaattgaaattgactgtgaaatggactacccaattgaaacgatggttaaaaccgatgaattagaggaaactgtcagttacgctgatgtttatgaaacaattgcggagtttgttgcccaccataattacaatttgattgagagccttgctaataatttattgcatgagcttttcaaaacatacccaatgcttaatggtattcgccttcgtattcgtaagtatagtgtgccaattgccggaatttttgataatgtcgaaattgaagtagcagggagcaagtaattatgactgaagtttacctaagcattggcagtaatatgggcaaccggttagcaaaccttcaaaaagctattcagatgctgaatgtgccgcctaaaattgatattacggcgatctcctcagtgtatgaaacagaaccggtgggaggtgtcaaacaagattctttttacaatattgcggttaaagttgcaactgggttaacagctcagcaactccttgaccatcttcacaatatcgaacaggagttacatcgacgccggctcattcattggggaccacggacaattgaccttgatattattgattttggtcatcaacatattaaaacctcaacgttaacaattcctcatccagaaatggctaaccggcagtttgttttattaccaatgcgcgaaattactaatcaaaatgatccttattatcaacaattggatcatttattaaataagactccagaccataattggcttaaaaagatatatggacgagaggtattttcatggaccaacaaaaaatagcaaaggctgttaaagatttattaattgcaatcggtgaagatccggaacgagaaggattggcagagacaccccagcgcgttgccaaaatgtaccaagaagttttttcttctcttaaccatcaaccagaagaagtggcgaactataaggtctttcatgttgatgatgtgccagaaatggtattagtgcagcacattcctttttattcaatgtgtgaacaccatttgctgccattcttcggatacgcgaatgtggcttatgttcctaaagataagaaagttattggcctaagtaagatccccggttgttagattttgtaacgaaaaaaccggggatgcaagaacgcgttacaacagatttagtagccgagttgcaacgaatccttgatccagccgggattgcagtaaccattgcggcccgccacctttgtatggaaatgcgaggtgttaataaggccggtcaatttacgtatactgataagtttacaggtcaatttaagactgacagtgatttgaaacaagaatttctaaatcaaacgaggaattatcgtgcagacctatgaacaaattaacgcgggctttaaccgccaaatgttgggaggacaacaggatcgggtaaaatttttacgacgaattcttactcgtttaaaaaatcctgaccagcgatttaagattatccatattgcggggacaaacggaaaaggctcgactgggacaatgttagaacagggtttgcaaaatgctggatatcgggtcggttattttagcagtcctgctttggtagatgatcgggagcaaattaaggttaatgaccatttgattagtaaaaaagattttgcgatgacttaccaaaagatcaccgaacgcttaccaattgatctttcgcctgatgatattaccatttttgagtggtggaccttaataatgctgcaatattttgcggatcaaaaagtggattgggcagtcattgaatgcggtttaggcggtcaagatgatgcaaccaatattatcaatgcgccttttattagtgtgataacacatgttgcccttgaccatacgcggatcttaggcccaacgattacccaaattgcccaagctaaagcagggattatcaagaatgggactaagcaagtgtttttagcgccgcaccaagaaaaagacactctcacaattattaaggcaaaggctcatcagcaaagagtgggattaacgcaagcagatgcccagtcaattgttgatggaaaggcaatcctgaaagttaatcataaaatttataaagttccttttaatttattagggacatttcaaagtgaaaatttgggcaccgttgtcagtgtatttaattttctttttcaacgaagactggttacttcttggcagcctttactatcaacgcttgcgacagtgaagattgctggtcgaatgcagaaaatcgctgatcatccttctattattttggacggggctcataatccagatgcagccaaacaacttaccgaaactatctctaagtttccccgtaataaagtaattatggttcttggttttcttgctgataaaaatattagtcagatggttaaaatttatcagcaaatggcagataagataataattactactcctgaccatccaactcgcgcccttgatgtaagtgagttgaaatcagctctgcctcaagcgattattgccgataatccccgaaaagggttagtggtggcaaaaaagattgcggagccgaatgatttaattattgtaacgggttctttttatacgattaaagatatcgaggccagtttagatgaaaaataattttattattgcaacccataatattcataaaattaaagaaattgaaaccattctaaatttttaccaccaacacggtgaggggtatcgaaaaaagttaccgcaacaaacctttcctcctgaatcaatagtgagctatgaagaaaacgcaaaggcaaaggtcctctttatcagtcaacaactaccggcagcaaaaataattaccgatgattctggcttagaactcccggcttttcctggaaggtacggggtgcagacagcgcgggaattggcacaagaagttcctaatggtgatttaaatgattacttgatccatttagttgatggtaaatcccgacaatttataatgaaaacaacaattgccctggcgataaataatcaagtggttaaaattggtcatggtcaattaaaggggacaattgctcatgccgaacgcggagtcaatgcgacggggtttgatcggatttttattccagctggtgaatcacaaacgctcgccgaaatggaccagccgacccgcatttcttatttacatcgtgcacgagctgttaaaaatttattagatcaattaggagaatgaaatgaaagttactgaaaatttagttactaaagactattcgaagttagtgtccgcgatcttagccgaccaagttaatcgccatcagcagcttttattgacgtgggagtgtccagatgtggagacggctggaatggtagagcgatttatccgtcattttgatacccctgtcgcttgtgttgaaaagcgcgtagaattttctttcccgctcctttccctaaaagaactaatagcacgggtgaaagagcggtgggagaacgaccaagaattaattgcttctcttgaacaggtttaccgtcgtcaccagattatttggcgtgcaggccggtttacttttgatctgacagagcaaccggtgatttatggaattttaaatgtaactcctgactcattttatgatgggggtaaatttcaatcccattccgctattgctagtcaaattgctaagatggtggcagctggggcaaacgtaattgaagtcggtgggcaaactacgaaaccgggtggctttaaagaggttgatccggaagaagaaattgcgcgaattatgccggctattcagcttcttcgcgaaaactatccccagattgcgatcgcagttgatacgtataaactcccagtaatggcagcggcaattaaggccggagtagatattatcaatgatgtgcaggcatttaattcaaaacaaaaactaattttgatggctaaggcaaatgttggaatggtaacgatgcatagcagccgaacccatgactatgataaccttaccgtagcgatgcagaaattctttgaacacaatcttgggacaatagcggctgctggcattgatcttgaacgagtgattttagatcaaggaattgggtatgcaaaggttgctgacggttaccaggattatgcgacgatgcgaaacattgaccaccttaattacctccagcgcccgattatggttgcgatctcccgaaaaggttttggtcaaaaattatttaatctagcaaaagaagaccgtctcggcgtaacattgattgctgagacagcaatgtatttgcgaggcggtcgtgttttacgagttcatgatgttgaggaaactagtcagttagtgaaaatgattgacactattgaaaacagttattggtttagatccaccagcagccaatccccaaggcaataataagggcaataaaaagtaaggctgttagatagggattgccaaatgtttcccgtttaaggcggaaagcagtttccattaagatatagattagaattaaaaagatgatccatactaggttgctcagaagctgagtcttgaaatgaagaaaggtatggacaatcgaagcggtcaataaaaggaaaaagaataaacggcttagttcaagccagttagtcactttccgttcaatttttgcatgcagaccagtggtagtgatgagaatcaaaataatgattaagaccgccactattatttttaacatatgggtaaactcctttcggctttgattttagcattgatgagagaaactgactatatgcgttagtgtaagattttcataggttggatgaataattcatctggtcgtggaaatcttttttgtagaccaatttacttatttacaaaaaaagaaaagaccagtagcctttagtgtgtcgaatactaagcaaaggcaggtctttcctcatggatattttaacagaaatcgagcagaatttggtgaaatcaggcagtttatttgaagctgaacagattattttaaaaggggtattggagttaggacaagtaatcatgcaaaactttttggaaagcttagatcgaagcttaaagtcccaagctccagcgaactatcaagtaattaataaacagccacggacgcttaattttatctttggcccggtgacttttcaacgacggtattatcaggctgggacaaagaaacgtgaattttacttagaccaacaattaaaaattaaaccacgtcgtcgtttatcgccacaatacttaatgatgatggctaagattgcccaaacaactacaatgcgcaatactgccgacattttgaaccttgtatttgacagcggaattactgccgattcggtaatgcacgccgtgcatgagttaggaaatcaggtagctaaacaaactcaagcaaaagaacaccaagctactcctcgccatatgcctaaaaatttaactattgagggtgatgcctttatgattaaaggtaaaaaagaagcaggtcagctgactcttgtgcaccattatcgggtttatgagcgagtagctaatcaaatcattaatcggcatgactttctcagtgttgggcaccaaggacggcttgaagcacgactaagtgattatttagaccgccattataagcttgccggtcaaacgatctttttggccagtgacgctggcccaggttacgaaccagctaagctattaagtctagttcctcaaggtgcacatggtgaatactttctcgaccgctatcattgtttacagaaaattgaacatactttaggccggcacaacgagttagccatgcgagcaattaaagccgttcgtcatcatgatcaagcagagctaacaataattttagatacttatgaatcacaaaacctaacggaaaaacaagcagacgacctaatgcgtttaagaaagtatctacagcgaaattggcggtatatcctctcaccacaaatgcgtggatttaaggatattcatttaattggttcagtcgaaagttctcaccgggcttttacttaccggatgaagaaacagggcaagtcatggactaagcagggggctaaagccatgattggtttaattgaagcccgaatgaatggtgaactgcaagctagtttaaatacaatcctagaacaattaacagttcttcctcgagtggctcaaaccagcctattacaggaaatgcatattcgaactggagagtttctaagaaaggcaccgacaaagccgtcaattggagcagtacaaggaataattccgattaacacggccacaagtagaccaatgggacaactttttaaggcactaacccactaaaactgtatatttaaaggctacctatgaaaacttgacagatacactatatgcttttgacttgaaaatataataaaaaaagtgtatggtacgtatattgcttgcgtaaaaataaataatatttgaggtgaaatcaagtggcagattttgaaattggcgatattgtaaaaggaaagaaattcggtcccctcgaacatgaattttctggtgttgttgaaaaggtttatactaattcaattatggtatccatccaagattttgatccgtctgataaaagcggggttaacgaattaaatggccgcgctgttattcgccaaaaagaagctaagatggtaaaggctgttcctcgtgaagaagaaaaggatgacgaagaaatagtagaagatgctaaatcttcaaaaaaatcttaaaaaaagatgacaaataattagaagaggtatatactaactaagtgttgaacttagttagttaatgcgggtatagtttagtggtaaaactcaaccttcccaaggttgcgtcgcgagttcgattctcgttacccgctcttataaaaaagctgaggctaagagaaagttttctcctagcttcagcttttttagatctcaatcttagctaaaacttgatgcattgcttcagcagactgttgcatctttttaacttcatctgatgttaacggatattcaacgacctggccgattccttgattattaatgatggcaggcgttcctaagtacaggcccttaattccgtactgtccatcaagcggagccgaaatcggtaggacaaggttccggttttcgatgattgcccgtgtaatatacgagaggcatttagcaattccgtagaaagtagcccctttattggcaattatttgactgccagcttcgtgaactgttttttcaatttcacttttatcaatatttgaaagggcagtaattgtattgagggcctttccaccgattgtgatttcattaaaggccgcaaaagaagtatcaccatgttcgccaagcattaaggcatcgatgacattgacggataggtgtaatttcttgcttaagaggacccgtagccgcattgaatcaagagaagttccggtcccgataacccgttctttaggaaaaccgctgattcgctgcgcaattgttgtaaggatatcaacaggattgcttgagataacgaaaacaccagtgaatccacttttgacaatcggttcaataattgacttaagaatcgtagtgtttttattaactaggtctaaacgtgtttcaccaggtttacggggaatccccgctgtaataacaaccacgtcagcatcagcggcatcttcataggttcccgcataaatctttactgggtttgtcaggggtgtaatatcagcaagatcagccgcatccccaactgcttttgaccttgtacgatccaccagtaccaattcatcgacctcatttgttgactgcaataatgaaaatgcaaatgatgagccgacagccccgtcacctattaatacaactttgtgcctatacgtatcaagcatcaaaaattcctcctaatgcagctccttttgcgcatcccaatgattgattgggccaaatttatgaccaaccgttaatggatttgcgattgctgcgtaaacggcatctttagcctttgttactgctattttaacattatttcccttcgcaagctcggcagcaatgatcgcggagaaactatccccggttccattcaaccgatcagtcttaacaaaaggttttttgagccagaagctatcaccgtcttcaagaagaacaaagtcatcaacagttgtttggctatcatcattatgcgcgcccttaatcaccacattttttgcccctaagtcttgaagataatgagctgctttaacccgttcttcatctgtggtcatttcaattcctgttaatttttgtgcttcatagaaattaggagtaataacagttgcaaggggaataattcgttcacgaaatagttcataggcggattgttcaagcaacattgcaccgtgcttagtaataatcacagggtcaacaactaacgggccaaaatgttcaggcgaatagttatcagcaacgacattaattacatcgtcattagcaagcattccagttttggatgctttgatgtcaaaatcttcacttaataccttaaactgttcggcaataaattcttgcggcattacttgggaagaggtgatcccgtaagaatttccggaaacagcggcagttaaaataccgtgaccatatacgccatccgcaaaaaaggcatgaaggtcagcgggcattccagcactcccgtccgaatcatgacctgcaattgtgacagcttgaattgtagggtttgtcataaataactcatcaacctttcattattatttaatgataataattgtaacatataataagtaagaaaaaagtaataactcacccttgtagattagtccttgtttttaaatctaaatttgttataataattgagtgtgaaaataggatttgaggagtagtagcactttgaaatctacagcgaccctttgttgatgagagttaggggcttttcgatttgtgaaggcgtgcctcagatatttcaattaaatcaatgaatgagtggaattctaattcaattagagtggtaccgcgggtaaatctcgtctctagtaagcattatgcttattaggggcgtttttttataagtataaggaggaatatatatgagcgataagcaacaagttgcagctgcattggcacaagcattgccagagatggatgttaaagaaattgaagctaagattgaacggccaaaggattctagtaatggggattatgctttcccgacattcttcttagctaagaccttacataaggcaccgcaaatgattgcaagtgagttggttgaaaaggttgaccaaaacggttttgaaaaggtagttgttgctggtccatatatcaacttcttcctcgacaaagcccaagttggtgctaagattttgcaaactatcttagcggatcctgaacattatggtgagattgatcttggtcaccaatcaaatgttacgattgattattcatcaccaaacattgctaagcctatgggaatgggtcaccttcgttcaaccatgattggtgaagctgttgcccggattcttgaaaaagttaactacaacttaattcggattgattaccttggtgattggggtactcaatttggtaagttaatggctgcttatgagatgtggggagacgaagcggaagttaagaaggatccaattaatactttgcttaagtactatgtgcggatcaataatgaagctgacgaacatccagaatacactgaagcaggtcgtaactggtttgctaagctcgaacatggtgacgaagaagcatggcggctttggcactggttccgtgaagtttctcttgaacggttccaacgtgtttacaagatgctagatgttaacttcgactcattcaatggggaagctttctctgctcaaaagatggaagaacctatccaattgttacgggataagaacttattgaagcctagtcgaggtgcagaaattgttgaccttgatgaatataacttaccaccattactcatcatcaagagtaatggaacgacaacttacatcactcgtgatttggcaactgcacttttccggaagcggatgtatggtcatgctaagtccctttacgttgtcggtgccgaacaagaaacttactttaagcaattacgtgcggccttaaaggaaatgggcttcaactggtgggatcaaattgaacacatctcctttggtttaatgaacttaaacggtaagaagatgtctacgcggaagggtaatgttgtttcccttgaagacgtattgaatgattctattgatttagcacggaagcaaattgccgaaaagaaccctgaccttgaaaacgctgatgaagttgctaaagaagtcggtgttggtgccgttatcttccacgatttaaagaactaccgtcggaatgctgttaacttcaagcttgaagatgttgttaagtttgaaggtgaaactggtccttatgttcaatatgctcgtgctcgtgctgagagtatcttacgtaagggtggcatccgggactttagtgatgttgacttgacaaaggccggtgctgaagcttgggaattaatcagcttccttggccaatacagcgaagcaatcaagcgggctgcattaaactacgatccatcagtaatcgctaagtatgctcttgaattggctaagaagtttaaccaatactacgctcacactcggattcttgataaggacgaagctcaaccagcacggttagctcttactcaagcagttagtgatgtgctcaaatctgctcttgacttacttgatatcaaggcaccagatgagatgtaaataaaaagcgtgtggagaatagccttgtagtgacacgaagctagttccactttatcttgctattattcgtgaaaatagaagagggagaggctgagaaaaacgtcgttttttcaacagcctctttatttatatgaactttatttaagatatcgtggaaattaaccacaaggctcgaggctaagtccgaacgataatcagcccgtgccgtgctaatcaccgttctatccttagcccaccgccttgtcgagaaggttaattcccactcacttcctcttcttttaatttctggtaaagctggcggagaaaatagcttaccatttgccaaaatgtgataaaataattgtcagctttttgaaatgaaaatggagatttgttaatgaatcgtgaaccacaatctaattcagatttgaaagagcgaatcatagagtggttaaaaaagacttgggcatcgttccgagtttggtttaaacactattggcagctctttgttgcgatgctgaaaaagttctggcatcggtatcaattaacgcgatggatcattgttatttttctaggaattttcttaattaccagtatccatttgacgtttgttgctaaaactgcagatgttaaaaatcttaagaaccggttgcaacggccaacaatgatttatgatcgtagcaatcaatcggccgggagcctctacgctcaaaagggaacttatgtggaattaaaagatatttcatcaaacgttcctaacgcggtcctctcgactgaagaccggaacttctatcatgaacacggcttttcagtcaaagggttaggccgtgctggcttcttactagtgaaaaacaaacttcttcaccgtgactatatctctggtggggtagtactttaacacagcaactggttaagaatgcctttttgactcaacaacagaccttctcccgaaaggcccgggaaatttttattgcggttgaggtagaaaaccaatacagcaaaaatgagattttaacaatgtacctcaataatgcctactttggtcatggggtatggggagttcaagatgcggccaagcgttacttcaatgaaaacgccagtcagctaacggtaccccaagcagctaccctggccggaatgctgacgtcaccagggatgtacgacccagtagaacatccagcagcgacaaaacaacgacggaatatggttcttcagctgatggttgaaaatcataagctgagtcaaagtgcagcggatcaatataagcaaacaccgttgaatattaccaacggctacgtgccaaatgatagttataagtatccgtacttttttgatgcggtcattgccgaagccgaaagccgttatcatatttcagaaaaagatattatgaataacggttatcggatttatactaccctggatcaggatcagcagcggtcaatgcagcaaacttatgacgatgacgataacttcccgcagaactcagccgatgacacaatggttcaatcagcctcgattgcgatgaatccgaaaaatgggggaattaccgcggtcgttggtgggcgtggaaaacatgtcttccgtggatttaaccgttctacgcagatgcggcggcagcccgggtcaacgattaagccgattgttgtatatacaccagccctagagcatggatatttctatgattcaacgcttcaagataagaaacaatcgtatggaactaataattacacgccaaagaactatgatgatacctatagcgggacggtaccgatgtataaggccctttatgagagtcttaacgctccagcagtctggttattaaataagatcggggtcaatcgtggttatgatatggcaaagaagtttggtttgccagttgaaaagggtgataagaaccttgccttggccctcggtggtatgacccgcggagtatcaccgcaacaaatggctcgtgcctatgcagtctttgccaatgatgggttgatgccatcaccgcactacattaccaagattgaagatgcctctggaaaggtgatcgccaaaaatgatggtagcaagaataagcggatcatttctggtaagacagccaaagaaatgactagtatgctaattggcgtatttgatcacggaactggtgaaacggccaaaccaagtggatatacgcttgccggtaaaacagggaccacaaactcaggggtaaaaggcgatgattccaatgatcgtgataagtggatcgtaggttatacgcccgatgtagtggttgcaacatgggaaggctatgatgatacaaaccaaagccacaccctaaacgatatttctgaacggagcattaactacctttacaagaatgaaatgagtgcgattttgccaaatactgctggaaccaaattcacggttgaagatgctcaaacacgggcaaaagaaaagacaaagggttcctctaaaggatggggatcattcctcaaagatgagggcgactttgtaaataacttcaaccaatcagtaaataactttggtaataaggcaagtcaatggtggagcaatgttcgatcgcttttctaggataatatgatacaattaatctaagaatgagataaaggagacttttacatggttgtaaatatttatgatactgcaaatgaacttagtcgccaattgcgcgaaactcaagaatatcaaggattacaaaaggcttttgaagcattaaaggctgacagtgacacctttgacactttcaagaagttccaacaagctcaagcagatgctcaacacaagcaaatgactggtcaacaaccaactgatgatgaaattaaaaacatccaaaaccttgccaaggaagtaagtggcaagaaggttgttcaagacttgatgaaccaagaacggcaagttgatagcatgcttcaacaattgaataagacaattacaagtccaattcaagatctttacagtgaagtaatgccaaagatgccaggacaagaataattaatttattacgatccaagtgaggggctgggagaaagcaaaatttttctcagctcctttattgttaagaggaaaaattatgagatttattcatacagccgatttacaccttgatagtccttttttagggttgacttcgatgcccaagccgttatggaaacgcgtccactcatcgacgtttactgcttttcaaaagattgttgacgatgcgattgccttaaaagttgattttgttttaattagcggggatatttatgaccgtgatcagcaaagcattgccgctactgattttttcattaagcaatgtgaacgacttaatcaagcccacatccccgtttatctactttatggtaaccatgattaccaaattgtccaagacacgggagagctgccagcaaatgttcatgtttttggcaatcgcgtaatgaccaccactcttactttggcaaatcatgacagtgttgctatctcaggctttagttatgatcagcgctggattcaagaagatcaagtgcaaaaatatccatcaaaaagaaacgaaacctggcacatcgggatgcttcatggagcagtccggcaaagtcaaaataaccactatgctccgtttacgaccgatgaattaatcgctaaaaattatgattattgggcacttggtcatattcacaagcaccaattcttgaatgagaagccgccaattatttacagcggtaatccgcagggacggcataaaaatgaggccggacagcacggctattatttggtggaaagtcagggcaataaacttgtgccccaatttaaaccagttgcggaaattgaatggacaagtctaactatcaatgctttatcaactagtagtcttgttgaagtggagcaatccctggcgcaagcaattgatgacaaacttaaaaacgcacctttccaactggtagagctgacgattgctaacattgaacaactttccccaacgattcggcacctgcttgcaaatggggatgtccttgaacacctgcaggatcaaaatgcagataatggtaaatggtgggtctatgatctcttgctccaccagcaaaattcgttgccatcaatgactgacctagatgaacagtattggcaacaagccgcccaagaagtatttacccctgctaatattgcagaattaacaaaaagtttagcacgggatgccgatttagcagctaagttgacaacccttgatcttaagcaattaaagcaagcagcgactcaattattgcggcgggaggattagcatatgaaaataaaggaagtccgtatcgatggctttggcaaatggcatgaccaagattttgactttacagctaacccccaaataatttatggccctaatgaagccgggaagacaactctgatggcctttcttgttagtattttatttggctttgcggatgggcggggaaagaatcggtttgcccagtatattccgaagactacttctaattatggtggaagtttattagttgagatcaacggccatgattacgtgattaaacggcaacgcgggcggaatggcggtaaggttagtgtgactgattcacaaggacgtcaaggtggtgaacaagaactaaagcaactgcttggcccaatggatcggtcgctctatcaagccctttttagttttggtcaacgagacctaacagctgtggacgagcttaatcgggatgaatggcaacaacatctgcagcaattaggggcagttggtagtgcacagtgggaccagttgatcaatcagtaccagaaacaagctgaccatctctataaaccgcgcggacggaaatggccgctcaatcaagaccttcatcaatatgcaaatttgacagataaaattaaccaagcgcgtggtaaatttcactgttatcaggacctacaagcagatttgaagacaaacaaagcaaaattacggcaagcacaggcagaattgcaaaaacaacagccacttttgcaaaaattagcacatttacagcaattgtggccggtttactatgaatggcaaagtagccaccaaactcggccgcttgctgattatttaactgatcagcaggttacgatggctcaagaactacaagtgagagaaaaggaacttcgccgccaacaacaggtttatcaacagcgcttggcaaggatcgatcatcagtctccacaagcgcctaagcattcaccacaaagtatgccggaacttcaacgacttaaggagcaggtagttgaattacaagcggaagaggctttgcagcaccgtcaacaaacgcaagctaatcagtggcaacaggaattaactgcaattaaaactcgctaccaccatcccttgccagcgccattaacctcacaggaaaaagcagaacttgcccgccttcttaatgtccaaccgctttctcgggcaaatacgaaccagtcaaatggcgatccttctcgcgccgcaatgatcggaatcatcggcggctttgtcctttttatcattggattattagcgaatgccacttttattaccgctatcggagcaattgcggcctttgcgacagtgatgtatctttattatcaacgccaaggaagtcattctgctccagtaacgacagattcccaagcaatcacggcgtttggccaaaaacatggcttacaggattttccacttgatcaatggctattaatccagggagatttacaacgaaatgccgaattagctgcccagctccaaactgccaaacaagatcagcaaagatatgaccaccaacttgctatctttaaccaacaattgccaccagctttgcaaaatctaactttggcggctgttaggaataaattggatgatttactggaacaagggcaacaagcgcgccaggatatccaagcaaatacccgagaaaaagcaacgattgctaacaatttagcccagctcaatcaagactacagtaaaattcatcagcaaaaactggcgatttatcagcaagcaggggtgaacgatgataaccagtttacccagtacttagcaaatcgttctgcagcacaatcacaagccttggcatcagatgcctatggacaacaattgaccgcagaagaccgccaagcgcttgctgcatacgcaaatagagatgagctaatgacggctttagcgaagactcggtaccagcttgatcagctcaacctaacaatctctcatacccacgaagagattcaaaaagataaagtcgaaattgatagtttagttaaagatggaaccctcagcaatctggaacaagaacgggctaacctagccgctaagatttggcatgaagtacaggaatggttaaggtaccaattggcaattcagtggattaataaggccctggtaggagcttcagctgatcgttaccctgcaatcattcgccaggcagaacaatattttgccttgttaaccgctcatcgctattcccggatccgtttaacggccgatggagtcaaagtgatacgaagggatcaagaagtttttttagtggaagaattgtcgcagggaacggctgaacaattgtatattgcgctccggcttggctttgtcaccgtgatgagtgatcaagctaacttcccggtaattattgatgatgggtttgttaattttgataacgttcggcggcaacgaatgctggccttgctagaaaaaattgctgagaagaatcaggttatctattttactgctgatgatcggattaaggaccttgacgttaaaattcttgacctgcaagcattaaaccgtgaataaattatgaagatgatataaacatttatttaggagactggcacgaaaaaataagtgtggtatattggatgagtgaagttatcgaaaaaatattttgtttaaggatgtgtttcttacatgaaatccaaaaagttaattgctatcattgcaggggccgcattgatgatgccgcttgctgcctgtggaaataaagcagtcgctactactagcggcggtaaaatcactgagagcgaatactacagcagcatgaagcaaaccagtgctggtaagcaagtgcttcaacaaatgatcttagataaggttttggagaagcaatacggtaaagaagtcagtgataagcaagttaacgcgcaatataatacctacaagaacgagtacggttcagactttaatgcttatcttcaaagtcaaaacttaactgaaaagtcattgaagcaacaaattcggtcaaacttactcttgactgcggctgctcgtcattactcccacattactaacaagcaaatcaataagcaatggaccaagtaccaacctaaagttcaaactgcgacgatccttgttggtagtaagtctgatgctgaagatatcattaaccaattaaatgactccagcaacaagtacaagactttcaagaagcttgctaagtccaagtcaactgatagtcaaaccaagaacaacggtggtaagcttccagcctttgataatactgataaccaacttgattcagcttacaagaaggctgcctttaagttgaagacgggtgaatatactacgaccccagttaagactgatgacggctaccaagtaatttacatgatcgaacacccagctaagggtaagaagagtcaacacatcaatgacttgaagaaccaaatcgttcaagaaaacatgaacaaccaaaacttcatgcggaaggttgtttcaaacgtcttgaagaagggtaacgtttcaatcaaggaaaacgatgttaagaatatccttgatgactaccttaactcaagcgccactacaagcagctccagcaataacagcagcagtactagctcaaataagtaaaatagggtataaaaataaggctacggaaaattttcgtaaccttattttttatgtgcgcccggcatgggtattagctaggcggtgagagtccgctatgggccgtagtagtcggaaccatgagctgaggacaagggtgtccactgcgaggtggaatctgaaggaagtctaaggcaaagtactgcaccgatgaacaagaagtagctataaggctggaactaactggataagactgcatgacaagttaaagtccaacactactcgaagttactttcagtaaagctaccggtgacatggtacgaaagttaatatccttacccggggagatctggcctacacgtttccgacaagaggaataagtttaatttccacagaaacaagcggtgcagtgatgtagcgttgagtaagccagaagtcagccgaggtcatagtagtctgagtaatcagatgaaggactgaacgacaataacttgtaacttatatcggaggtgtaatcaggtgcgacaatcgcagaaaacagaacaacaagctgaccgcttgtcgaggataggtttggaaaaccgaaagtacacaagggcgcgtagtaccgattatggtgaaggtaaaggtatgagtgtcactatccaagacttagtcttggaccgcaataaccttaatcaggcttatttgcgagttaagagaaataaaggggcagcaggcattgacgatatgacagtcaatgaccttctgccatatctcagagaaaataagacggaattgatcgctagtttgcgtgagggcaagtataaaccagcaccagtcaaacgggtagaaattccgaagcctaatggtggagtaagaaaactcggaataccaacagtggtggaccgaatggttcaacaagctgtggcccaaattcttacacctatctttgagcgtgttttctctgataatagttttggcttccgccctcaccgtggggctcacgacgctattgcaaaagtagtagatctttataatcaaggttatcgaagagttgtcgacttagacctaaaagcctattttgataatgttaatcatgacttgatgattaagtatcttcaacaatatattgatgacccatggacactaaggctcattcgtaagtttctaactagcggagtcttagaccatgggcttttcgctaagagtgaaaaaggaaccccacaaggagggccattgtcaccaatactggcgaatatctatctaaatgagttggataaagagttgactagacgtggtcaccactttgtgcgctatgcggatgattgtaacatttatgttaaaagtcaacgagccggagaacgagtaatgcgaagcattacccagtttcttgaaaagcgattgaaagttaaagtgaacccagataaaaccaaagtcggtagcccgctacggttaaagtttcttggcttttcgttgggtgtagaccacaatggagcctacgcccgtccagcaaaacaatcgcaacaacgagtaaagaaagcattgaggttattaactaaacgtaatcgtggaatatccctgacaagaatgtttgaagaaattcatcgaaaaatgcgtggatggcttcagtactactcaattgggaaactaactgactttattcaacgccttgacaagtggttgagggcccgaataagacagtatatctggaagcaatggaagaagcttaaaactaaggtaactaacttacagaagctggggctgtcccagcgtgatgcatatgtcttcgctagtacccgcaagggctactggcgaactgcacacagtaagaccttgagctattctctaactaatagaaaactggaacaactcggacttatgaatatgtccaagacgctccagtcaattcaatgtgattaagttgtcgaaccgccgtatacggaaccgtacgtacggtggtgtgagaggtcgataattgaactaatcaattatctcctactcgatttccacttcttaacatcacgttcaacatcgttaataaatttttgcacaccagggatggcagcttgtagttcatcgatgctgttcttcaactgtgaaacttcgctgctgagccgtttgaattcctcttgaatttcttttagccgttgcataactagtcttctttcatttgatcgatgattgattgttggatttctttgtacttttcatcgttgtagttaccagaattgtccttaaaaatcatcttaaaatcatcatcgctagtgtaccgtggaatcaagtggaagtgggaatggaagacagattgataagcgacttcaccgttattgttaaccacgttcattcccttgatagctgggttagaagccttgactgcccgtgcaatcttggggatacgggaaaatacttgggcagcaagatcagcatcgtaggcaaataaatcgggaacgtgcttcttaggaatgacgagggtgtgaccaggagttccctgtgaaatatcaaggaaggcctttacaacgtcatcttcatagactgtgtagctaggaatctcaccgttaatgattttgcagaaaatacaattattgtccatattaatcgctccttttgaagattaaacttatcctaagtataccgaaaaaatcgcgttcgtgcatgatttagtagaagaaataacctatgatataataaaaagatatgactaagcaataattaagaagggatgaataatggctttagagataaataaacttgttggtggatattcccagattcctgtgttgaaggatgtcagctttgatgtccaaccaggtgaattagttggtttgattggactaaatggtgccggaaagtcaacaacgctaaaccacgttattggcttgctgcgaccattttcaggatcgattaaaattaatggtcttactatccaggccaacccggaagagtataaaaagcagatcgcctatgttcccgaaacgccaattctttatgatgaattgactctccgtgagcatatcgatttaacgattatggcatacgagcttgatcacgatgcagcatggcagcgggcaacaaaactattaaaactttttcggcttgataataaacttgactggttccccgctaacttttctaaggggatgaagcaaaaggtaatgatctgctgtgcctttatgactaaggccaagttgctgatcattgatgaaccattctatgggctagaccccttggcagtgcatgatttgctagacctgattgagcaaaagaagaaggagggcgtcgcggttttgatgtcgacccacgtccttgatacggcgcaacggtattgtgaccgctttgtcctattggcagatgggaaagtccgggcacatggaaccctcgatgaattacgagccgctggtgatcatgccggcgaatccttggatgagatttacttgcatcttgcaaagggtgatcgtgatgaataagttatttagcaagcgtcgcagtcaacactttatgctcctgttgcgttactggcggctagtcttcaatgaccactttgttatcgccttatttttcctgttcggagctttggcatatggctattctcaatggctgccaaccttgggatcgcatgaatggtggacccggctgatcttgatcggctggtttacggtcatcgctcaaattggtcgtcttgcaacgctgatcaaaaagccggacccagtctttctcttgccgcaagttgaaggaatccatcgttaccttaaccaggcgacctggtatagtctgatcttagcggaaataatgacggtagtgggggcctttatcgccttgccgttcgctttaacaacggaaaaactcagcagtgccgagattgtgaccatctttttagtcaccattgtcaataaggctgattggatgcatgtagctcgtaaatcactgagtttgcgctggggtgatcaacagtggcggacccggctagaatactgggtaaatccgctccttgcttcaatcgcaatgtggctggtaaatccctatgtcggtcttgtcgtggcagtgatcttgtacttggcggtaattgtttattatcgtgatcttgccgttaattggcggattgccgttaaggcggaacaagatcggatgtatagtgtctaccgtttctttaacctctttactgatgtgccaagtgttcaaggaaataccaaacggcggaagtgggcagatggcttgatccgctggctaagcaaagatggtcaaccatggtcttacttatacgctcgcgcatttgtccggagtaccgaagtgagcgggattgtcagtcggttgaccctactaggaatggtgattgtcttcttactgccagcaggttggttaagtactctggtggtcgtgctctttatttacttgatcgcgacccaactgatgccactctatgaccagtatgaatcaaatgtctttactcacatctatccaatccctgctagtcagcaacaggcagactttaagcagctgttggccaaggtaacggcgcttgaggcactattgatcgcccttgctagtatcggttggcagttgaatgtcggccagatggtaattaatcttattattgcggcagtggaagtggtcttattaagccgtttctacttcaatgtcagagtcaaaaaactaatgaaatgaggattttaatttatgcgtgtgaaacataaaaagtgggctgatccattaattgctgcccatccagaactaatgattgatgatgccactcaatttaagggtaagtggcaatcacggtttgcaaaagaacaacccctccacttagaagttgggatggggaaaggtcaatttatcattggcatggcgaaggctcatccagaaatcaactttatcggattagagattcagcggactgttgcggcaattgccctcaaaaaagcacttgaggaagacttgccaaacttgcaattgatttgtggggatggagaagacttgcaagaatactttgaagatggggaagttgcgaagatgtaccttaacttctctgatccatggccgaagaaacgccatgctaagcggcgcctgacctacaagaccttcttagcaacctatcagcagatcctccaagatcaaggggtaattgaactgaagactgataacatgggtctctttgaattctccttggaaagcatgaataactatgggatgatctttgatggcgtctggttagacctgcaccacagcgaagaaaatgaacataatgttgagacggaatatgaacaaaaatttgcggcgaaaggccaaccaatctataagctaattgctaattttaagtaaaatactagtcagtaagtagacgaatgcttgctgactagtatttttttacttttttgctggggtgaggaatcgatttctttatagcaacaccaagtgaaaaagtgtatttaaaagtaatcccaccattaatgaaataataattttgtgtttatggttcgataaatatgtgctcgaatattttcgaaatataaataacaagttatgacgtacaaatatatggggggatattgaatgtcgaagaacaatgcacaagaatatgtacgcaaaatggagcaacaacggcaacgatttgggttaagaaaactcagtgttggtgttgcgtctgtgttactaggaactacttttatggtcggaggtacagtagcacacgctgatagcacacctactatggaagaagcaacaacagcaaataccgatattacgcagctggtttctacttctgttgtacaagctgataaacaaactaatgaggaacaaaacgcagccgaaaatactagtagtaattcacaaaaagaacaacaattaataaataaaacaagtgatgagagcacagatcaactgaataataaaaagaatcaagaactggtaaaggataacgagtatgaatcgattactaatttaaacaaaaataacgtcaatacacaaaatactccagttgaagaaagtaaggtttctcaatctgctaccgaacagaatgcaagaattgatttaacgtttgttgatgatgacgataacggaaagatagtagattattcagaatatttgccaagcgaagataatggtcatcattatgcatacggtaaagttggcgataaggttagtccgaaagcatacaataaataacggtacgatgatgacgtgtacccccagagttggaaatcaactctgggggtattttatatgaccaaaattagcgttaaaactaaacttaaagctgttgaagaatatgctaacggtaatgttgctttagcatcagttaggcataaatacgggattgctgaacatgatttccaaatttgggtgggaatttatgcaagatttggtaaaggaccattactcaatccacccaaagtaactggggattttcggttaaatctggtaaagtggaaacaagaaaatttggcgtcaatctcagaaacttgtattcactttggatatcgttccccaggttcagtgtatcagtgggaatgtctctataacaagcaagggccacaggctttactgagattgcgtcggggaaggaaacctaaaaatggtcaaacgacacgacaagaatcaagacaagcttcttcagctccaaaaacagaaccaaaccttacaaagagaaaacttattgttaaagatacaactcgatgcctccaaaaaattgacagccttgagaaagcatccaaaaaagaactcgcacaagtaatttatgacctcaaggctaaatacttattaaaggatttgatcgatgcacttcccatttccatgtcaacctatcagtattggcaaaatcggtttgaacatccggatgaggatgaagaagaacttaaagccgttattaaaggcctctttaactactaccaagctgaatacggcgtacgccgtttaagcactcaaattcgagactactatcgcttaattggtaaaaagacacctaatcataagcgcattcagcgcttaatgcatgaaatgggacttaaatgtatcaaatataatcggcgagtccgtaagtatgattcctctaagggaccaaatggcaagaaagctaagaataagctaaatcggcgttttatgagtaaccgtaaatatcagaaaatggtttgtgacattacagaattaaaggctcatgatgggcgaaaagtgtacttagaaattattaaggacttggcaactaaccagattcttacttggtcaatcagtcaacatccaaatcttcaattcgcattagatccactccagcaattacttaagcagttacctcatacaggataccaattaattttacatactgatcaaggctggcactatcaacatcgtgcttggcgcaaactacttcgtcagggaaacattaggcaaagcatgtcgcatcgagcaacctgtctggacaacgctgcctgtgaaacagtctttagtaaactgaaagcagaaattggtcctgataccagttatcgcaatcaagaagaattaagccaagcaattaatgaatggattcacttttacaacgaacgccgtattcagacaaaactaggcaaccaaactccacttcaatatgagcagaatctagttgcctagaaaaatatttattcaattttaaagcaagaacatacaggttccaactttaagggtacacgtcaatttttttattatttaatgtgtaaacttgacagggcacagtaccgcgcctgcttctaattttttatcatttgtgacgtcaaaaaggtaaacgccaagttaataaggatcaacttttgctaaagcgggaatatatgtcgctacctgtccttcgccaattttgctccaacattcttgaattgcgtcattaagattcatgatagttctcctttaattaaaaaagctgggaaaatttgtccccagcctttactttagttattctcaatccgttttaattctaatagactaccagtatatgcatcagcaataaactcgtaatctacttcttcgccatcttctagacgagaaacgccgccttcataagcatgggttttaaccgcaaatcgttgaaaaggtattgctttatcattgatccagctaccggttaaagaaccttcacttgcaaaatcgtttttgactaattttaagatccgatcagcagatatttggcggttaccaaaaagtttaccagcgataaaaccggcgattccagatgcacctaatgtgactggaatcagccaggggttgagggagttattgtttgcattcatatgattgcttccttcactatttaaatttaatccgttcttaacttctcatttattctatcatttttaattattaaaatccaaatatctagtccttgcaagcagagtacttacaatagataagaagcatggtataatattgctaaaatgatatagggatgaggattatgaaaagattaccacaattaaaagaagatcaattaattgaaactattggcaatggcaaggtcgtccttttctttacagctgattggtgcccagattgccgtttcattaagccagcaatgcctgagatcgaacaagacttcagtgattatactttctatgaagttgatcgcgatgaaaacatcgacctagctgctgaattaaatgtatttggaattccaagcttcattgtatatgataatggtaaagaaattggtcgatttgtcaataaagatcgtaaaactaagcaacaagttgaagattttttaaacaatttgaagtaaaataagaaggctgtgaaaataaagagactgaattattcagccttctttagttttaaattagattttcatagtcttctttttatgtaataatataaaatggtagattatattagagagaggaatatttgatgttaatttcaagttacaatcccaatgaattaggcgacattttagtcgttattaccgctccagatgcggatgaccaaattactaagattgctgatgatgtagctcagatcaccgctgaaaaagatggtgcattacttggctataactttatgaacgccagcaagatcttaccagaattaacaagtgaaaacgggcaagtatttttagatgcagcccaagttgaaaaattaaatgcaaagttacaagaagcgggctttgataagctcttaacggctgacgaagatcctaagtttgtggttggttatgttgaaaagatcactgaccatcctaagtctgaccacttaaaagtaacgcaaacgcggattgctgatgataagactgtccaaatcgtgtgcggatctcctaatgttgcggaaggtattaaagtggtagtcgctcgtcctggtgcgatgatgccagacggtaagatcatttggcctggtcaattgatgggtgtcgatagtgacggaatgctctgtggtttccgtgaactacggattaagaatgctcccgatgaaaagggcctattcattatccctgatgactggcaagaagtcggtgaaccggttgattttgctaaggccgatacgttttacccagaaaactaacaaaaaacagctgattactattgccaaaattttataatgctttattatttagtgagggatggatcatagttactgatctacccctcgcatttattttaaattgaattgttgaaaggaattggattgatggaacaaaatacatattactttgttggtattaaagggaccgggatggcctctttagcacgtatccttcatgacaaaggacaccaagtactaggttcagatattgaaaaggaaacatttacacaagcgccattattagcggcgggaattaaaattttgccatttgatccagccaatttgaaaccagggatgattgttatccaaggaaacgcttttgatgatgatcacccagagattaaacgagcacatgaattaggccttaaaattttaagctaccctgaggctgttgaaaatgaggttaagaatcatactagtattgggattgccggagcacacggtaagaccagtacgactgcattgttatcacacgtattagcagcggttgaaccaaccagctacttgatcggtgatggggtaggtaaaggaaatgcggatgcacgcttctttgtttttgaagccgatgaataccgtgatcacttccttgcctaccacccagactatgcaattatgacgaacgttgactttgatcaccctgattacttcaatgatttggcagatgtccgtgattcatttgaaacgtacggtaagcaggttcaacgggcaatttttgcttggggagatgatcctagtcttcgtaacttaaacgttgatgttccggtttactactatggaactaatccagatgatgatttccgggcagaaaatattcaacggacaccagaaggctcaacatatgatgcttacttccgcgaccaaaaactcggcacattcactatccacttatacggtgaacacagtgttcttaatagcttagcagtactagcagttgcatacatggaacacatgaacatggatgagattcaacaggaattagccaactttagtggggtaaagcgccgtttcagcgagactgacattgcggatataaccattattgatgactatgctcaccatccaagcgaaattaaagcaacaattgatgcggcacggcaaaagtatccagatcgtgaagttatcgctgtttttcaaccacacacatactcacggttggctgcttacatcgatggctttgcagaatcgcttagccgggcagataagacttttgttaccccaatctttggttcaattcgtgaaaatgctggaaatgtttctagtgctgatttggagcaacggattgacggtagtgaaggcattgacatggataccatggataaacttttgcaataccataatgcagtagttgttttcatgggtgccggtgatgttgaaaagtacgaagaaaagtacaaagaattgttaaaataattaaagatttacttgaacgaaatggtggcctctgctaccatttttataattagtcaaataaagtcaaattaaatagaaagagggagttttgatgaataacttttctcaagaaccagggcgtcgggttgtcactgacgcagctggcttgaatagtttcttgacccgaatgtatggaaacatgacgctggcagttcttgtttctgcattcagtgcttacttgaccatgggggtattccggagtgcggttttcggtttctttagtgctcaccctggaatggtttgggttatcttattgctaccgattgctttgtcaatgggggtaagctttagtgctacccggaacccagttggggcatttattatgctgatgctgacggcaataatctatggtgtcgagtttgcaattattgctggtgtttattcgggagcaagcattgcctcagctttcgtatcatccgcagccgtttttgtcacgatggctttgtatgggaccattactaaacgcgacttaagtaagtttggtgctcacgcgatggctgccttgattgctttaatgattgcttaccttatcaacatgttcttacaaagtcctgccattgcttacatcttctcctttatcgctgttattatctttactgttttaacagcttgggatgcacaaaagatgaagcaaatctacatcaactatggtggcgaagtatcaacaaatggtttagctgttctaggtgcccttcaattgtacttagactttgtaaacctctttatctcacttctccaaatttttggaatgagtgaccgaaattaattaaaagtgagtgttttgcacgttatcttgttattatattgcaaaatagtaagaggctgttgaaaaacaaaagtttttctcagcctctttactatatttaaaaactacttattaacgtttttccttttagttaaataataagaactatcagttacgagaatcaagaacgttgcgatccagatagttttcattcggaaaaagggaagcaactgagcggaaatgatcgcgccgagcgtaaaacagatcacgatcattaaataactaaaggccactgagcgttgcgagcgatcgtgatgaaaataatattcgctccaggcaaccgcagcttttttaacactgccacttgtaaagacactgttatacccaagcccctcgattttgctgaaagcggcactttgcattgcaagcccaaatgaaacagctggtaccattagataatcaggaaagctgtcaggaagaaaaccgataattgctcctactaataaaattggcaataaacaaactactcgccaataatcagtttttaaatgagcatggagaatactaaccattgctaatccaacaataaatgcgatcaatgaacctagccgatcaaccacgccaaggaaattgtggtttgcgagcgcagcgctaagaaaaatgatattaccggtttgggccgccgccattgttcgcccacatttgatatatgtaaaagcgtcgatgaaaccaccactaaaggtgagaaggagggcaaagagccgtgcttctgctggcttttgatagttaatgagtttatccatgaatttcatctcgcatctaatgtttttcattttaattataacttaaatctttggtcaagaaactaaaccattgctatattctctggtacaattactattagcgatagaagggcgggaattaaatgacaaaacaattattgttaattgacggaaatagtattgttttccgggcattttttgccatgcataaccaaatggacaagtttacaaataaggacggcttgcatacggctgcaatttatggctttaagttgatgcttgaccatgtgttgcaaaactttaaaccggatacggctttagtagcctttgatgcagggaaggtaaccttccggacgaaaatgtatgatgactataagggtggtcgaaacaagacgcctaatgaattgaccgagcaaatcccttatgtgcgtgaattgatcaaagactctgggttacatagttatgaattagctaactatgaggctgacgatattatcggtactttggctaagcaggcggatgatgctggctacaagacgttgatcgtaactggagatcgggaccttacccagttagcaagtgaaaatacaaccgttgccgttacccacaagggagttactgacacggaacactatacgccagcgcatgtcgaagaaaaattaggaattaccccacgccaaataattgatatgaaggcattgatgggtgattcttccgataattatcctggtgtaactaaaattggagaaaagacggcgatcaaacttgtgaaacagtttggttcggttgaagagctttatgaccatattgatgacctcaaaaagagtaagatgaaagaacatttgattgaggatgaagagattgctcgccaatgtaagacgttagcgacaattcttcgggatgctccgctcaagattggcctagatgatttgcaataccaaggtccacaaacggatgacttgattaagttttacaaagagatgggctttaaatctttcttgaaaaagatggatatcgatggggctggagaggaagacgaagctgagattgctccaattgactacacagttttaactaaagataacttagatgaactaggacaattaacgggtgaagtaagtttttaccttgaaatgccagcagaaaattaccacacgtcaccattcgctggttttgtgatcggcaatgaaggacactggtttacgagtcgagatgtggacctgcttaaagaggcgcctctcaaggatttactccagagtgatagtgttaagaagaatgtctttaatgccaaggcacaaatcgttggacttcatcgcctcggtattccgcttgaaaatattaattttgatctgcttttggcatcttaccttctaaatactaatgacaatagtaacgacctgggacaagtagctcaggaacacggttatgatgatgtacgaacagatgaggaagtttatggtaaaggtgctaagcgtgctgtgcctgatgatgacgagaccttctttagtcacctggctacgaaagcgcgggcaattgaacatctgcgtaaggatttttttgccaaattagatgaaaataagcaaacgccgctatataccgatattgaattaccgctaacccgggttcttgcaaaaatggaaatcgcgggtgtccatgtagatgcacaaactttgaaagatatgggtagtaaattaactgaacggctatcagaaattgaaagtcagatctatcaagaagctggcgaggaatttaacattaactccactaagcaactaggccatattctgttcgaaaaattgaaattgccagtgatcaaaaagaccaagaccggttattccactgcagttgatgtgctggaaaagttagctgataagtcaccgattgttgagcaaattttggaatatcgtcaaattgctaagcttcaatctacctatatcactggtttgctgaaagttatccattcaaatgaccagaagatccatacgcgctacttacagacattaacgcaaactggtcgcttgtcttctgttgatcctaacctgcaaaatattccagtacggttgccggaagggcgcttaatcagaaaggcatttgttcctagtcatgaaggttggcaaatcttctcttcagattattcgcaagttgaattacgggttcttgctcacatcactggtgacaagaaccttcaggaagactttaagaatggtgaagatattcatgctagtacagctcgccgaattttccatctagcccctgatgccgagattgaccgtaatatgcggcgtcgggcaaaagcagttaattttggaattgtttacgggattagtgattacggactggcacaacggattcatgttagtcgtgcagaagctcatgaatttattcaaaattatttccatgaattccccggtgtaaagaaatacatcaatgacacaattgcgtttgctaaagaaaatggttatgttgagacgattactcaccgtcgtcgttacttaccagatattcatgccaaaagttttagcaagcgatcatttgcagagcggactgcaatgaatacgccaattcaggggagcgctgctgatatcattaagattgcgatgatccggatgcaagatgagcttgagaaacgccatctaaaggcaaaaatgctcttgcagattcatgatgagttagtctttgaggctccaaaggaagaaatcccgattctatcggaattggtgccaaaagtaatggattcggccgttaagttggatgtgccacttaaagtagatagtaagtatggggatacctggtatgaccttaaaaaatagatcggaggaattaaatgcctgaattaccagaagttgaaactgttcgccacggtttgctgaagattgccgctaagcgtaaaattaacgcgatcgatgtttattatggtaaaacgattaccaatgacgttgaagattttcggcaggcgttgattggacagacgattgaaaatgttgatcggcgagggaaatatcttctttttcgttttactaatgatttgacgatgatttcacaccttcgcatggaaggaaaatattacaaccaaccgattggcggaccaattgataaacatacccatgttgtctttgaatttacggacggcacggaattatgttatcaagatacccgtaaatttggtcggatgacactggtaaaaaccggtgatgagatgaatgtcggcggattgaagacgattggccctgaaccgacggaagacgcctttacgttgccatactttacagctgaattaaaaaagagtcggggaaagattaagccattcttgcttaatcagcgtcatgtcgccggtctgggtaacatttacgttgatgaggtactatggatgacggggataaatccggagcaaccagccaatactttaacggctagccagattactgaattacggaaaaatattatcaaagaattggcgacagcgattaagtacaagggaaccactgtgcatagttttacgaatgcatttggtgatgccggcgctttccaagatcgcttaaaagcttatggtcatgcgggggatgaatgtccgcgttgtggcacgaaaatggttaaaattaaggttgctgaacgtggaacgacattttgtccacactgtcaagtattgaaggaataagaaatgacaaaaatagttggattaacaggtggaatcgcaaccggcaagacaacggtaagcactattttgcgccaggctgggattccggtgattgatgctgaccaagtagcgcggcaagtccagacaccagactcggttgggttaacacggattgtcaaagtatttggtccgaaagtacttttgccaactggggagctcaatcggcaaaccttagcaaaaattgtctttaatgataaagaagcgttgaaaaaactcaatgagattcttcagccattaatttacgatgctatctttgcgcaggttaatactttaaaaaaacagggtattccgctcgtggtgttagatgtaccattattattcgagcaacattatgatgaagattgtgattatgtggtagttgtttatactgatccacaaacgcagcttaagcggttaatggctcgtgatcattgttctaaagaggaagcgcaagcgcgaattgttgcccaaatgccattatcagataaagaagcgcgggcggattttaaaataaataataatggtgaccaggctgccctgcaaaaacgagtcgcatccctaataaatcagctaaaagcagagtaaatgtggtaaaataaagtacttatactataaaggagggggacacattgcgctgtccacattgtcacaaaaatggatcacgggttgtcgatagtcggccaagcgaagacggaagctttattcgtcgtcgtcgtgagtgcattcattgtggctttcgttttacaacctttgaacggtacgaggaaacgccactactagtaattaaaaaagatggcacgcgccaagaattcagtcgccaaaagatcctcaatgggattgtgcgctcggcagaaaaacgaccggttagtatggagcgattgaccaagattgcagataaagtggaaaaacaaatccggagtattggtgaaagcgaagtctccagtcaaattattggtaaatttgtgatgaacgaattaaaaggcgtcgatgagattgcttatattcggtttgcaagtgtttaccgccaatttaaggacgttgatgcctttatgagcgaacttgaaaccatgatgaaggcagaacataaaaaataacttaggagggctgtaaaatgactgcagcagcttttgacccgcaagccggttatgttgttacggccagcactgcatttattagttttaatgaccagacttttgcaacattttatcagccaattttaggaccagttgcgtttagctttttttatgcgttaaaagcgcgcttgctgcctaatcctacgattgctaaccggaccttgcaaagtgacctgttagcccaagtaaatgctgggggccgacaagtactggaggctcttcatcgtttagaggcagttggcttagtgcaaacttatttccagcacgatgagatcggggacgtatacgtttatgaattgcagccgacccttactccagaaaaatttttagctgataacttgctgagtattttacttttagaggaagtaggagaagatgcgtttggacgtttgactaagcaaagtaggcaatacaagcttgcttcttctaatacttcactaactaatgtgagtcacaacttttttgaagaatttcatattaactcgcagtcaattactgaaacaccacaagcgattttaacggcgcgaaaacaggcaccagtagaaaagcaaccccagttaactgcggggataagcgatgactttgattggtcaaccctcattcacttgctggctaatcagccgattgtcagtgcagaccttgaaaataatcgagacctaatattattagaacatcaattatatgggattgatgcgccaacgatgaagacattggttttgcggtcgattgatctgcaaaccaatcatttcaatccgaaaaaatttaagcaaattgttgcgtctacctataatattgtctattcttcaacgacaaaagtagcggaaaaagaagcgccggtgacaaatagaaatagtgaactgactagtaaagatcaggagttattggcgacagctaaggattactccccagtcgaatttcttcaggttcttaaaggtcaaacgggtggctacgtaacttcaggtgaacgtcatattctgacaggtttagtagcgcaagaaaaacttacccaagatgccattaatatcttaacttggtatgtgattagtgaccggggaaattctactttgacagctaattttgtcgatgcaattgccaataactggctccaacatggagtaattaatggggaacaagccattgtccaattaaagacttttaacaagcagtcgcaagaaaagaaaaaggaaacaaagacgccaaagaaaaataagtggcgcaaaacgattaaggaaccgatgccagcatggagcaagaaagacacgagtgagttgatgaaaaaggcttcctcacaagaaattgccaaactgcgtgaacggatcgctaatcgtaagaagaagtagcagctaaaggaggtggcagcatgcagtcactaaacaaaactttacaagagttaatgcgcggtcaaaatatagcaaacaatatccaacaaacgatgaagcaagtttatgcggataaagatgttcaagcattcttaaacgaaaatcgtgaccgtcttagtaaagaagcaattaaacggggacaatcaaagctttatgagttttttcatgaaaagcaattaattgaaaaaggcgtgccaactgttgcccctggatattctccgcaattggttatcagtgcaggccaaattgacgtaacctacgttccaactaaacagttattagaacgccaacgacaacgttatattcaacgactagttaactcgattaatatgcctaagttcattaaaaatgcgtcatatgatgattattatttaaatgaagatacccaaactgatacacgcacaaaggcaattcaagcagccatggactttacagataattaccaaaaagataattttcaaccaggactttacctatatggaaaattcggagtcggaaaaacatacctccttggagcaatcgctaatgaactcgctaagagtaagggagttgcaacaacgatggttcatttccctagttttgctgttgaaatgcggaattcaattaagcaaaataatactggcgaaaaattggatgctattaaacgggcgccgattttaatgcttgatgatgttggggccggtgcaatgacaacatgggtaagagatgatattttaggagtaattttagaatatcggatgcaagaagaattaccaactttctttagttctaatttttcaatggatgagttgcaaaataaccaccttgctatcaatgcgcaaggcgataatgagcccctcaaagcggctcgcattatggaaagaatcaagtacttatcacgtgagattgaaatggaaggaaagaatttgcgtgataagggataaagttcttgacattaaactttgaatttagtaagctaataaacgttgaaagaaaaagcagaagcacccgcttctcgcctaggtgatattgatcgccgggctgacgagatgaatgataatcgaccactatgataaggtcgttgttatgaagcggggtacttttgtacctcgcttttttgcttgatctttcgctaaaaaaattggaggtgcgttgccatagcacaagatatgattgtcaataacggtattcgtgcacgggaagtgcggttaatcggtcaagatggtgaacaattgggcattaagtctaagcgtgaagcgctacaattagctgaagaagctaacttagatctagtattagttgcaccaaaggcacgcccagctgttgcccgcattatggattacgggaagtaccgtttcgagatgcaaaagaaagagcgtgaagctcgtaagaagcaaaagacgataacggttaaggaaattcgccttagtccatcaattgatactaatgactttaatgttaagttaaagcgtgttcgtaagttcattgaaaagggcgataaggtacggatttcattacggttccgtggtcgtgctattacccataaggatatcggtcgtgacatgattgaacgaatggctgaagaaacttcagacatcgctactgttgttcaacgtccgaagatggaagggcggagtattttcttaactcttgctccggctgctgataaagcaaagaattaatttaagaaggtaggaattagttatgccaaagatgaagagtaaccgtgctgctgccaagcgtttcaagcgtacagctaatggtggattcaagagtggaaactcattcactagtcaccgtttccacggtaagactaagaagcaacgtcgtcaattacgtggtttgagcatgatggacaagaccaacgtaaagcgttacaagaagttattaccatttaagtaaacttcacaaaaataactatttaatatacgtaggaggatttcaacatgcgagttaaaggtggaactgttacgcgtgcacgtcgcaagcgcattatgaagttagcaaagggttaccgtggttcaaagcaccgtcttttcaagactgctaaagaccaagtaatgaagagttacacttacgctttccgtgatcgtaaggtcaacaagcgtaagttccgtgaactttggattgctcggattaacgctgctgcacgtatgaacgacattagttacagcaagttaatgcacggcttaaaggttgctaacattgatattaaccgtaagatgttagctgatttagctgttaacgatgcagatgcatttaaggcactcgttgacgaagctaagaaagctcttaactaagcctaaataatcttcggtcgcttatgatgcgtatgcatgataagcggctttttttagtgcgcccggcatgggtattagctaggtggtgaaagtccgctatgggccgtagtagtcggaaccatgagctaaggacaagggtgtccaccgtgaggtggaatctgaaggaagtctaaggcaaagtactgcatcgatgaacaagaagtagctataaggctgaaattaactggataaggctgctagacaagttgaagtccaatactactcgaagttggtctcagtaaagctaacgatgacatggtacgaaagctaatattcttacccggggagatctggcctacacgtttccgacaagaggaataagtttaatttccgcagaaacaagcggtgcagtgatgcagtgttgagtaagccagaagtcagccgaggtcatagtagtttgaataatcatatgaaggactgaacgacaataacttgtaacttatatcggaggtgtaatcaggtgcgacaatcgcagaaaacagaacaacaagctgaccgcttgtcgaggataggtttggaaaaccgaaagtacacaagggcgcgtagtaccggttatggtgaaggtaaaggcatgagtgtcacgatccaagacttagtcttggatcgcaataaccttaatcaggcttatttgcgagttaagagaaataaaaggagcagcaggcgttgacgatatgacagtcaatgaccttctgccatatctcagagaaaataagacggaactgatcgctagtttgcgtgagggcaagtataaaccagccccagtcaaacgggtagaaattccgaagcctaatggtggagtaagaagacttggaataccaacggtggtagaccgaatggttcaacaagctgtagcccaaattcttacgcctatctttgagcgtgttttctctgataatagctttggctttcgtccccaccgtggggcccatgacgctattgcaaaagtagtagatctttaaaatcaaggttatcgaagagttgtcaacttagacctaaaagcctattttgataacgttaatcatgacttgatgattaagtatcttcaacaatatattgatgacccatggacactaagactcattcgtaagtttctaactagcggagtcttagaccatgggcttttcgctaagagtgaaaaaggaaccccacaaggagggccattgtcaccactactggcgaacatctatctaaatgagttggacaaagagttgactagacgtggtcatcactttgtgcgctatgcggatgattgtaacatctatgttaaaagtcaacgagccggagaacgagtaatgcgaagcattacccagtttctagaaaagcgcttgaaagttaaattgaacccagataaaaccaaagtcggtagccctctacggttgaagtttattggcttttcgttgggtgtagaccacaatggggcctacgcccgtccagctaaacaatcgcaacaacgagtaaagaaagcgctgaagttattaactaaacgtaatcgtggaatatctctgacaagaatgtttgaagaaattcatcgaaaaatgcgtgggtggcttcagtactactcaattgggaaactaactaactttattcaacgcctcgacaagtagttgagggtccgaataaggcagtatatctggaagcaatggaaaaagtttaaaactaaggtaactaacttacagaagttggggctgtcccagcgtgatgcatatgtcttcgctagtacccgcaagggctactggcgaactgcacatagtaaggccttgagctattctctaactaatagaaaactggaacaacttggacttatgaatatgtccaagacgctccagtcaattcaatgtgattaagttgtcgaatcgccgtatacggaaccgtacgtacggtgatgtgagaggtcgataatcgaactaatcaattatctcctactcgatttagttgctttccgagtaaagcacacgatataattaaatactagaacatttaatcgggttaaccgattggaatattaaatttgatgaggtgcaactttgttagagatatttaaaccaacatggatggttaatacaatatattctgtttctcctgcccaattaaaagagcagggagtgcgagctgtttttagtgacctggataataccttgattgcttggaacaatccagatggaactccagaattaaaggaatggatggattctttacgagaagcccatattccgctaattgttatttctaataatagtaaggaacgagttgggaaagctgttaatagccttgaccttccatttgtttcgcgatcattaaagcccttaagttttgggattgatcgtgcacggaaaaaacttaatttagcaaaagatgaagtggttatggttggtgaccagttattgactgatgttgctgcggctaaccaagcgggcattcgaagcattttagtacgccccctattaaatacagataagtgggatacccgtattaaccgcttctttgaacgccgtgtttggaagagcttaaacaaaaaatatccagatttaaaatggcaggaggatttgaatgactgaacaagaacaacaaactgaagaattacgttgtataggttgtgggagtattatccaaacggaagatcctaatggcttgggttatacgcctaagtcagcccttgagaagggaaaggagacaggagaattatactgtcagcgttgtttccgcttgcggcactacaatgaaattgctccggtatcattaacggatgatgactttttgcgcctattaaatcagattcgggatgccaatgctttaattgtgtatgttgttgatgtttttgactttaatggaagtctaattccgggcttacatcgttttgttggtgataatccagtattattagttggaaataaggaagacttgttgccacgttctctacggcggcccaagttaactgactggattcgtcaacaggcaaatattgccggattgcgtccaattgatacggttcttgtttcagctaaaaagaaccatcagattgaccacttgcttgatgtgattgaaaaataccggcacaatcgagatgtttatgttgtaggtgttacaaatgttggaaaatcaacgttaataaaccaaattatcaagcaacgaacgggagtaaaagaattgatcactacttcacgcttcccaggaactactcttgataagattgaaattccgcttgatgatgggcatgttttagttgatactcctggaattatccatcaagaacaaatggcccatgtcttatcgccaaaagacttgaagattgtggcacctcaaaaagagattaaaccaaagacttaccaattaaatgatggtcaaacattatttttaggcggcgttgcgcgatttgattatcttcatggtgaacgtgcgggaatggttgcttactttgataataatttaccaattcaccgtacaaagctaagcaatgctgataatttttatgctaaacacttaggagatttgcttaccccaccgactagcgatgaaaaggatgggttcccaccattagaacgttatgagttccacattaccgaaaaaagcgatattgtctttgaaggtctaggatggattactgttcctgcgaaaacgactgttgctgcatgggttccgaaaggtgtcggggctcttgtacggcgcgcaatgatttaattagtatttgaaaggaaagacttatgcaattaagaggaaaacaaaaacgatttttacgagcacaagcaaaccatcttcaaccactattttctgtgggtaaagatggtctgacggacaattggcttgctcaattagacggcgcacttgaccgtcgagaattaattaaggttagcattttgcaaaactcagatgttacaactgatgaagttcgcgaattaattgaagaaaaaacttctattcaggtagttcaagttattggtcgggtattagttttatttaaagtttcagcaaataaggatgcccgtgaattatcatcacgagtagctgaaatctaagtaaaagtaggagtgacggttttgcaaagctgtagtgtagtagacaaggtgcaaacccaggcgcaaccggagactaaagttagtggacaccgtaagcggatcggcctctatgggggaacatttaatcctattcacaatgctcacctatttatggcggatcaggttggtcatgccctttgtcttgatcgagttgattttttaccagatgctaaacctccccatgttgatcataaagattcgcttgatccgcaattgcggttacagatgctcgaattagcagttgctgataacccctttttagggattgagtataccgagttagagcggggaggagtcagctatacttacgatactattaagtatttgttagataagcaccctaatgtggattattactttattattggtggggatatggtcgattaccttgacaagtggtatcggatcaatgatttaatccgcttaccccatttccattttgtcggtgttcaccgtcaaggagcgaagaatgagacacgatatccagtgatttgggtagatgtcccaacagttgattttagttcaaccgatattcgacaacgggtgcaacgtggccaatcaatcaagtatatggtcccagatgccgtaagcaagtttattgaggagcatcaattatatcgtgaatgaagaattagtttataataaaagttatatcccaatgacacggtctgaacttatcgaccgtctcaaaaaggcgttaaagaataaacgatttcagcatgtattacgtgttgagaaaacagcgattgagttagctgctcaatacggtgttgatattgaaaaagcaagtatcgctggcctgtgtcatgattatgctaaacagcgtcctgacgaagattttattgccgaaattaagaaaaaagggcttaatccgctgctcttagattatggtaatgcaatttggcatggagtggttggcgcagagctaattaaggatgaattagggatttgggatgaagatatcctaaatgcagttcgccaccatactactggagcgccagtaatgacgaagctcgagcaggttatttacatggctgactatattgagccgggtcgtgactttgccggcgtaaaaaaggcacgagtaattacagcagcaaaccttcaagcaggagttgcttaccaaacaaaacatacgctggcttatttgattgaaaatggaaagccggtatatccaaagacaatagatacctataatgcatgggttccgcaatatgaaggagagatagattaatggatagtaaacaattattagaaatggttgtcaaggctgccgatggtcggcgcgcagaagatatcgtcgctcttaaagttgatgaaattagtccaatggctgattatttcgttattatgacgggaggctcagaccgtcaagtacaggcgattacgaatgccattgttgaaaaagcgcatgaagaaaatgtcaaaattggtagcgttgaaggtaaaaatcatgctcaatgggtattggttgaccttggtgacgtggttgtccatgttttccgtgaagaaacccgtcaattctataaccttgaaaaattatgggccgacgcaccccttgtcaatattaacgactggattaatgattaatgatttatcaaagttttgcccagttatatgaccagctttttgatcctgaaatgtaccagaagtgggaaaagttcacaattaaaaaccttcctgctaatactaagagcattttagatttagctggcggtagtggacggttaggagtaatgctggctgctcgtggatttgatgtaacggttgctgacttttctgctgagatgctcagtattgccgatcaacatgccacggaagcaggagttagtatgaatctcttgcaagctgatatgcgggacctcagtgctttaccgcagtatgatgcgatcacttgttatgcggactctttttgttatttagacgatgcagcggccgtgcaaaagaccttcaatgaaattgctgatcatttgaaagataatggtgtctttttatttgatgtcatttctccttatcaaactgatgtcatttatccggggtatatgttcaactatgaggataaggatcatcagcgagcgttcatgtggcagtctttcaaagatgatgatgttgagcatggcgtaattcacgaattagcttttttcactcgagataatgatggacgttatgatcgtgttggagaaacccattatgaacgtgcttatgaattgcctttattaaagcagatgttatctcaagctggttttaattctgttgaagtgggatcaaatttttcgacttctatcaaagaagaaaaaccaacacgatggttctttaagtgtcataaataaggagagttcacatgaaagcagtagggatggttgttgaatataatccatttcacaatgggcatcgctaccaccttcagcaagcgaaaaaaatttccggggcagatgtaacggtagcggtaatgagtggtaattttacccagcgtggtgaaccgacaatcgttgataaatggtcgcgggctagggctgcagtgatgaatggcgtggaccttgtaattgaactaccggttttttatgctgtccaaccagcacaccggtttgccggaggagcgctgagtctcttaaatgctcttggcgttgactcgattgtctttgggagcgagcatccagaatgggattttgcccgtttggtgaaggctgaagaagcttttaaccaggaaagttttaataagtataatgcaacctatgccacccaatttaacgagcaattgaaggaacaaactggtgtcaccctgattgatcccaatgatattttagcttttgcttataccaaagctaaaatcaaccagggttatcattttgaattgctgcctatcaagcgacaagggagtaactatcacgaccagcaaatcaaaggaaagattgcgagtgcgagtgcaattcgtcaggcaatcaatgaaaagggcgattaccggcaagctgttccacaagtgatgggagatatattggcggcaataaagagtattccttcatggacagacctttatcctttattacgtaatcagcttattcaagcgcctgtttcaacccttcagtcaacttatctaatggcggaaggattagaatatcggatgaaggaagctgcccagcggagtcttgactttaattcgtttatgaaattcaccaagactaaacggtatacttatgcccacttattgcgagtttgtttatacactatcttgcagattacccaagaggaagtagctgagcatagtaaacatccttatcttcatgtcttggcctttaataagcaaggccgtgaataccttcatgaggtaaaaaaacagcttgatctaccgctgattacaaaagtcgaccaagaaatgcgggatcaattgcttaaccttgattaccgagcaggaaaactatatcagttatttacgccggctgaacaagatttaaagcacccgccgataattattaattaacgtctttgataaagtttggtaaaatattctaagtagatttggttccctaaaaggttgtcaaggaaaaaacattgacaacgtataaggggactagtataattgcacatgttgcattaggaggttagtacgttgaaatggtcgttagctgaattacatcgttaccaagatgaaccacttcatattcaaagtacttttgatctgaacgcatcattaacgaagctgtttccagatattattttagctgttcaaccagttaaagttgatggttacgttacttatgacgatggtgatgcaacgattagcgctcatgttacaacgacgttaaccgttccatctagtcgctcgttaacacccgttcaattaccgctcgattttacgttctcagagacgtatatcgatgatcgttcacactttgcccgctatgaggatgaagatgaggttgttttccttattaaaaagggtgattcaattgattttgatactgcattagcggaaaacatcgttgaacaggtaccgctacgggttctttctgccgaagaaaaatctggcaaaccaatgccaaatggaaaaggttggagtgttatctctgaagatgactacaaggcccagcagcagaaagatgacaaagttgatccacgtctcgctaagttgcaaaacctttttcctgatcaggataacaaaaaatagcggacggttaaaaaccatttgtggataattctaatttcttaggaggtgtcaaacatggctgttccagcacggaagacttcaaagactaagaagcgtatgcgtcggggtcacatcaagttaaatgtacctggccttaccccttgcccaaactgtggtgaacttcgcaagtcccacatggtatgcccaagttgtggttactacgacggcaagcaagttgttaacactaacaactaattaatataaaagctatcctttaggcgccggacctaggatagtttttttattttaaaattttctaagaatttacaagtgaaaaatgatataatctaattccttgataaatcgagatttttagtatagagaatactggggtttattaaaaaattgtgataaaattattgtgttttattaatacgtataacaagtaaaaaaagattattatagtaggtgagttattaatgagtcgaattttgattattgaggatgaggaaaatttagcaaattttgtagaacttgaattaaagcatgaaggttacgatacagatgttgaacttgatggtcgtgctggattagaagcagctttaaatcaagattttgatgtgattttgctagacttgatgctcccagagttaaatgggattgaagttgcacggcgggttcgtgaaataaaagatacaccaattattatcatgaccgctcgtgattctgttattgaccgtgtctctggtttagatcatggggcagatgattatattgttaagccatttgcgattgaagaactccttgcacgggtccgggcgttattgcggcgaatcagtattgaagatggtaataataaggaacatcaaacaacggtcaattacaaggatcttaccattgaaaaagagaaccgggttgttcgtcgcggcgatgaagtaattaaccttactaagcgggaatacgaattactgttgatcttaatggaaaatatcaatgttgttatgtcacgaaaagaccttttgagtaaggtatggggttatgattccaaggttgaaaccaatgttgttgatgtttatattcggtacttgcggaataagattgaccgtcctggtgaaaagagctacatccaaacggttcgtggtactggatatgtgattcgctcctaggaatgatcaattatgaagcaaaaagatgaaagacggtttgtttcactaaaaattaagtgggcagctggaacggcattagggtcattaatcatcttttgtatcgttgcgatggcattgtttagcgcgtttacgcaaaatttatttcatcaagaaagacaattattgaatcaagggatgactaatattagtacacaattaagtactgttgataagcccttaactaaaaagaatgttagtcaccttattgatccagacagaaaccggtcgaatattatttctggagaggaatataaacgaccggtaattaaagagttaagtgatggacacttggttattaatatttataatcctgatggaaagaatattttgagtactggtcgttatattaaaaagccgcagtttacgactaatcgcaatattcatattgctgctgggcctgatcatgatgtgttggtcgggcagatgccaatttatggtcagaataatcggcagttgattgggtacttacaagttgaaaataaccttgacgcttatatgcaaagttatcatcagttggcattagtatgtatcttggctctctgcctggttttgattgcgagtgggctattgggatactttctttccctctttctccttcgaccattggatggaattcatgacacagttaaggagattagtgcagatcctactaaagatgtccgggtaccgactaccaatcgtaacgatgaactagcagaattgataacaatgtttaatgaaatgcttgatcgaatgcagcggtatatcgaccagcagtcacaatttgtcagtgatgttagtcatgaactccgaacccctgttgcgattattcaaggacacttagagatgcttcagcgatggggcaaggatgatccaaaagtgctggatgactcaattaaggcaacattaattgaaacgcgccggatgaaaaacttggttcaagaaatgcttgatttgagccgagcagagcaagtagagattaattttcgcaaccagcatacgattgttaatgatgtggttcaccaggtctacaataactttaagatgctatatccagactttactttccgtttggacgacgatctgaaagaaccaatcatggttgatatttatcgcgatcatcttgaacaggtccttgtgattttatgtgacaatgctgtcaaatattccactgatgatcataaagagatccatattattctttcacggggaatgaatactgttgagattggtattcaagactttggtgaagggatctcaccggaaaatgtaaaacgggtctttgatcgcttctatcgagtagataaggctcgtagtcgtaagaaaggcggcaatggattaggtctttcaattgccaaacgactaattgaaggttaccatggttcgattaccctagaaagttcagtcggtgctggatcattgtttagaatcattttaccgattattgaagatccagagacaaaaaaataaatatttaagatgtgagaatagaagcaggatgagaaacttttgctcctatcctcacttttttattacaaaacatttttatttaattgttttctcaatggccgacaaaataagcgatgttttcaactaagggcggtataatgaaaacggatactaaaatatgaggatttttattgaggagttgaataggagtggctgcgaaagagcagaaaaaattaatcacaacgccaacattggtgttaatgattatttcgacaatatatgggtttggtaatgtttcaatagcctatgatcaaatggcatatgcggggatgttttggtacatccttgctggagtttgtttcttcttcccctgttgtttgatgatggctgaatatggttcggcatttaaggacgccaaagggggaatctattcctggttagctggttcgataggggaacagctggcctttatcggaacctttatttggttagcgagttgggttctgtggctagtatcaagtgcttctcgactttggataacattgtcggcactattatttggccatgatactacccaacaatggcatttttggatctttaattctaatcagttaattggtatcttggccattctttttgtcttacttgtaaccttactgagttcccagggaattaatgggattacgaaaatcagctcatttggtggagcgtttatgattggaatgaatgcaatttttattattgcaagtttagtagcgattattgctaacaagggggttactgcccagcctattcatggtattagcagttttattgagtcgcctaatcctgcttttaagacgccaattgcgattatttcattcgttgtttacgcaatctttgcatatggtggaatggaaaatctaggtggagttactgatagtatgaagaatccagcgaagacatttccaagaggcttagttattggttcgctcttaacgattggcagttatgtgctaatgattttaatgactggctttagtgttaattacaatcatgttattgcaaaatcaagcgttaacttaggtaatgttacttatgttgtctttaatcaattaggataccaactaggtgtgtcactagggttaagtcatgctactaatatttttcttggtgttctctttacgcgaatgattgcgttagctggcctgatggggatgttaggagcaatgttcctgttagtttactccccgattaagtcctttatcatgggagctaatcctgagttatggcctaaaaaaattgtgacattgaacaaacacgggatgccagcatatgcaatgtggattcaggcaatttttgtttcgtgtattattttcttagttgcatttggggttcagcagctgctagtttttaccaaatcttgacagatatggttaatgtttcaacctgtgccccgtatatcttccttgttggtgcattcccattctttcaaaagaaggatatcccacatgattttgtagtatttaagaatcatttttggacaaatgtattagttgtctttgttgagataattgtttgcctaggaatcatctttacatgcatccaaccaattattgagcatgattttcaaactgcattctggacggcatttggtccggtcttctttgggattgttgctttgattttctacaatcacgcatcaaagaagattacaaagtagataaaagaggaggctgggagaaaacttttgttttctctcagcctcaactacttttatgaataatagtaagataacgtggaactagcttcgcgtcgccacaaggctcgagtctaagtacgaacgataatcagcccgtgccgtgctaatcaccgttctatccttagcccaccgccttgtcgagaaggttattttccacttactctttattcaattttttaagtcgctggtaaatgataattccaccgatgcaagtaataacaaattcagtaaaaggaactgctgcccagaccccattaattccggcaacttttgccagaataaagattgcggggagaaggataatataaccacgaagaatcgataaagagaatgatgctcgcgctgatccaattgctgttaagaaaaggatgaacaatagatttaacgcgctgaagaatacacttgtaaagtaaatcgggaggccaacactagcataggcgaggagttgaccagaatgagaagtgttaaaaacttcaataattggatgcttaaaggtaattaggataataaagctgattgttgctagaaagagggtaatgataatcccattttttaatgtcatcgatacattcttgtatttgtatttaccaaattcccgactagcaagcggttgaacaccgagcgctactccattagcaattgctagcacaacgatggcaatgttggaaataacgccatatgcggcaacggcatagttattagctagttgcaataaaacatggttaaagaaatagatactaacaccagtacttaattcgtttaatgctgaagcaacccctaaacgtgctgagcgccaaatgtttcttaggtgagggacaacccagtgccattgtaattgtcgtccggcaaacttccgatgaaaacttaaaaccatcaagctaattgctggcgaaaataacactgccaatgctgctccttccaatttaagacccattccaaagataaagaaccagtcgatgagaataacagataatgtttcagttaaggtggcctccatggttaacgtgggattgccatcgttacgaatgaaattaatggcaatgtaattaaccatatagagaggtccgctccatgaaattattcgtaaataaatgattgccatctgacgagtggcatcatctgccccaaggaaattaactactggagttgcaaaaatgtttaataggattgctaggataagcccaaaagtaaaagcaaaaatcatcagttgactaaataatgattttattctctcaggatgcataactttatttaacgaaaagattgtggcgccaccgactcccagcaatagcccggttccattaaaaacgttgaacagggggagcaccaggttaagcgtagttaagcctaaagccccggccgcgattgaaataaaaagggtgtcaataataacatacattgacatcccgagggtggcgacaacattacgaataacataatgccgtacttctttggtaattgacattggtgaatccatattaaaacctccacaaaacttgctcccatcctcccagttggacgcctgtttgagaagcataacttaatttgttgcagaacccggcgattctactttccttatttcatttattgatattttagcaaatattctcattgcttatattataattccattacaatggtcaatttcatgttgaacaatctcagcagcaaaatctgtaagttctaatgtttgcgtttgccagctctgattgcgaaatttaacggtaatttgcttataccgtttagtaggacgcgttccgcttaatgaaaggcatccttctgcagtttgataagggtgacttttagcgacaatttgcggattgaacattacgacattaaagggcccgattcgcgcaataattgcattcttatttacaccaatcatattggcagccattccaacacattcagcttggtgagcattaagcgtatcgctaagatcggttgcaaggggcaaatcagctttagtagttagggttgcttttttagcaagtaattgttggtctttaataattggtttaatcatgtgtcttcctccgaaaaaataaagctgagaaaaaacttttgctttctcccagcttcttaataattattttttatgatgttgctgtttgccagcattacgttgacgattacggtttgcttgatcgcttggcttggcatcgcctttacgtaattggtcaattgcatcagtcggtttagttgaagaactaggggtgttaattactggtgcttctggcattttaattggattcttcttgctctcttcctcaatttggcgacgaatccgcggacggtaagcattgaccatcaaggtttgtaagatggcaaataatccaccaatgaagaagtaaagacctaatccggcagaagaagtgatagaaatgaagaaggtcatgaaaggactcatccaaatagcagccttcatttgcttcttctgggcttcaggaacactgacaagcccaagataactctgagcagcataggcaataaaagataagaccgctaagataatacttggcttaccaagtggaatcccaaagaaagttgcatggtaaaggtctggagaataacggatagcagcatataaggcggcaaaaattggcagctgaattaacaatgggagacagccgattccgccagttaagctaatgttgttatcccggtacagagccatcatttgttgactaacggcagcctgttcttcaggagtcttggctgctttttgcttttctgttagttctttaatcaatggttgaaccttggacatcttttcttgcataatggttgattttttcatttgtgagaacatcaccggtaaaagaattgttcgcacaactaccacaatgacaataattgcccaaccgtagttattgcccatgtggctggctaaccattccatcaagtgctgcattggtttagccatatagtcatagacaaacccgtatggtcgaccgctcttagtagtccgtacacatccgctaagaagcagcaggagggtaaagagccccccagcgatcgttattcgttttcgtttcatattaatgaatcaaactcccttatttctttgtatattaattacgttaatagtacgtattttactctattcaggaattgaattctaccgctaatcgcgaactaatgcgtgatttgaaatgaatgatggtagttttgcaggcttccttcgatgattttaaccttagtaattcgagcataaggagtggggccagctttaattttagagattaattgtttaacaatctcaatgggaccctgcaattcgcaataaacgctcccatcatgcttattcataacgatcccttctatttctgcttgttgtgccaactgatagacgctccagcggaatccaactccttgaacgcgtccagtaatggtaagatgataattaaccataattaaagctcctcgtattctataaataaatctttacggattttgctacattacatcttgtcttctggtcaccgcatgataacctctaattatcattggctttggtcaactggtataggttaatacctcctgtagtttgaactacttattaagtctgccgcccaggcaatcaactaattttcgaactcacatgctgtatcgattagagaatcgactaattcagagtaggattaggtgcagctttgattctctaaccaatgaacactgatacttgcgaggatgtctttagtgattgtaattaggggctatcatgcagtgatcagattaagaccagtaaattttaatgaaaggaggccattccaatgaaactatttgtcggtattgacgttagctcaaaagatcttgtaacctcgatgatttccgaaggaaaccacgaagttgttttccaaggtaacttcgttaatgatttgaaaggcgcaaccgaattaaaaaatgtaattatcaacacggcgaattcaaatcatttagaccaaattattatcggaatggaagctacttccatttatagttttcacccagcgatgttctttcaagaagattcagacttgaaaaagctgaatactcagtctgttgtcatcgatcctaagaaaactaaacgctatcatgatgttttcgctgaagacaaaaacgatcagatcgatgctttttacatcgccgattatttacgtgttggtcactactcagttggatttgtccgtcaggacaattacattgctcttcaacgcttaacacgttcacgttatgaactggttcaaagtctagttcgtgctaagcaacactttattgagaacttatactataagctcaatgaactagtgatttctgatgagctaaacacttcagtcttcggttcgacgatgatgagtcttttgactgaagatatgactaccgatgacctgctcaatatttctctttccgacttaactgcgtatttaactgaacatggacgaggtcgcttcgcgaaccctgaagccctagctaaaacaattcagaaggctgttctctcttcttatcgtttagataaagttgtcgctaattcagtggatacggtcttgtctgtttatgccgaagagattaaagcctttcaaaaaatgattaaggatctcgacaaggcaattgagaagattgttaaagtaattgatgaagaacaaattctccgctcaattcccggcatcggaccggtatacgcagctagaatcctagctgagattggtcaaatcgaacgatttgacaatgaagctaagttagctagatatgctgggctttcctgaaaagaaaagcagtcgggaaattacgctagcgataatacaccacttaagagaactggtaatgcttatctcagatactacttggttgaagctgccaaccgagttaggatccaagatccagttttcggtgaatattaccaacgaaaatataaagaagtgaaacgtactccatccaaacgagctctcgttcttaccgcacgtaaattagtcagggtgattttcttcctactcaaaaatcaccaaatctatcaagaaaagaggtaattggtatagaaagataaaatgattctcgacgcttaagttttaaaacaccttggtatcaaggcttatttaagtgcgcccaaaatctggtcaagacaagctagtcagtgataattacatcctgacttattaccacatgacttaatgaaaacttattattagttaataacaattgtacaacaggaacatggtataatttaattaacaagaaggagcatgcaaaatatatggaacaattaacatcaattcataatcagcacgttaaagattggaagaagctgcaaaccaaaaaagcacggcgtcagactggtacttacctgttagacggctggcacttagttcaagaggcatccaaagctggaatcgagctcttagaagtaatcggaacagctgaacaattagctgcccatccagagcttgaaggaatggctaatgcaacctatgaagttactgaagagatcatgaagcatattacagatacggtaacgcctcaagggattgccgcggttgttgctttaccagattctcatcatttaccagcagggccattgcatggggcatggcttttcctcgaccgggttcaagatccaggaaacgtggggacaatggtgcggacagcagatgccgctgggtttactggagtagtagttggacaacgctcagcagacttatttggtcccaaagttgttcgttcaatgcaaggaagtcaatttcaccttcaaatgtttgagggtgacttaagaaagtggattgatgattttaaatcaatcaatgctccggtgtatggaacgcaactgaatccccaagccaaaaacttccggactgttgatcctggtgatacttttgccttaattatgggcaatgaagggcaggggatgagcgacgatcttctttcacaaacaactgataatctctatattccaatgcgtggtgaagccgaatcgcttaacgtcgctatctctgcaggaattttaatgtttcagcttaatcaaaatctagattaaattaatttattttctcgttaaaatcgtgtatgataattgcaataatatagaaaaggggtattacatgaaatcaaaaaatgaatggcgcaccgataaagagtatgtttcaatcgttgccgatcttttagcccagccagctgtccaaaagctagcgaactatactcagcatcatcactctacccgcctgcaacattctattgcggtttcgtatgatagctacaaaattgctaaaaaatgcatcttgattatcgcagtactgcgcgggcaggtctcttgcatgatctcttttattatgattggcggacgactaagtttaatttaggaacccatgcatttattcatccccgagttgcattacgcaatgctgaaaagctaaccccgttaaataaaaaagaaaaggatattatccttaagcatatgtttggcgcaacgttggcagtgccacgctatccggagagtttaattgtatcgctagttgatgatttcgaagcagagcatgaattctttggcccgctacgtgcaaagatgcgtcgaaagattaagaaacgtcgaatgcaaacaacttggtagaggagaaggagagttaaattatggaacaattagtagcagaaaaggcacttgatgaagactgtaaactttgtccaaaatttacacgtacgtttatgatcttgggaaagaaatggaacggattaatcattgaagtactacttaaaaatggcaacatgcgatttaaggatattgccagtagcattgcaaagtgcagcgatcgagttttatgtgaacgattaaaagaactcgaagacgaacaaattgttattcgtaacacttacgaaggttctagtcgggtagattattctttgactgaacgtggtcaagaattgcgcccagtcatggaagctgttcatgcatggagtgacaagtggatttaaaataacgcttgacgccttacagatgattgtctagaatatgtaattgaattaaaagcgatgatgagagctagtagctagacgatcctgttagagagttgcaaccatgagctgagaattgcaatcagcgatctaaggcgaatttcactttcggagctgatacgtaatggtattccggccaatcaccgttattgattatttgagtgtgtaggatttgttcctacaaactagggtggtaccgcgaagcctcgtccctatattgggatgaggcttttttgaattaaggagtgaaaatatgggactaagagagaaattagccgaacttcgtgaagaaggattgcaagatattaaacaatcagaggatttaaagcgaattaatgaaatccgcgtcaagatgctgggaaagaagggaccgattacttcagttcttcggggcatgcgtgatcttagtgctgaagaacgtcctaaagtagggcaatttgctaacaaggtgcgggatgaattatcagctgcgattgaagaaaagcgtgctgagctagaacaggccgccatgaatgctaagttagcagcccaaacaattgatgttactcttcctggaacaccagtagcacaagggcaaccccatgttattcaacaaatcattgaccaagttgtggacttgtttgtatcaatggggtatgaagtagcagttggggatgaagttgaacaagaagtttataactttgaaaagttaaacttgccaaaggatcacccagctcgtgatatgcaagatacattttatgttacgccatctgttttgatgcggacccaaacgtcaccaatgcaagcacggatgctcgaaaaacatgattttagtcaaggcccactaaagatgatttcaccaggtaaggtttaccggcgtgatactgatgatgcaacccacagtcaccaattccaccaaattgaagggatggttgttggtaaaaatattaccatggctgatttgaagggaactcttgaggccgttgctcaaaaccttttcggtgacaagttaaaggttcgcttgcgaccaagttacttcccatttactgaaccatcagttgaggcagatattacttgtttcaactgccttggcaagggttgtgcaatttgtaaacaaactggttggattgaagttcttggtgccggaatggttcatccaaatgtgcttaagatgtcaggcgttgatccagaagaatacggcggttttgcctttggacttggaccagatcgttttgccatgctgaagtacggtgttgatgatatccgtaacttctaccaaaatgatgtccgcttccttaaccaatttgaccagaaaggataatgtgaaatgaaagtatcatatcaatggcttcaagaataccttgatttagatgttgcccctcaagatttagctgaaaagattgctcgtacctctgtggacattaatgacgtttactcactgagcgacggattaaaaaagattgttgttggggaagtagtaaaatgtgaaaatcaccctgactcagaccatctccatgtttgtcaagttgatgttggcgaagaagaaccgattcaaattgtttgtggtgccccgaacgtccaagaaggtaaaaaggtaatcgttgcccttcacggtgcgcgaattgctgataaccaaaagattaagcgtggcaagatccgcggtgttgagtcaaatggaatgctttgtgctcttcaagaaattggctttagcgacaagattgcgcctaaagattacgaagatggtatctacttcttaccagatgatgctaaaaatggtgatcctgtatttaagtacttaggaatggacgatacgatcatcgatacagacgtaactcctaaccgtggagatatgcttagtatttatggaaatgttaatgatatcgctgccttttatggattaaagccacattttaaagaaattacgattaaagaagaaggcactgaaaagacagcggaccttctccaagcagaaattaatgatactaagattgcaccaacttataaattacgggtaattaaaggtgttaaaattgccgaaagtccactatggcttcaaattcgcctctggaacagtggtattcgtcctgtaaataatgtcgtggatgtgactaactatatccttcttaaatatggtcagccactccacagttatgattatgatcaattatctggtaacaactttggggttcgtcatgctaatgaaggtgaaaagtttgttacattagatggggatgaacaaaccttaaaagcaaatgatattgttgtaactgtcgatgaccaaccagttgctcttgcgggaacaatgggtggagaaggaactgcagtaagtgatgatacgacaactgttgcccttgaagcagccatttttgatccagtaatggtccggaagcaagcacggcgcttagatcttcatagtgaatcttcaatgcggtttgaacgtggaatcaatccagcaacagttgaaacggcattgaatgaagcagctgaaatgattaaggaacttgctgggggaacgattactgctggaattgttactggtagtgaagcgccagcagttgatacgccaatcaaactatcccttgcgaagattaatcatgtcctgggcacttcattaaccatggaacaagttactgatatttttgatcgcttggcatttgcttacactgttgatgatgacgatcaattaacagtgattgctccagcacggcggtgggatattagcctggcagctgatctttatgaagaaattgcacggatttatggttatgataacttaccgtctactttaccaacgatgacgcgtaaccggggaggacttacgccacgtcaacggtttattcgggcaagtcgtcatgatctcgaaggaatgggcttaactcaagcaattagttattccttaacaactgttgagaaggctaagcagttccaaattaagccacttgctgaaccgatgaaactcgacttcccaatgagttctgaccatgtagctacccggatgaatattgttagtggcttgcttaatgatattgcttataacgtggcgcgaaatgttgataacgtagcattatatgaagaaggccgaatattcctgccaatgggggatgaacgtccagtagaacaagaacaccttgcagctgcggttactggccaaatggtagctaatagttggaataagaaggatcaaccggttgatttcttccaattaaaggggatcgttgaacgttaccttaagaatatggggattgctgggaagattacttatgttccaactagtgatcgtccagaaatgcacccaggacgaacagctgatattatggttgatgaccaattagtcggcttcatcggtcaagttcatccacaaactgctaaggaatataagattccagaaacatatgtatttgaattaaatctagaattattactggctgcaccaaagattgaaaatgaatatacacctattagtaagtatccttcaatcactcgcgatattgctctcttggttgatgatgatgttgaaaatgcaacaattgtagaggcaattaagcaaaagggtggtgcttaccttaaggacattcacctatttgatgtttatgctggttctcaccttcctgctggcaagaagtcattagcttacaccttaacttatcaagatgataaaggaacgttaactgaagaccaagtaaacacggcctttgataaggttactgcttacttgcaagataaggttgatgcagaaattcgttaaaaattaaaaggctggattttttcggcctttttttagtgcaaataattattttttacgtatttatattatagggctaatcactaaactaataattagtggttgaagcgctgaaaattttctgctattttattaatagtttgataataaaataatgatatttaatataaagagggataaacgaaataatgaaatcaacaacaaagaaaattcttgcatcgtcgttaggggtagctggcgcaatggcaatgggcacggtaactgcaaaggctgatacgaccgttacggtcaatgctggcgatagtttgaatgggattgctcaaaagtataatgttagtgcggatgatattgcaaccgctaatcacttgcaaaataaagagttgatttttgtgggacaaaagttgacaattccaaccaaagataaaaatgaaacacctgctaataatgctgagaaaaaggatcaagccagcaagaacagtcaaagtctacaagattctgttaacaaggcaatgtcttatttaggaaccccttatgtatggggtggtaataaaccaggtggatttgattgttctgggttggtccaatattgttacggtattccacaacggacgacgtatgaacaacaagctttaggaccacatattcacgataatgttttaaacgcgccatatggggcccttgttttctacggttctgatgatgcgccatatcacgttgccatttcacttggagatggtcggattattcaagcaccaaatgaaaatgaaacagttaaaattactgaccaacaatacttccctggaaattactatgttgtgatgcattaatattccctttcacctcacctttaataatttaaattagtaattatcttgcgcatcacaaaagagtgctatatactatttcagattagaaagttttatgagggagacaaattgatgagtattcaacagaataagcgtccagtagttattggtgttacaggtggttccggtagtggaaagacaacggtaagtaataaaatctatgaccaattgcatgggcaagcgatccagattattaaccaagatacttactataatgatcagtcagatatgacaatggatgaacgtaaagcagtaaattatgatcatccacttgcatttgataccgattttttaattaagcaactaacggatttgcgaagtaataaggctattgagatgccggtatatgactatgcacaatatacacgttcagccaaaaccgttcatgtagaaccaaccgatgttattattttggaaggaatcttaattcttgatgatgagcgtttacgtgatttaatggatattaaggtttacgttgatacagatgatgacattcggattattcgccggattcaacgtgatatggtagagcgtggacggtctcttaattcaattattacgcaatatttagctacggttaagccaatgtaccatcaatttgttgaaccaactaaacgctacgctgacattattgtgccagaaggtggcgaaaatcaagttgcaattgacctattgtcgacaaagatccgtgatattttggtaaaacgtggacatacggaattacaataggtgtttacaagctgaagtagaaatggtaatgttgcactggataaattatgaggagtgtttataatggctgaagaaaaaacttttccaatgacccttgaagggaagaaaaagcttgaagatgaacttgaagaatatcgcttgaagcgtcgaccagaagttattaagcggataaagattgctcgtagttatggtgatttatctgaaaactcagaatatgaatcagcaaaagacgaacaagcaatggttgaaagccgaattgctcaaattgaaaacatgcttcaatatgctgaaattatcgataatgaagatgtcgataaggatgaagtatctatgggtcggacaattactattcaagaattgccagatgaagaaccagaagaataccaaattgtcggtgaatcagaatctgatccatttaacggtaagatttctaatgaatctccaatggcaaaaggattacttggtcacaaagttggcgaagtagttgaagttgaagttcctaatgggacaatcaagctaaagattgtcaaggttgattaattaaaataagaaaagcgaggtcgaggaatgtggtgaattcctcaatctcgcttttcttattggtattatttttctactatgctatagtaagatgtatgaaagcgatatcactgaacgttggagggaagaaaaatgaaattgattattactgatgctgcaagtcaatggtttcgtgacgaaatgggattagaatcaggaaatggaataaagttttacggtaaaacctatggtcaaaccgaagtccatcatggtttttcacaaggattcactcgtgaagatacaccagttgatccaattttagaggttaaaaaggatggtattaactatcacattgattcgctagatgagtggttctttaaggatcttataactactgttgactatgatccgcaagccgacggaccggtttttcattttcaacatgaagatggtgatacacctgacgtagctggatttgttaatgacgctgatgaccattccgataataaggctgacgcctctactggagcatctcagcattaattttttatatagtgaaaaagctctttagcataaactattctaatgatagtatgctaaagagctttattgttaatcaaacattgtccttatttgatgttctttcttaacccaccaaccagttaaaccgagacttataactgtaattataagcccgagaatgagaaacggtggccgataataaaattcaacccgatgctttccgggactcattggaatagccataaacgtattaagcacggtttgtggagtagtagacttaccatctactttaacgtgccaacccttggcagcagggatagtagtcattaatactcgctgatttcgctggagattgactgtaccaacgatccgattactacggtatgaactaatctttaagggagattcttggagagtctttaagcttgccataaatggccgttgctttagttgatagatactaacgttttgcatccaaagtgtagctttctttagttgcaaattgacaaggactttttgccccttttgatcatgagcaacgttgattactaccgtattacgaaaggtgtcatattgggtgaattttttgttattcatcgtaattgtggcattatcctcaacgtttggtccgagcgttaagtagtaagaatcgttggttggcggaataaattctagctgaactgatgctggtttaagcaggttttgctttctaaagatcgtgccagtaatttgcttagcactttgaacattattgaatttgacggaattaaagttttgaacggcaaataatgaatgaagtgttggacgaccggcaagcgtttggaaaatctgtgactgatagtttaacggatccattgttgtccgttgaaggtgaaggatggcggtattagctccaaatgcgatcggaagagcatgtggattctcacggagattgactgccgaagttgatcctactaatgggtaactgtaccaatcaggacggaaacctgataggggtaatgcctgtccggctgacgtgttccgagcattcatagtgtatttgtaaccaagaagcgcatcactcacttgagttccattagtatacgtaacaaaaccatccccatctggctgcccaattgcacccatgaaggctggaattggcggctctaaggtcgaaccaaaatggtcaccagaattaaagtctgcttggaagggatcatcctttgttcgcataaaagttttggcaacgcggtagaaactcggatcatgcttctttagtttttttacacttttatcaagagcaatagtgtagttgccaaattcaggctgtgaaacgtaagagatcttattaagcgccgtgtacccactcatagaaatatcacagacagcaaggagaacaagaagcgcgtcgtataagcgcggtgaatttgttcggggaatacaaaggcaactaacagcgatcagcgaaaagcataagccgatattccgttgattgctattaatatacgataagttaagcgtaccaacataccagtaaattgcgataataagcaacgtcaggataagtgcactgcgcttttttattttgaaatcaggttgaagcactttagctgcaagatagatgcaccagaaagagaaaaggtaggaaaaacgataagggtaccaaactggaaactggccggcatgccataaaagatctaatggttcgtaacagaatgagaaaataaagaaaatagaaatggctgccccaatcaaacgacgacgaaggtcaaagtgattattgaagaagtagagacaagcaccgagcattaatagcattccgatataaatgttaggctgaccacttggcatttgattaaaattaaatgatccggggacaagtttcccaagcattttaggagcaaagtactcaaaacggctgtgaatcttggtttcagtgtagatccctttactttgcattaaggcatagaaagttggcaataaaatgactgctgaaatacccaccgcaagcagcgaactgccgagatagcggagaaaaattactccccgttgtcgccatgaggctaacgctggtgtttgccagaggaaaaatagaaaagtaaagatggcaatcatccagcccatataataattatcaatcagcattacggctagccaagcgatataagttccaacacggttttgataaataagtttgaggagtccccaaataattaacggcaaaagtattaaagcatcttgccaaatcatatttaattggttggcaatcatccagccattcattgagtagactgtactgaatgctaaaattcgccacccctgttgtagatccgttttttgcattagccaagcaaaactcaatcccgctagaccgtatcgaacgagtgtaacgatggttatcccagttgcaaggtgttgagcagggaagaataacaaaattaagtttaatggacttagcaagtaatacgcattagttccaaacatttcgccaccaagtcctttgctaaacgaataaaagaaactgctgggatggtggagaatagtatttcgaaggtaactgaaaaaatcgacatattgttgaccgagatcaacggttaataagctgcttttgccaaagggagtcatttgacggtatgcaaaatagcaagccatcaaaataactggtaataggaaacttgcaatcaaaattttgcgtcgatataaacgatgatgttgatataaaaacacagcaaaattctccttctctcaattaaatagacacatccacattatcatatccttttttaaaatgatattcattactattgttcattaaatttcattaaatcattggaataaattcttcatttcttataaataaagagtattattttcacgttagtagtggtaactatctgttaaagcaggtaattttgttaaaatagattcactacgatgaaggagaattataaaactgtgaaattctttgatcgaataatgaacttgtttggttcacgtgccaaaaagcgtcaaaatgcgcagtcaattattccattccggctgaacatgctattatggattgttggtatcttgttattagcgttaactattcgactgttttatcttcaagttctgcaaggaacatcatttaaagcggaagtaaagcgatcagatacaacaacgcagacgaataatgtacaacgggggatggtttatgattcacaagggaatgttcttgttggtaatcaaactcatcaagccattacctatactaaaggggctaatgtaactactgatcagctctatcagattgctaatcgtttaggaaaatatgtgtctgtttctaataaaaattcgcgcttaactgatcgaaatgaagaggattattaccttgctgataaagagcggcttaagagtgttttgaaacatgtcaagacttcagatgccgattctgaagatactaaatataataaagctctcgaatatttgagcaagcatcctgattcatgggaacttacagatcagcaaaagaataatgcccgaatttatgcggcaatgagtggagcatattccctttcgacaacttatattaaagaaacgggtgttagtgctaaagagcttgcagcagttggagaacacttgaatgaaatgccaggggtaaagattggaacgtcttggactcgtaattacccccaaggtacagatattcaatcgttaacaggaactgtctcaactactggtttaccaagtgatgaagttaactcattgcttgctcaaggatattctcgaaatgatagcgttggacaaagttatctggaaaaacagttccaatcaactttagctggttcgaagtcacaaactgaagttactactaacggaaatgatgtaactaaagaaaagactaagtaccctggtaagaagggtgataaccttgtattaacgattaattcaaaattccaaaagcaagttcaatcgattttgaaaaacaattactcagctgccggaaaccagtattctactggggtatatgcagtagtaatgaatccaaataccggtgcaatttatgcgatggcaggaattgaccgtgacccagcaacaggtaaagaaacccctgatgaaattggtgctatcaaccacccaattacgatgggttcagttgtaaagccggcgatggtcatgggggcattaatggatggtgtaattacgccaacaaataataccttaaccgatatgccaattaagcttgccggaacttcatctaagggatcatggtttaaccatggtggatcagcaaatatggcaattaatgcagcaacggcgctcgaagtttcttccaactcttatatgatgcaactactcatgaaagaagcaggaatgaaatatacaccaaatgcgcaaattacgatgaagccaagtatttttgctaaagcgcgggttacttcaacatgtttggactaggggttaaaactggaatcgacttgcctggtgaaacaagcggttatacaggacctgctgaccaaaagcatatcggttcagcacttgacttgtcatatggtaactatgatggttatactttgattcaacttgcccaatatatgtctactattgctaacggtggtaaccggatgcgcccatacattgttaaagaaatccgtggtacgaaagccaatggtcaacttggtgccgttgaatatacaacaaagccccaagttcaattaaccattcctgcttctaaagctgactttgatgtcgttaaacaagggctttatcaagtggttcatggttctaaccgttatgttactggtaaagcgttggcatctgttaaaccatcagtatctggtaagacagggactgccgaaacctactacaagtcgcactcaacaactacgctaagttttgctggatttgcgccatctgataatccacaagttgtagttgctttggctattccaggagcttcaaattccgatggtggtgccaacctgacaatggcaaaacaaatttttgaagcctactggaagactgttcagagtcccaagggtttcggtgactaattaaactgtcaaggaaatttccttaacaaactttgataaattactagccaaatagaagaataaatgatatagttgtacgagttagggttacgataaataaccacgttaaataaaagaaatagtttggaggtcaaaataatgcgtgtcaacattacacttgaatgtacttcatgccacgaacggacttacttaactagcaagaaccgtcgtcacaacccagatcgtcttgaattaaacaagtactgtccacgggaacaaaaggttacattacatcgggaaactaagtaatgaccatataaaggagctgggagaccggctctttttatttatttttataaaaaaacgcttgcataaattcactcaagcggtgataataaaatctgataccgtttgttacttcactataaaggagcggtcataacataatggcttattcaaagaaagagttacgacaagcatatattgcgcgccttcaacaattagatttaaacacccgtctttacgaagagcgaaagttagcatctttgctatatgatcaacctgaatggacaggggctaaaacaattgctgttactttaagtcaatcttttgaaattgatactgaacctattatccttcatgcgcgtcataagggccaacagattgttgttccacggacgttgccccatcgtcaaatggaatttgttgaattaaatgaggataccgatttcgacgagacgtcttttggtattttagagccacatgatggcaaagtttattctccagatgagattgatttgatggttgttcctggagtagcctttaccgcatctggtaacaggttgggctttggcggcggttattatgatcgttacctaaaaaactataagggccctaaagtttcaatggcattgacaacgcaactggctgaagaaaacgaatgggaaccagaagaattcgatcagcgaatagataaagtgttgtatttaccggggatatagaagatgcggacacagggactaagattggcgcccgtgacgcttaccttaataatttttcaggtattagtttattgctggttagtttatgcaggtggctcaactaatacagtaaccttcctgaatatgggtgctcgtagtacgcccttaatcagggaaggtgaatggtggcgtttagtatcacctgtgttccttcatgttggtttatcacacttagtagtcaatagcgttacgcttttatatattggccgttacattgaagagttttttggtcattggcgaatggtaattatatactttgtcagcgcgttttttggtaatcttaccagcgcggtcttcatgccatcgacagtttcagctggtgctagtactgctatttttggattatttggcgcatttttaatgttgggtgtttgctttcaccataatgttattgttcgcgtcttaagtcgtacttttttgtgttatttattattattaatattgtgatggattttttcctgtcaggagttgacttggtaggacacattggcggcctatttggtggctttttcattgtatttattgttggtgctcccatgttaggaactgttgattacctgaaacggttgttaagtggagctgtattaacggtaagtttggtaattttgactctagaattgaagtgataatttatggcaatcgcctcaagaaactaccgcacactatacgatgttcagcaactattaaaagaattcaacgtgtttgtatatgtgggtaaacgactgtatgatattgagttaatggctattgagctcgataacctctatcaatcaggagttgtagataactcaacttatacaaaagcaaagattgtcttgcgtaaagaacatcgtgaagaacaaacgagaattaaaaggggtaaattgtattaaaccttacccaggaaaggaatcattatggctaagaaattaattggtgttgaccttggtggtactactatcaagtttgcaattttaacggagaacggtgagattcaacaaaagtggtctttgcggactaacattttagatgatggttcacacattgtgccagacatcattaactcaattaatcaccaccttgatttatataaaatgtctcgagaccaatttattggaatcggaatgggaactcccggaacaattgaccgtgaaaagggaaccgttattggtgcctacaacttaaactggaagacaactcaaaatgttaaagaagagattgaacaaggcactgggatgcaatttgctcttgataacgatgctaacgttgctgcacttggtgaacgttggaagggcgctggtaatgaaggtgacgatgttgcatttattactttaggtaccggtgttggtggtggacttatctccaatggtaagcttatccacggtgtcgttggtgctggtggtgaagttggtcacatgattgttaagccagatggatacctttgtacttgtggaaaccatggatgtcttgaacaatacgcatccgctactggaattgttcatatcgctcaagataaggcggaagaatatgaaggtaacagtcgtttgaaggcaatgattgataacggtgacgaaattacagccaagattgtttttgaccttgctaaggaaaatgattatcttgctaatactgttgttgatgaagtttgcttctacctcggtttagcaactgccaacttaagtaacgcattgaaccctgaataccttgttatcggtggtggagtttccgcagctggtgaattccttttgaagcgggtaaagcaaaactttgaaaaatttgccttcccaacagttcggacttcaactcaattgaagttggctgaattaggtaatgatgctggtgttatcggtgctgcttcattagctcgtcagtttgtaaacgcagattaatttgtaaggggaaatgatcgtggtacttggagttagctctggcttgatgattcttaatgcagtcattataatcatcttgttagtatggatttttagctgggcatttcagacttaccgtcgaaagagatatgcaactgtccttagtcaagatgactttaagcaaggaatgcgaaaagcacaggttattgacttgcgacaagaaaatgactttaaacaaggtcacattcttggtgcacgtaacttgccttatccatatcttcgtcaacaatatggcgaattgcggaaggacttgccggtttacttatatgatgaaggaatgacattaagtacccaggccgctgcatttttaggtaagcatgagtataaccacctttatatcttaaaagatggttatcgtgcgtgggacggtaaaactaagaagtccaagtattaaaaaagtatcttgtatgctttttatcaggatggttgaggattctaaacaatcatttgctaacgtttggaatttagcctcttgtaaaatttaaccaataaaagaggctggaagaaaacaaagttttcttccagcctcaactgctttcacgaacaatagcaagataatatgaaactagcttcgcgtcgctacatggcttcttgttttgaatcttaaataaaattaaagttggtgtgctgagcggcccttacggatagcagctcgacggttttgatcaaacttttcttcttcttcttccgctggtttaatgacagttttatggaaagtaagaaccccgctagcaatggcagcaactgttgctaaactaccaactaaaataccttttgctaattgtttcataacataaaacctcctcgaatttataggttacctccattatgcaagaattaatggcgttttaccagtgagaaggacaggttttagcataaaatttataaaaattggagagttaagatgaataaagtaatcgcaattgtcggtccaaccgctgtaggaaaaactgcactatcaataaaactggcacatgaatttgatggggaagtaatttctggtgattcgatgcaagtttatcgccgccttgatattggaacggcaaaagttactcccgaagaaatgggggatgtgccgcaccacctcattgatatctgcaatattgaagagcgtttttctgcagcccgttttaagaaacttgctgaccaaaaaatagacgaaatagctcaacgtaatcatttaccgattattgcaggcggaactggattttatcttcaaaccttaacagataatctagcattgggaagtgaccagtttgatcaacaaacgctcgacattcgtaaccattggaaagaggttgctgaagaaaagggagccgagtacgtttgggagcaattaaacgacttggatccagtagctagtactcggatccccaagtctaatactcgccgggttatccgggctttagaggtaattaagaaaacgggtcaattattttccaaccaaccccagttcaaagcaacaaatgattttctcttaattggcctgactactgaacgccctgttttatatgaccggatcaataagcgagttgatttgatgattcaaaacggcttgttagaagaagcaaaatggttatttgatcaaggaggggaagatctgccggcaggtaaggggattgggtaccatgaattatttccttattttcatggcgagattagtcttgacgaagcgattgaaaaaattaagcaggattctcgccattatgccaaacgacagttaacgtggtttagaaataaggctgatactcactggtttgatattttgcgtcatcccgatgatattaatcaaattaagcagtttataaatgattggttaaaaaaataaagtacggaaggaaagatttttttattaaaataaagctcttaaatagaattgacttatgccctgtctattgttattctaagtcacagtgttaaggagagaagcagatgttagatagattggtatggtcatctattatttctgtggagattgtatgaaagggaatgaaattttatgggtaaacacgtatttacaaaagatgaagttcgccaaatggtaaaggatgaagatattcatttcttacgagttatgtttactgacttattaggaacgattaagagcgttgacttaccagttagtcagttagataaattgatggataacaaaattatgtttgatggttcttcaattgatggatttgttcggattgaagaaagtgacatgtatctttacccagatatgtccacttggcttgcattcccttggggtgctgaacacgggaaggttgcgcgggtaatctgcagtgtttacaagactgatggtactccatttgaaggtgacccccgtaacaatttaaagcgggttcttgaagatatgcggaagatgggcttcaaagactttaacattggacctgagccagagttcttcctcttcaagactgatgaaaagggtaacccaactaccaatcttaacgataaggaaaattactttgacatggaaccagcagatcctggtgaagattgccgtcgtgacatcgtcttagctcttgaaaagatgggctttgatgttgaagctgctcaccatgaagttgctcctggtcagcatgaagttgacttcaagtactcagatgctttagaagccgctgataacatccaaacatttaagttcgttgttaaaacaattgctaagaagtatggtttccatgccacctttatgcctaagccgctttctggtattaatggttcaggaatgcacctcaacatgtcattgtttagtcaagatggcactaacgccttctttgatgaaaatgataaagataagctttccgcaactgcttaccatttcttgggcggtttgatgaagcatgcacgaagctacactgcaatttgcaacccaatcgtcaactcttataagcgattggttccaggttatgaagcaccggtttatgttgcttggtcaacttctaatcggtcaccacttgtgcgaattccgagtgatcgtggaatgggaacacgacttgagttacggtcagcagatccatcagctaacccatatcttgcaatcgctgctgttcttgaagctggtttagatggtttacgcaacaacttaccaccaattcataacgttgatgaaaacatctatacgatgacgaaagcagaacgagctgaaaaagatattcatgatttaccagatactttacacaacgcattaaagtctttggctaacgatgaggttatcaagagttcaatgggtgaacacctctataacagctttatggaagccaagactcgtgaatatgcttcatatcgtcaacacgtttctgactgggaacggcaacactatatggaacaatactaattaatgacaataagttaataagcaatgaaaaaacacttatgcaggattacttgctaagtgtttttcatgcgaaatcaactagttaattgacaaatatgttgtttcatatacaattatatttgttgcaataaaagcgtgttattataatgtggatagtacgtttttaaggactgctagttaaactagcaaccaattttaaatcggaattatatttcgattagttactaaaggagagtcttagataatggatcaaaaggtcagagttcgatatgcacctagcccaacaggtttcttacatatcggaaatgctcaatcagcattatttaattatttatttgcacgtcacttcgatggaacgatggtattacggattgaagataccgataccaagcggaacgttgaagatggtgaagctagccaacgtgaaaatcttcactggttaggaattgactgggatgaaggtccaaataagccaaatccaaagtatgccccttaccgtcaaagtgaacggaataaagaaggtatttaccacaaatacattcaagaattattagacaagggcattgcatacaaggattactcaacagaggaagaattagctgaaatgcgtgaacggcaaaaggctaacaatgaacctcctcattatgatggtcgttggtatggcaagagtgaagaagaacaaaaggctgctgaagcaaagggattgaagccaactattcgtttccacttccctaaagaccatgattacgaatgggacgatattgcacgtggtcatgtttcatttaactctgacaaccttggtggtgatttcatcattgaaaagagtgatggaatgccaacatataactttgccgtagtagttgatgaccacaccatggacattacccatgttttgcgtggcgctgatcacatttcaaatacgccaaagcaaattgctatttatgaagcattaggctgggatcacccaactttctgccacattccattgatctttaatccaaagactcgtaagaagttaagtaagcgtgataaagatacccttcaattcattagtgaatacaagaagcacggttaccttcacgaagcaatctttaactttattgcattcctaggttggtctccagttggcgaacgtgaaatctactctaaagaagagttgattaaggtgtacgatccaaaacggatgtcaaaggcaccagcatacttcgatcaaaagaaacttgattggatgaatgctcaatacattaagagtatgtcgatcgataaattaactgatcggacaatggaattaattaaggaaggcgaaactgaagaagctaagcgccttcaaagtattccagaagatcaattgactgaattgcttaagaagacaattaaagttcaccaacgggatattaataagcttcttgaagttattcaatatgcatggtcatactacacggttcttgaccaatcattcaactatgatttgcttaaggacaacgaagacttcgctaatgaagatgttttagctgttcttaagggcttaaaggctaaacttgaaaacggtggcgatgaccttgattacagtcaagctattaaggaagtgggtaaggacactggtattaagggtcgtggtttatacttcccattaaaccttgcctttactggttcaacttctgcaccacaaatctatgaaattatggatatttattcacgtgatacagatattgaattgcttgaccggatgatcaaagcatttgaaaactaattttataaagttaagcataggacaacagctaatcgatgttgttctatgctttttattttaaactgtcatataattaaaatatgtagttagtaaaaaggggatcttaagtaaaatagttgaaatgagtgaacatatgcggaagatcttaaatgatgttccaacgttaaaagtatttgatttttcccaatacgtttcaaaaatttcaggaattattaagtttacaattggtgaacctgattttgacacaccagaatatgttaaaagggccggaattgagagcattgaaaacaatcgaactcactatgctccccaacgtggaacagtgggattgcgtcaagcgattgccgatacgttggctaataaatatggccttcagtacgatcctgcaacagagattcttgttacaaaaggagtaacagaagggatttctgttgcaattactgcaattactaatccgggagatataattttagttcctaaatttcaagaataagttagccactggactcaaataaataatactgaccaattgattattggttgatggagctgtgatatctcttggtagaaggccttacgatagatatccattgacgaatgtccattaaacatagctcgtggatagtgattcatccaatcattagtcgctatgatctgagcactactatagttatttatagcttcacctttggtaatctccttgcggagaaaccggttattgatctcattggatccacgttcccaaggggaatacggatcagcatagaaaacatgatcgtgaacttgtgttaactcactaaattctgaaccgttgtcagaggttattgtcttaaagatgcgatagtaagcatctgtgcccattttctggcgtaaatttataaagaactgatttactgcatgcgcagttttaccagcaattttactcgtgatattaactcgtgaaaggcgatcagtcattactagtacaacactgtcattaccgtttttctgtccctgaactgtatctagttcccaatggccaatttcggaccgttggtccgcagtttgaggtcgttgagcaatattaggacctaagcaccttttagcttgcggatgagttcgatgatgcttacgtttaggcttttcaaagaggtctaaattggacgtacgaagcacaccctcattaatccattgatataaagttacaaccgactttgggatcagggtgccatcattcattaaatctcgagccttataaataaccgcttgtggggagtaatggtggtcgtcaaactcaccaagcattagctgatcagctaatcgtaaaaattgctttgaagaataatataagcgacgacgaccagaatggcggtgatgttcaagatatgtggcctgaccagcttcataactatagatgtagtaagaatattcgtaaatcttaccattagatttttgacgacgaagttggcggaccgtaccacggttgagctcgttattaattgtttgatgattaactcctaattggcgaccaattgcgcgattggaaagtccttgcgactttaaagtcgcaatcatcacacgttcttctttagtaagatgagcattctttttatgagtagtcaataaactagtagacatggtatcatttaagtgcgtcatttgacggacatcctttcatataggtttggttcacttaatatgatacctgatgtcacgccgaatggcgttttttatttaccaccaactgggtggctaacttcattctataatccaccatataattttagttccaacgcctactttctcaatctacacgcctgatgtaatgattgctggagggacgccagtagaagtagatacatccaagactgggtttaaactaacgcctgctcttcttaaacagtatctagataaatatgatgatcgagtaaaaggaggtattttcgttaacccttctaacccgactggaattgcctatactcaagcagaaatgaattagcagccttaattaagggtaagccaatctttgcaatctgtgatgaaatttatagtgaattaaactatgacggtgaatactcaagcatggctaagatcattccagaccagacaattttggctaatgatttttcgaagtcctatgcaatgatcgggtggcggattggatacctttgcgcaccagctaaagtaaccgatctgctgttcaaggttcatgcatttgctgtgacggatatcgcaacatttgtccaggatgctgcagaagccgctttaaaggctggggacgaggcaacaaaggaaatggacgcctaatatattaaacggcgtgactatatgtataagcggcttacagagatgggctttgaatgtagtcaaccaatgggcgcattttatatttttgccaagattccaccattccttgatcaggatgacaataagctaatttatcaacttgctaatgaggccaaagttgccgtaacggctggatcaaactttggtaaaggtggggaaggatatcttcgctttagttatgctacaagtattgagcagattaaaaagggaatggatcgtcttgcggaattttgtgaaaaagaacaaaataatgcttaaaagaaaagagacagcggtgttaacacatctctgtctctttaatatataagtgaattgcttcaaaagagttattcgctcagtttcttggcgtcagcatcaatctttgcaaaaccagaaccatctggcttcttgctgccacgcttttccatagctttacgagccatttccttacgttcttgcttactaagtgccataataacttcgcctctttttctgaaacgcttcaacaataacagttattaacaaaagtaaaataactgttactaatattatagttcagtctataaaaaatgcaattatgaacatgatcgcttaaataaatggggggcatggagagggcaaactgaaattgttttttctgattttcttgataaaataaaaataaaaaataaaaataatccagatatcctaattaattacaagtattaaaaaaagaaaagagttgctacatatgaatttagacacagcaatatttgcaggcgggtgcttttggtgcatggttgaataaatatatcgagaatggcgctatattagtaataacacgttgttaaacaccttattttaattccatgggaaacttatgggaaaattttatttatctaaagaagagatattcttgtgaataacaataatttataaaagaaaaagcgccaacaaaagtcagcgctaagattactacttgagtaaccatttaattagatgtttaatgtgcttactaggcacaatgagaatcagtacacaccaatgcaagggagtcacctccaaacttgcgcttagtaaagattgattaagtcttcggtgcgcttaaccattgtatcacaatttatttatgttataatatatacatgagaattagtacaccggtgtgcaaaatggtttcagttgattacttaaaccgaaccggttggggcgcttaataggcgctcttttttatttacatttaaaattttaaaaatatgtgaggtaattaatgatgaaaagtaaagtgttaaaagaaaatggtgaaaaagttaatgcaaaacattatcaatataaaatttttttgagtaataaaagtgaacctattgaatataattcaactgaagcagtatattcatatgaagaagtttttgaaaaaatttgtgaaaaatatgcaattaagctttctgaaggaaacattgaaaaaattgaaatgtcattagttgattaatatgtgttgagatttaataatacaaaatttaatgaaaataagcagcaagctttcaatttaaattggaagatacttgttgcttatttttattcagatagggcacaagaaagcaataaatgatatgacaaaaaatcttatgaagtaacaaaagaattaagtagttagcataacctatttactttagaattgcatagagatatagctataataaagtttgttttgataaacgagagtgtgatatagtgagcttgataagttctaaggattatgaacatatcctaagaataaatgactttaattaactacttaactaaaagtagaaaggaaaacttgatcggcgcacttttttattgtttaagtggaattaaatttttattaggtgagaataagatgaatagtaataataaagcaataacctcagtttcggagtttataactgaaatagaacgtcattattcagacggtaaagaatatttctttagaggagaatcgaaagattatggaacaattattccaaatttatatcgtgaattaaataagcttatcgatgattcaactaactactataagcgcttatctattgaacttggaatacaaaatacagataatatctcagttattgatcaaatggcgactcttcaacattatggcgcaaaaagtagacttttagatattacaagcaatgcattaattgctttattttttgcagtagaaaataccgatgaaaaagaagacggcattgtacatgtatttaatggcaaagttttttttgattcaggacatacaattgctaccaaaacagcagctaattttatggatatttctttaataaataatttttataaatattgccacaccttcttaaacagtcgtaaatttcctaaaaacgtaagagaagctattatacaatgctcaacctatggtaacggtttggaatatgagttaaataatgtagaaccttatcccattcataatagtgcaaatgttatagctgagttaaggcatatgacaacttctgagatgatgaaagaaatgccgagttttgacttgattgattttatggaaaaattgaatcaaatcgcaaaaactagagaaaggttaaataaaccattagcaatattttttgatatgcatttacctcagatttatttaagtacgtttagtaatgacagaataaaacgtcaacaaggagcatttataactccatcaatactaagtggtcaaaaaagagataactcaaaaaaacttcaaaagtatatttattcgagcttctataaagcagaaaacaatttaataaaagaatatgtggagttaaagaaaagactagttaacaaaccactagttcataacaagcttcccaaaatagtgttaaaaaataaaagaatgaaattagacacattagtaaagtctaaaaaggagttttctcatcaaaaagagaaaagattaataaagttaaaacaaataatgcataaatttgataattatagattatctggtagtgatttaaaacttaaagaagactttaaatataattgttttcagttgatgtttgacgtgaattatgctggttatcgccagtccataacgtactctgtaaaaaagttgaaactgggttcgataataatagatgggagtagtaaatttcaaataaaaaggacattaaatagtcttggaattaatgaagggacagtatatccagatcttaagcatatttcagattcaataattgaaaatcaacattattaagataatgaaccaattttaattattgaatgcatagccggtttttcatgtggaaaatttactgtatttatatcaaaataagattacataatatacagttttactaataaatggtagtattatgaactcataagaaatgaattaagcagcaagccctctacacggaaggaaacttgctgcttattttttattcaaatggggcacgtttagttggcatctcttttccagtaaagggatcatacatagcccatttatcccaataatctactaattcttggcggaatactttctgagcttctgaaatagaaatatggtcaatccgggagattcgttttacataaggtttccattcttctggaatttgaatactgtctaatgaagcttcttcaagaatatagcctttgaaatcttctttatatcctaaatgatcaaacaagagtttacccattacatttgcatcgtgaataatcttttgggccgtttcttctgtatagacgagcgaatattcaaggggggcttcgttaataagatccgcagatttacagaaatatttattagtatgagggttcttcattcggtataaaatagtcataaaaatagctccttttaaacgtatgttcgatattaatatagcatagttagtcatttttatcaaacatacgttctgagcaatggattaagaaaatgtatattaaagcttacttaacttatcagccaaagactcttccatttctttagtaacgtgtaaataaatttcttctgtaattttactattttcatgtcctacgtgattttttataacgtataagggaactccaagttctgctaattttgaaacatgagtatggcgaaaaaaatgtgtagtaacacttttatcaatttttgctcctgcttctaatcgatggagaaaacgatctaaatgtgatgcatcaaatggacgattacttcgtgaatctttattaataaaaatcaagtcatttggatctttattgaggctaagttctttataaatattgacagccttttgtggtaatagtacttctcgattactagcaattgtttttgcaccgtcagttttcttgactgaaactttaactgtagggttacttacagtccctaatagttctcgttggtgtgaaagggagccatcaataattgctttatacttaccttcttctttaattatgtcttttacataaagtccggccgcctctccacaacgcataccagtcaaataaagccactctaggaaaagcttgatatcattacgatcttttttctcacaagcatgaaggattgcgtgatactcatcgtcagtcaaatatttattttcaatacgatcacgttttcttttaatttcgcttcgccatgttatttcaacatctttgaccggattctttttaagatatccatatttaacgccaaatttatatgtcattgataagtatttcttgtaattttggattgaagcattggttaaaggcttatctggatcataaagcttttgatctaaatagcgattaagtatttctgtagttattttattagcaagggtatcgttacctaagtcattacaaatccgtttaagccctcgaaaggcattatagtaagtgttaaccgcaactctttgtttatagatagttaaaaatttgtcagcaaggtttcgaagtgaaatatctttatctgtgaagtattccttttgcttagctttttcaattttttttgccagctcgatggctgctgctcttttagtttgattattatttttaagataactaacagagacttttttatactttcctgttaatggacttttatagttttcgccaaaacgatatctaactttgccacgtacggtatatttttcaacccacatttttatctcctttagtttatattgtgcaaaacatacgttcttttagagtgctaaataaaaacgccagtagaagaaatagctaattctctatattttttgcgcatcgcaaataatgtaaaattagtagctctatcaacgctttctgtcattgaaataggaattcgaaaggcttcaattaattgctgcttagtctcaaaagtgatgtcgtgtgtacggcaataatctaaaagcaacataattgcaattagatcaccatcgccttcggctttttcattaacactgcaataattacaactaagactaacttcatcaccagataaaatgtgtccaatttcatgagctagtgttagtggtcgttcgcaagctggaaaccagttaggattgtaccaaacgcatcgcaattcaatttgcgattgtggtacccagtcacttggccattggctttcagtaaggacagtaatgttatgttccttagctacaccttttaaccactcaataagatcttccatcttgttcatcaacgtcaccttttttctcatcaattttatttatattcagttagtctatgtattgtaattattatttttgcttattttgtttgttattcattgccttttgtgattctaaaaaggacttaattgaattgcgcataaatgctttttgctcatcgctaatttgaagtccttcgtaagaacgtaatccattaaaataatgatcaatatcttcggaagtaatatcaccatttccgttattagtattttgtacttcttctgggtgccggcgctccttcttatcacttacccccattaaccatccttcatccacatttaatactttagctagctcatataatttatcttgcttagcttcatattttcctttgaggtagtcggatattagttgacggtttataccagttcttctgccaagttcggattgggaaatttttgcatcatctaatgctatttttaacctatgctgaaagctgtcaactttcctaatcataattgtttcaactccttaaagctaattttaacattaaaatacaaaatataacatattgagtaaagaaaaattgacagaaaatgattgtaattgcaacactgtcatgttaaacttgcttttgtaaagctaacatgacaaaaagaggatgatttatttgatttttaattatgataaactgaaggatcgaatgcaacaactgagatataatcaggtatctcttgcaaaagctacaaacattgagcgagtaacattaaatcgaaaaattaataataggattatgtttaagcaagacgagattctttcaattgcgaatgcattagatatagggtcagacgagataggtgtatatttttttacccttattgtcaagaaaagatgacaggatatttaagaataataaggaatttgttaattcgggagaggaggtaattctgatgatggcaaacggttggaagagtagggaacaaattatgaaagattatggctatagtgaaggaacttttggtgatcgaatgcgtgaatgtcttgaatctccatacagcagcgccgttgttagcgacacctctaagtatgcaattattattgaaccgctttatcagaagttccttatgtggcgatcagaaaaaatccgtaatgagaagtcggaaaaatcgggtcgtttaactagaggtaagtatgattaaaaatataaaggattaatcataaattggcagaacttggaaaatttatgagggtactcaaaaattgaacaaaggtgataaatgggtgtggaagaatattctaaacaactttcgttacctagatgaccttaaacggatagaggtaaaaggaactacttggaaaccccatagtacttctccttgaatgtttaaggcaataacctttgcacaatggttgaaagagtatttaagcgagttttcaatgaatggaaatggataacagtaaaagaaagtggggtaggtactatgcctaaaattataaagattaaacataaagcggttaaaaatagccaaattcaaattcctgactatgtatttgatgagggactaactctagacgcaattggactgtatatttatttactaagtcgcaaacaaaaagaggttagccttgaggatattaataataaatcgagggattcacaagagcataatttagaaatactgagtgaattggaacaacatcatttaattgctaaaaaacttaatagcaaggctaactttatttggaaattacttccggtaaagcaggtgtagttttatgccgaaaattaagcatcgaagacgtcaagggtattcaactgtaagcaatactccatatgatgaccgccgtctgcagctcgaatcaatgggtgtttttcaattgctatggcacttacctgacgattggtcatttaatgagattgatattgttcaacgttcagcttctggtagaacgaagctccggaaagcgttagacgaacttgaaagatttggttacttaaaacgaagtcgattgcgtaacgaaaaggggcaattaacagctggtgattgggtattagatgatttagggacacttggtgataattcagttttggcaaaaaagaagagaatggaaagaaaaaagccaaggaagcatcaagtaaaattttactcatgggttcaaaagcctatgttctgttttgtgacattggcttatttctcgccaaaaacctatgtcacgttttcaaacataggtgtattttatcgaaaacctatgtcacgttttccaatgttggataacgtcctactactaattactcatagcactaattactcagtaagtagtaagtatgctgctagcaaagcagcacaaactgatgaacagattcttgcaaagaatcgttcagaacattcactagacgatccaaaaggtatttcacaagcatataatctctggaatgatatctggggtaaaccttcagcgttcgtcgaaaagcaaattagccagtgggttaatgaatttggaattgacgttgtcgcccatgcctttaactatgccaaatggaaagtggagcaagcatcagcagcaggctcctacctagcaaaggtatttgacaattatcggcaaaacaacgttcaaacagcttctcaagcagcagaagctgatgcaatgaatttacatcgttcaaagctctcgcaaagagctaagcaaagcgattctactactacgcctagcaaaggcaaatcatctcgcaaagatgatcttaaaaatttaataaaaagcgaaccagaagctatctgttaccgagcagcatgtttagcaaaaatcaatttaagcggagcagaccagcaggctcttaatgagtttgtcaggcatttaggccctaagctagtcctaaatgcgattgaggttgctaaacaagaaacaaggtaccagtacccttcgtggggctttctcagatcgattttaagacgatatgaggctcagggaattaagacggttgaagacgttaagagcggtgatcgaaatatgcctagcaaaggtaattcaaagcaatataagcgtcataagccgattaaagagccaatgccagaatggagtcgaaaaccgcaagaagagctttacaaaaaggcagacccggaagcaatacgtaagcttaaagaacggattgctaatcgcaataagcggcgaaaggaagtttctggttaagcaagttggggaggattaacgatatggggacgaagaaacaagcgcaaattattactcgactagctcacttaatcacaaaaagaagtgaacggctaagtaatcaagaaagtctgtcagctagcgtcagcattaagcttacacaagaaattaagacttactgttttttgattcgcgtatttcaggaaaattaattcgagggagattttgaaaatgaatggggataaattgattgacaatattttgacgatattcatgcttttagggatttgctgcattctagatgcaatattctttgccatcatcctctttgcgcctttaagaaggtaagcgacgatgaaacatttgaattgggctgcaattttattgattggctgggcgttttactttcagatttttttgattgtggcgattaaacggctaattgaatttctgagcgttaacacagttttatcggttttgggagcattgctgctcagcactattttaggtggcaccctgatgttattgattattcaaaacgaaagtggggaatagagaaaatacaatgaaaactgtgcttatttggacttcataggaggtgagtttgcagtgaaagtaacagtgggtcatcacttacttgaagcgtacccagttgaaaattatgtttatgaagtatcatattgcggtagaaaagagttttaccaagatgctttggacgctgctcattcaacgctttacacaaaagatagttcatataatgcaacaattactaaaattccagttaggcctattagtgaaaagagaattgagaagagactgctacatcaaaagtggagtcttgatgactgggatccatcagcggttaaagaattcaaacaatcaaaactttatctttttagactgtatcttagaaaaataggtcttattccattattgattatgttatatgttgcaatttagattgtcttagcaatttttaagtaaagattggtcgaggaggtaacaaaatggggaaagattattcattaagctcagaattatgtcttagtaattggactgcagaaactcttgatagttctgtaaagcactggatgaaaaacagaaatcagctgtcaagtgcaagcgcttatgtaattagcgatgaagattgtaattttctgaagattgattttgaagatccagtaaaacaagctgatgttctaaaaattaatcggggctctcttggtttggcaacagtatttaagactattcaatctgctaatgctgtcataagttttctagaggctgtaggtgttaaaaaaataaaaaatttgcaagtacgaaagctgcaaggtttattgtattaggattgcgaaatgagggtgagtatatggaatttaaagaacaagaacggaactcgcttgaattagttagccaaattttaaaagatagtccattcgatggctgggtaatcgtagcacaatctccggaggaacaagatatgatttcaatcacttctggtggtaggggaatttcacatggtgcgttagtgaatggactttatgattcagcaaaccgttttgcacaattaaattttaagagtgaaattactaagactgattttattttgacaatggcagaagcgatgggagtctcgacggctaatttaaaatcagctattgagaaaaaaccacaaaatatttagggggcttgttacaaatgcaagaaagtaatgcttcacaagcggggtatcaaattgaaaactcgaataatggttttacccaaataacaaatactgaaagtcaggctgtttttgttcctagtgaactgtcagagagctataaagctttatctcctgaggaacggcaatggtggcttggaattgaacgaaaggttgataataaccggcgtgactatattatccgctttggcacaattctaaaggaaattaaagacaaaactagccgccaaggaaaccgtgataaagacaagattacatttgagcggtggattaaagctcatcatgtttcaaaggggaatgcctataacgctattaacattgcgcaagcatattatcgaattaaggcacagaatgatccggatgaagagctaatgcttgataattatctaagccttcctaagatggcccaattagcaatcgcaaccggaaaggctgatccggaacaggaaaaatatttattacatgcaactgtagaagctcgtaattcgcgaatttggcaggaaatggctaagtcgattagcaagaaaaatgagctcgctaaaagtcaatcaaacaaaattcaaaaacttaattctgaaaatcagcgtttagctaatcgtttagcagacgttgaaaactctcgggctgaaattatgaatgagctgaatgatttacgagaaggaaaaagacacttagaaatgcaactggaggagcaaaaaaacaaggagccggaattagttgaggttgcacctgatgattatgacgaattaaaggctgataaagaagaagctgaaagcttgcttgctgatcgggaagaaaaactcaaaaaagttaaagcggagttaaaagctgctcaagaatcaggacaacaggttgatgatcttgctaaacaagttaatgacttaattcaaaaaaataatgctttgcgaacacagattaagcaacaggaatcagtagaaagtaaacatgacaaagcttttaagcgtgtttcatcattttcatctgaaatgttagcaaatttagtaaaagattttgacctgatgcaagttttacctgaaaccaaattcttaagtcagaaggatttagcccagactgatttagtaaaactagcagaaatgtttgaaagtaagggatcagaaattcgtgaaaaactattagccactcataatagtaaacaagtaattgacggggactttaaggaggcttgagggggagaatgaagaaatgatgtacgtgaaaggaagatttgttaacgcaaatgggcttgaaagaagaccctggtattttgcggtttcctcgaataaattacgggattttaagttggccatgcaactttacaagaaaaaatcagtactagtaatggttagtgatcgacggaaatatgtaaggatagctcaagtggagcctaaaatcatcaaaacacttcctaatagtggaaaatgtgtaggtaatttaattgctatcttaaaagcaagtaacgggcgaccaatcgaattatttaagttagtgcagagttttccagacgacttaaaaaatattacggttgctgaaattgcagctcttcatttgccaagtctaaatcgtaaacttgaccctaatgttcaccaccttcctaaatgaggctagaagcaatgatttatcgtagacgattaacccgagcagaactacgccaacgagctaatcataagatgattagtggatcttggaatgacgaggaagaaaatgagcccgaaacacaactaaaaaacataaaaaatactggtcgatggataacacctattttaggaacctttgtgttgaccttatttatttttttgcttttttggaatttgtatcacttttttcagtgactaaggggacaaaatttatgagttataaggaaaaatcaaatcatgattaggaaaaaattgccaccaaaacggtcgatatatcgacgggagttaaggaaaaaagcattacctaaaaatattctgtataccatgttgttggcatttttaatcttgattctattggtattcttactgctatttgcagcaatgattaagattattttgacttgaacggaggaaattgaagttatgaaagaaattaaattgcggaaatataatcaaggcctaaatcaattgctttattcaactaggttagaaggagaaaacgaactgcgatttaacttttctccttttgatgagggaagttcatggattgcaaatggctcactttccaaaattatgatgtacacgggagttaatgatcaaaacgggaagaaaatttatgaaggcgatattgttcaaataattcatgatcaaaaacctgttataaagcaaactgtcagatttaggtggattgtagaatgaagttagccacccagttggtggtaaataaaaaacgccattcggcgtgacattaggtatcatattaagtgaaccaaacctatatgaaaggatgtccgtcaaatgacgcacttaaatgataccatgtctactagtttattgactactcataaaaagaatgctcatcttactaaagaagaacgtgtgatgattgcgactttaaagtcgcaaggactttccaatcgcgcaattggtcgccaattaggagttaatcatcaaacaattaataacgagctcaaccgtggtacggtccgccaacttcgtcgtcaaaaatctaatggtaagatttacgaatattcttactacatctatagttatgaagctggtcaggccacatatcttgaacatcaccgccattctggtcgtcgtcgcttatattattcttcaaagcaatttttacgattagctgatcagctaatgcttggtgagtttgacgaccaccattactccccacaagcggtcatttataaggctcgagatttaatgaatgatggcaccctgatcccaaagtcggttgtaactttatatcaatggattaatgagggtgtgcttcgtacgtccaatttagatctctttgaaaaacctaaacgtaagcatcatcgaactcatccgcaagctaaaaggtgcttagggcctaatattgctcaacgacctcaaactgcggaccaacggtccgaaattggccattgggaactagatacagttcagggacagaaaaacggtaatgacagtgttgtactagtaatgactgatcgcctttcacgagttaatatcacgagtaaaattgctggtaaaactgcgcatgcagtaaatcagttctttataaatttacgccagaaaatgggcacagatgcttactatcgcatctttaagacaataacctctgacaacggttcagaatttagtgagttaacacaagttcacgatcatgttttctatgctgatccgtattccccttgggaacgtggatccaatgagatcaataaccggtttctccgcaaggagattaccaaaggtgaagctataaataactatagtagtgctcagatcatagcgactaatgattggatgaatcactatccacgagctatgtttaatggacattcgtcaatggatatctatcgtaaggccttctaccaagagatatcacagctccatcaaccaataatcaattggtcagtattatttatttgagtccagtggctaacttattcttgaaatttaggaactgtcagatttaatcacggcaaatttattccagtatgcgattacaggtcgacggaattaagaatcgttggtaatgtttttagcttaaaaaatgatggtgaaccataggtaaagaaggtgaacaaaaattgaaatacaaattaaaatttcaatttgatgattataaaggctacgctgtaatcactttacccaaagaagaaagccttgaggaattaaagcatgatttagctttaggcaaatatcttttgaatgcggaagaaagcactttagagttttcaacatttcaaaaatataacgaaaagcgataccacttagtcctttataaaaataaagatacacgcttaacaattgaaggttcctttaatagtactcatgacttgggaatgaatttagttaaagctgaattattgcaattgaaagaacaaaaacctgtgatgcaggctcaacaacttagctttctgtaagtgatttgatgctaagtaatagattaagtggggtaaatttttaatgaatagatatgatccagaattattgcatcgtcgtagagtgattacttttagtgtattaacggtagccgtcatattgcttataacgggctttctctacggaattggagtgcttcatcgaagtagtacaaaaacgcaacaagcagctcttaaaagcaatgagccggtggtagtaatgtactactctaaaacgtgtccagattgtaaaaaagtagcgattgatgttcataaaaatgcttgggaagtaacagcaactcaagccacgattggtaagttgatgccatcaccatatcgccataagaatttatatttacaatggcaaaataatgaagataaaaggctatttaagcaaaacaatgttaattcagtaccaacatttatggtttatcgcaatggaaaaccacaaccgattgctaatgcgaatggaattgatatttatcaatactcaggtactaataagcaggtaattgctaacatctaccattacttacaaataaataaaccgacagaaaaacagcaggggggtaaccaatgaataaaagaaaatggcgaaaaaagatccaattttggattgataagtatggaaaaagatttgctaaatttaagacttggtatgatgaccacgcgatgcaacgtaaattaattattagtggcacgctctttttaacaatgatagggctgcttgttggcacacgagttgcaccaagcaaatcgcgatttgccgatactccattaaatacagcagagagttttggtaatgatagtaatgccacaatagcactaacttctcgtaaatataatgctaagcaacaattcctggttgcgcgctttaaggtggcaccacaatctggtcaatatatcgatcctaaaaatattaaatttaaggttcgtacattaacaaaacaagatgcttcttatcaagttattccgcttgttaataataactttgtagtagttattgataacttaccgaaaggatacaaagcaattcagctagaagctattaataaacaaggagacagttcgcaaattacttatgatgcttcttctagtattgatccagaatctttaagttctagtgatagcgaactttcatcatcaagcagtgggaatggccagactggagcaggcaaaaacagttacaaatttgtcattaatgaagataaaaaatttgttgataatcgtttaactagacaaacccaaaaagaatatgcggttcaatcattacaagaatcaatcaagttaatgaacagagaaattcgaaaagaaaaaggagctttgactacctatcagaaacaattagctgcagatcaagcagcaatttctcaagcaaagaataatcaacaatatcaagtcgataaagatagtaattctgataatattcagcaagctcaagcagatattgcgactcaaaagcagaatattaagaacgtaaataaggtaattaaacaaagtaaattacaaattaagctttatcaaaaacaaattgatgatactcaatcaggtaagtataagttcccagcaaaggttgcaactaagaagatggaataaggaaaaaagaattaaataaattcaaaaagccagtcgatcaaaggctggctttagttataactaataaacatttcatttttagtttaagaaggttgaaggaatgaaagaatgttaatttttttatggataagcggatttaataggaaactggtaatatatctttttatttttttgagcactttaatatttatatataacctaatggaattattctttataagttttcgcaaaaataaatatttagaatggagtgaaatacaaaaactaactaatttgaagatagttttagtccttaatatgttatttatcattggcctatgaatctggtaagaggaaaggtggtatggatcagttgccgttacgaatgagttctgttagaaaatataaaatttaagtcagactggaataattataatacactatcttttgtcttgatgtaggtttggaaaaaggtattgatacaatgcaaaactagaaattatagcagatattagattgaaatagtcactacttagaactaaaagcaatgaagttataattgaaatgattgaaagaattttggcgatagtaattgctactttaaagcattgtccttcattagaaaatattgaacagagaagtaaataaataatacatgaaaaaatgctcgatcctaaaagtaatacgatggttactacaatccaatatataaaggtcattttattatgggaaaaaccaactactatagaagaaaaagcagaatgctttagaggatgagagaagatttgcataaaaagtggagaaaaaattttgagtagatatatggatagaattattccaagaattagtattagataattaaatttagtctttttcacgggcttagtctctctttattaatttattttggcgaaactttgaaaagtatcagcaataaatatactacaaatgatgatgctttttgtagatttacgtgatgcaaaagcgcatttttctgagtgtcaaatagtcggcagacgagagaattggggtaacacaagaaaaccccgccactggcgggtacctggcttgccaggtatcgttttcccttatgctcattaattagactagcacttaaattttactgtttaagaattaggttggcactcaaaagaaaggacatgattttatgaagaaaatagatggcgaaacacttcaacattttagattagataataatcaagttggcaaggtgcaaaaggaggtaaagaaatataacatgaccaaagcagaattttatcgcatggtggtcagtgattatttcaaaaatgaaactgttgcgaatttaactccagaatatatagatacgttgaagcaattaattgaaattctgaacgtaattggtgaacggcaaaaacgtattgaacgatcagttaattattgtgaagatcatttacggatcttttttgatgaatacgatggtgaggaggaaaactaacatgacaagaactactttaagaatgacaaaatccactgaaagtaaaattaattattttgaagctaaacttgaaaatgatcctgccttaattaaaaatattccatcctcaaataatggcctgattaatatgctattaaatgattatcttactttaataattaatgcttggaataaaagtcctcgaaaaagatacgaaactatttatcaagaatttttatcgacgcatgacacaaaactaaataatttaattaagcatgaacaaaaacaaatgaatcgaattaatgaaattctatatttgttaatggcaactaatcaagcagtcgtccgagttgataaagatgactggaaaaacatgcaatcaatgtttgaatttgggacaaaagaaaatgaaatttatgctaagttatcacagatggtagaaacagataacaaaaaattatttcaaaagggtaaataagttaatcctatttcgggggtaatagaatgactaaaatggtgaatataaaaaacaataaggatttctacgacaagttacatgagctagaggatttggatccagattggtttatccatgttggccaagagagtcgtttaaatacctatattgatgatggggatttaaatactgcagtaaaagatgttattaaggaacgaaatttattaaaagaagttcgagataagttgcaaacagatccgcaactatggagaagtgcagctaaaaaagatgcaattagattattggtaacttactataaaagattcgatttaagtaataaagaaatttcgcaaatattaaatattcccgaaagcacaattcgtcacgactatcagccattgaaaccaggagaaaaaatacatcctaagtttgaagttgaacttcgtgatcgtttcggaaaacatttaagtccaagtgaaatttagttgaagaacttgtcaaaatgtttcataattgaattagaaataattagaatgtgagatttaatatgaattatattgaacgggctgagaagctaatacttttaattacgtttaaaaagcatgatcaacagatagcaataccgcaagagtttttccaagaagaaagtgatgatatcaaattatctattgatgatcatcggattttgattactggtaatataaaattgcgtggtttactccagcaatataaaaaaattcttcgttatattctagacaataatgaaaaaacaaccttttttacgtatggtcttggcatccaaggcgttttagaaaatacgttagaaataaataatccggtaaatatcggaagtgtattaaatgtttttccagcaataacagataaattttcagataatgagacaacgtcaattggtaattttgatatatctttcacgtcagaattaaatggggacgaattagtagtatcgattagatcagaaagaaataaaatttcgcttttttcagctatatcgcatgatactaagaaaggaaaagatagtaacgacatgaatgagctttataaaaaagcgttaaactcgtttaaaaatctagttaaccaggaggaagttgattatgattgctaatacagttaacacgattaaaaatcacgatcacgaaatggtttctgttttttatgtacaatcaaatcaaaccaggaaaaattattttcaagatattgttactgaaactttctatgatataaaatttatatataataatgcaaattcgtcgttaatggatgcaagtaattttaagttgcttgcaaaaaatatgagcgagtattttagccctggcttaattgtgaatgtagaatttgggaaaccagttacctatttagagttaaaaaactctagaatatctgaagagaaactttttgacgaattttggaattttcgtgagaatgtttggtttgatttgccaaaagacttaactaaaaatcgtcatttagctatgggatagtatttatgtttgattggaaagaatatttaaatgttgcgaaagaacttgctaaaaattcagatgaatgtagtcaaagaattgctattagtcgtgcctattatgcagcatttaattatacgaaacatagaagaatatatgggacagaattccgtggccctaattcacatgatgatatgtggagagaagccttcagagatgagtcagaagaaagatattttcaaaatgccatgacactaaaagatttccgagtggatgcggattatcatgctagtagtcataaaattgcaaaagagtgtgaaaaaagtataaaacttgcggaagaaataatagattacgtcgacaaagcttgatgatatgaaggactaatgaaacaggataagcggattgcgatttaatgtataaactaattaaatttattttgctaatatatttgttgaagtcagcctaacagctggcttttttctttggcaaaggttgcttatttagaaaaaatcattgtaattaagtcgtaattatttgattaggagttaacaaatgataaaaaataatcaagcaccagatattatttatacccaacaattcggaattgctaatggagaaaggtatctccaatataccgaacgtaaagaagcaattaatcctagtccagaagatgttgaaattaccaataaaaattttcaacaagatccagatttaccagaaaactttgaaggttatcttggatatactgatcgtaaagctgccacaaaaatggaagatgacctggataaaaaattaaagggggactaccctactttttcgcaaggtgtctatgaattatctgaagaacagcatcaacaattaataaataatttaaaagaggctcaaactaataaatcgatgttatgggctggcgttatatcttttagcccagaatttttaaccaaagctgggctatatgatccgaaaacgaaaaaagtaaatcaaaaattaattaagaaagcaattcaagatgcgatgccaaactttctcgcaaacgaaggattagataatcaagaaactttctggtggggtgatattcatttgaatacagatcatgttcatgtccacttggcaattagtcaacgccataacacacgtccattaaaaaatggcgttcctaagggaatgtttaagaataaatcgattcgtttatttaaatctcaaatccatcatgaattagaaaataaaaaaagtcgttcaaggatgattgaaattgagaaagcacttgatgctactaagaaaaaattaactaacggattaacaaacgatgtaactattcaacaaaaaaattacttacagcaaattgctaatgctttaccggattataaagacaaaagaaaatggcgttcttcaaatcatagcgttgattttaaggaggctaagcaactaacggatcaattagttaatagtttattgcaaacaagcttaaataatgagtatttagaatatataaatctcttaaaagccaaagatgcaattaatcgtaaaaaatatggtcaaaaaattaaagatacggttaatccagcggataaaaaattaagagagtatctcgctaatcgaatttatgatttattaagggataacgagggtggattatagaatgaagttagccacccagttggtggtaaataaaaaacgccattcggcgtgacatcaggtatcatattaagtgaaccaaacctatatgaaaggatgtccgtcaaatgacgcacttaaatgataccatgtctactagtttattgactactcataaaaagaatgctcatcttactaaagaagaacgtgtgatgattgcgactttaaagtcgcaaggactttccaatcgcgcaattggtcgccaattaggagttaatcatcaaacaattaataacgagctcaaccgtggtacggtccgccaacttcgtcgtcaaaaatctaatggtaagatttacgaatattcttactacatctatagttatgaagctggtcaggccacatatcttgaacatcaccgccattctggtcgtcgtcgcttatattattcttcaaagcaatttttacgattagctgatcagctaatgcttggtgagtttgacgaccaccattactccccacaagcggttatttataaggctcgagatttaatgaatgatggcaccctgatcccaaagtcggttgtaactttatatcaatggattaatgagggtgtgcttcgtacgtccaatttagacctctttgaaaagcctaaacgtaagcatcatcgaactcatccgcaagctaaaaggtgcttaggtcctaatattgctcaacgacctcaaactgcggaccaacggtccgaaattggccattgggaactagatacagttcagggacagaaaaacggtaatgacagtgttgtactagtaatgactgatcgcctttcacgagttaatatcacgagtaaaattgctggtaaaactgcgcatgcagtaaatcagttctttataaatttacgccagaaaatgggcacagatgcttactatcgcatctttaagacaataacctctgacaacggttcagaatttagtgagttaacacaagttcacgatcatgttttctatgctgatccgtattccccttgggaacgtggatccaatgagatcaataaccggtttctccgcaaggagattaccaaaggtgaagctataaataactatagtagtgctcagatcatagcgactaatgattggatgaatcactatccacgagctatgtttaatggacattcgtcaatggatatctatcgtaaggccttctaccaagagatatcacagctccatcaaccaataatcaattggtcagtattatttatttgagtccagtggctaacttattcttgaaatttaggaagggataacgaggaacaatatcagaagaataacagtagcaataaaaaaagagacttaatggcacaaattaagtcacaaggtctcactgagaataagaaattattaaatttagaaaaggaaagattgaagaagcttgacccgaagtcaaaagaagccaaaagattaaaaatgcaaattggtttaaggaagtactacattcggcagattaatttagatgcacaaaaagaaagtttagatatgcggattgttcaattgcaaggcgcaccatcaacgaacctaaatcaatttttcctccattctttaaatgaacaaaaagaactaattcaattaagaaagttacctcgttatcgtttaacccaaaacccaaaattaatgcaacggtttaatgtgttaaaaaatcgttatatggatgtaaataaagttccaattaatctggtgactacaaaatcagttttagctaggaagaagcaactagctgcggaaattgcaatgattcaaagtaatacagatgatccatcaatttctttagtaattcctaatcctaatagcgattatcgaataatgaacgcaactgcctattacaagaacttagaagatattttagatgcaaaattacaaattcataaaaataatcaagcatatcaaaatgatttagctagacgcaatgaactcaaccggccacttttcactgaccttaagaaaaaatatgagtttgctcaaaacagtgaattaattgatactgagttggaacatcaattgacttatattaataataatcaaaagaaataccaaaaaaattcaaagtatcaagggataattaacagtaatttgagtcggcttttaggtcaaattaatcaagatggtcggaaacgagttcttgcgttaagaaagcatttaaacgatgaagatgatattgaaagagaagaccgtgaattagaacgagaagaaatttatgaacgatagataatattgctggcgaaatttgttctcataaaaaatatcagtttactaaataatagattaagcttttagggagactgataaattatggacaatgaatatgatattgggctaattactaacttaaccagtaacgttgcaacgggcgttattataggtactaatgaaccatttgagataaaaatgcgagaagaggttaaacaatcattaagccgctacatggttgtggcgattaacttggatcatactgactttatttatcaacaataatgttgtgattcgactttcacataatttgaatgtaaattataattataaaggtgatattagatgaaaaaataccaaaaacaattgaaaaataacttaagatttttgggaaacgttcctgttaaaatcttcaatagttatttggatgactattacgctaaagaaaacgacttaactccaataaagctaaagtttgagtctaaaaaaagaaatatagatttaatacaaaaaatatattggtggattgtaactacattaacggtaggaattattgcaagtggcattatttctcttagaaagtttgctacatctcagcatactaaagatcttccaagtatgattggaactttgctgattattcttgttgcttatctaattttgttagcaataattgaaattattatccagtctgaaaaaaatataatttataatcacttaacattgattaataaaaaaataaagagtatgaaggaagataaaagtcatgaaaagttggtgggaaaataatagcttaaaagtaattctttttgttatatatgaagtgctttctgggtggtatttgataaatttaaacaatttaaataaggcattgaaaggtagaacctattttgatattgcaataaatagttcagctcctttataccttttaggaagtatagtattactgggtgtagggctactataccttttctttttatatcgtaatttgtggcaggcagctactaaagattacttacttttgacagtagttatactcgctatacttacgataataaatatgatttttattatttatatgattcaaaatcctattttaagggcactcttatccgtgtatataattggtggagcagcaatatatgcttttaataattaattgaaagtcagttcaacggtgactggcttttttattacatcaattcaaatatttgtacatatgtgtgtacaaatattaaaggggctgatctaatataaatagaggtgatacgctatggtacaagcagttacaacaaaagatttcagaagatcatttaaaaaatatgctgatgacgtagcaaattataatgaagcaatcattgttgcctgtccagaacaaaagaatgttgttgtaatatctgaaaaagaatataactcttggcaagaaactaactaccttttaaagagcaaagcaaatcaagaagctttagcacattctattaatcagctagatgattctactaaacatcatttcttaactccggaagaatttgagaggatggcagcagctaatgaccaagcttaacattgattttacacaagatgcttggaaagaatatttaaattggaaaaaggatgataaaaaatggtaaaacgaatagataaaattattagtgatactattcgtcatccatttactggtcttggtaaacctgaaccattgcaacataatttatctggcttctagtctcgcaagcttaatagtgaacatcgaatggtatatggagtaacgagtaaagaaatacaaataattcaatttaagtaccattcattatgataaatagatacacaagtttgaggctgagaaaaactaaaattttctcggcctcagtaacacattggtcaacaatggtaagtaaacatctgttttctttacgagcataaaaaaagactatatacttaagttgttatacaagtacatagtctattctgtccatcacttaatagctgatggattttttagtatgtagcagaattcttctttaaaagatctgctaaaaagtcctctggaacttcgtcaacaggtttgaaagatcgaaaacttaaatcaagggaccgctcatgctccaattcaacaacgccatgaatgttatcaagccttggtagttttatatgcaacgggaaatacttttcgttagatgtgattggcataatctttaccataccaccacatagctgattaaaatcgttgtttgatactactaaagcgggacgatatccactttgttcatgtccttcagttgggtcaagactaatcttgatgatttgtccttgctttaagtctttataagattccatttaatgaaatctcccttctaagaaatattttattgccttcgccgaaagcgtgctggctccagcaattaaaacatttctttgccttgtggcttgccccaatcaatttctttgtttttaggctcatttttgaaatatgcttcggtatcaaaaccatcgaacatttttcttaatgggctttcgttcttctcaggttttaatataattttatcgtcttttagttgatacgatactttatcattgttacttaactttagaatatctaatacattttttggtattcgtatagataaactattaccccactttgataaagtgagtattcctttcgtgcttttcatgataaatccctccaacattcttcattaaacataccagctttgcgtagcttagttgctacaactacattatacaccatttcagcgtaatgtcgatacgtagttgatacatagacgtgaagttagcagaatcaacttgtccaaatttgaacgaggtgaatgaaaaaataaagtcagcttaacggctggcttcttcttttggcgtaagattgatttttcgttatctcagttactttgaatgcaaaaagtaactgaggtggcaattatgaccgaatatgaaagtaaaaacgggatggtaactgatgatgcaataaaaaattatttgcaagataatgagtatcagttaactaagaatcctcaagaagcgttatatattttacgtgatgggagcttaatttcgggtaattacgagtacgggtcacggacagaagatcaccgtatgattgaaggacttatttcagaaggcaaagagctttatacgggtgatccagaaaagttttggggtgcattacatgctaagacagggttgattagggtcgttccggaaactcaggaagccttaatcggagttaatcagtctttatcacagacccaaagagaattgataaagcgattggattatcaagtagacgaatatgttaaaatgccaaaaatcaagccaaaacaacgtaaaacagtacttgatatgtatgagcttggtgaagtcctggcgaggacggagcagcaagagggcgactataagggtacttacattgcctttgataaagaaaatggtacttactttggtctagataatcgcgatggtaaattaaaagaaccagttgagtatcatagctatgaggaagctaaacgcgcaattgatagtggtgcaaacttaaaagcttctcttgaattaacacaagaggttaaagatcggaatactttgactgttaaagctaaccggttgttggacgcaacattaaatgatcctgagagttttgaacgaacggtaaatcgaatgggagcgcttagagcgcacggtaataaattcaatcaaaatggcaatcaattattgttagctaatcatcagctagggacggtctatgcacctgcaagtgagtatcaaaaggataattcgttaagtaaaattaattttcaagagttacatggaactaaggtctttgtaccaaaaatcaaaaaaggaataatcgaactaaatccggctacagtttatgcagtcgaagaaattggtaaaaagcatcccgaattgatgaaaaatgctttagcaatcgctcgggaaaatagtcgtttcttaaatcagtcagctgcagatcggcgaagacagacaaataaagtcctcatattgactaaccaacgcctgaataatcctaaggcagccatgtcgcttcatattgccaggtatttaaccacttcttctgctggcttaaaagaagaatttaaacttagaaatgatgagaaagaattatttaagcaactatcagttaatgaacggcaaaaaatctttaatgaagcacaaaaattaagtcgtaagttgaatctaagagtaaaaagagaattttttaaagaaaaagagcataatcaggacaaacaactgaatagacctacaactaagtcacgtgaacgatagttggcaaaagataaaatgaagcaagcctgcttatatgatggaattacacacagcatataagggggctttttaatgtctgaagatgaaattaaacatcctttggcaaccctaatgaagcaaaagtatggggttactaaacaaagcagtttgagattaaactctgatgattcactatttgttgtttttcgaaaaattgcgaactatatttataaaaatggagaatggaatgatcaagattatgcagatgccattaaatcctacttggaaaatactgacagaggtaatactgacaaaagagaaattgcaagcatagtaaaagatcctggtggccaacaagtactaagaacaaatcgaaatacgtatacaatcaattataaagatgaaaatagtaaaaaactttatttcattcttgatcaagataataaatcttggagccatcagggggataattattataaggtctatgaccccaacgttacttgggtaattggaaatcaaaattatacattagggtacggtaagctccttaacgatttaatgcaggaatggcaaagcactaagcaagaggttccgcttgatgagtttaaggctcaactttatcgattaacgtctcataaatatgctaaaaagagttggcaaacgcggtttcaagagacagctttaggcaatttgagttatcaagaatttatgaccatgacagaaccgattgtcgaaaatgaggaagatttattaggaaaaggtcctgaagaattaaaaagaatctctagacgttttaaagcatctgctttacagaataacgagcagcttgcggaacagtatttaggacgtagggttcgttttaggagctggcaaacggcttatgaagcaaatcaaattaatcgttttatcaaaaattaccttgaaaagacttataacattgtgcggcagcaacgctacgaaagagatttagataaacaaactcatgctaaatcttgggaaactaaaaagaatattgataaagccacccaacaaattatggataggagtagtcttcatcgatattttagtaagatcgaattggataacgatgttgatttgaaagcatttggttattttgaagatgaagtaaagcgcttgatgagccatatgccattagcaaatgacaaaaatattttacgcttacgtaaactgggaaatcatcgagcgcttggtatgtatgtgccctcattagatacaatcgttttagaatttaggaaacaaagcgaagtacgtaaagactcaaacggtgatacggttggaattagctcatttattcatgagtatggtcattatcttgactatcatttaagtaagtggcctttatcattagaaaataatttcaaaccactgattacgcaatatacaaaaaatttagcaagttccaatctgtctgatagtaaagttgaatacttaactacgccaacagaagtatttgcacgaggctttgaattatggtcctatgaaagtgctaagctacgtggaaatttaattggtcaagaaaaagaatataacgctaaaacgggagctatcgaatatcaagcctttgatagtggtttaagagaacgattatttaattattttgatcaaattccacagctaaaggaaattaagccagaactagcaattgatacgtcacaatttgaaaaagtaaagccgttagaaacaaaagaagatttaagtgatgcgcatgtacttaaagatttatcggttaaggctctgcagcgatggacggataatccagagaagttagaacaattgattagtgttacggggacttcaatgcaaatgaataatcctaatcgcttattagcattagatcaattgcaattggagaaactgccagtaatggtgccagcacgagaacttaaacggttgaaggtaacgccagcgcaaggagttcataaggtgcgagggtttgtgcagaaatcaaataaacgttggatatcatctgaaatgtatagtttgcccgatttattaaaacagaccagtgataacttagaattaataaagcaattaaaagcattaggcaaaccgcaaaaacagtataatcaagaaaaagttaccaaacttttagatcaaactagcctgaaattaaaaaatagtgacaatacaattactaaagcatttaagcgtgctgaaagatatgtcttgcttgattcattaagcggacaggttaatcgacggccatttcgctttactaacgaggagcgtgaattattaaataaaggtgttcctgagttattaaaagttatgtatttacgaataactgaagcagctagtaaagaagaaaagaatttgcggatgaaacttcaaccaacaatatctaagaatattagtttaccgcttgacagatccaagacaattaaacgttaaacaagtataattaagaaaaaagagcagaggaagttatatgatgagtgatgaattagctgaagtagaatactttcgttatggggtagcgcaggtaaatttaattcctagtggtcggaaagttaaagtgattatcccagatgagaaagctgataatattgaagttggcggaatttatagcattagtgatgattatcaaacactagattgctgaatggaatggttaactaagaatattttatgatcaaataattagtgaagaacagatctgtccttaaatttaactaaaaaggaacgaaggtggttttttgaacggttcgcgaaaatgttcagtattttttaggtcagtactaaatcttttgacttattttagcccacagaactctgataatcgaaaagcaaagtatttttacgtcctgaaaaatgattatgagggttattctttgcaaaaactaaagggtattctgattgactacgaagtttcagtaagaaggaatgaattagctgctactgctattttggggttactgttttccgcactgctgtcaggactagggaaaagtgtgttagcctggtttcagactgcaacagagctttatgtattaaggttaatttcggttaagacgattccaaaagaatatgtaatgaaggccaatctgctatctggtatattggtagccattttgattattatcttggctttacttatttatcttgtcatagcaaatatctcgcgtaaacgcagaatctgtctagtgttaaaagaagttattaaggaaaaagaaaatgaatagttatcgtgcgcatgattggttacatgaacctgaaataattgctgaattaattatttctgttttatatgttattacgtttataatttacttaattcttctcggtatctttaacaaaagaatggaagacgaaggtcttacagatgctcttgtaaataaaataaatattttaggaacatcaaaaagtattcttgatgaaggaggcggtaaatatttaatatgggctgctctaatgattcttgcgtttattattgtaatcataatcttaatatgtttaagtaaccattcatatcataagaaaatctcgttagttattattgtagtatttattatagtttcaattatcttgtttgtaattttatggaacatgattaatataccgatacttaaagcatttataatttttacgggagccgtaggtataggcagcgcattaattggaacttctaattaaataagggcaaaaagtgggatgaggcgatagcaactagctaccgtcttttgttttactctttttaggtatttatctttacattgatgtaaaatagtgtaaaatatatgtagcatcaaaataagaggtgaggctaatttgaataattttcaaaaggcaattttcttgttgcagaatatcgacaagcttaaacagcttaatgtaaagcgatgactcttactgagttctctaaataactgatgtttcacggccaacgttgtataaatacattcagcatccagaaacaatgagtagttcgtttgtaaataaagcggccatgctctacgacaaggttgttaaatttcaagatattcttgatacagttcagcgtgaagataaacaatttaagactaccagcaggaattgattaagcttttagagtaatgtagctaatattgaagttacagattatacaaaagcaatcgcgacagtaattattagtgacttaaaagaagaaaattcaagtctgctaaaagcgttaagtaagcaattaccatttaaaccaaatttaaatgataatttgtcaaaatagtatttacaaattcgtaaatggtgttaaaataaaatcgtaaataatttaatacaatgactttaagaagttggggattatagactatgaatagtaaaaagaaaattgttacattagcaggagttagtttggttgctactgcaggagtagttgcttcaacaaatgaggtgaaagctgatacaacttctgataatgctcaggctgcagcaacgtcacaaacagctgaccaacaagcacaagctaaggttgatcaagcacaaagtaatgttaattcagccagccaagccactagcgcagcccaatcacaactagatagtgctaatgcggctaacagtgcagcacaagctgatgttaacagtcaacaagcgattgttaatgatgcacaagctaagtcgatgctgctacaagttcagtaagcaatgcacaagatgctgaaacaaaggcacaacaaaatgcagatcaagcttcaccagctaatattcaaaaggcacaagatgctattgctaatcaagaaactcaaattagtaaagacaccgatgctattaatgacgctaacaaagccgttagcgatgcacaaagcacagttgatgcagcgcaaaaaaagttaatgatgcaactactgctcgtgacaatcaacaaaagaatgttgatactgctagtgatgcagttaagaatgctcaagctattcttgacaacagtgatcaggctaaaaaggaagcccaagatgctttgaacaaggctaaccaaaaagttgctgatgatactactgccgttaacaacaaacaaactgatgttaacaatgcagcagaagctaagaagaatgcagatgaggcattgaagaacgccaatgatgcgcaaacttctgcacaaaagaataaagatgctaagcaagcaattgctgatgaggcaagtgtagcattagctgatgcaaatactgcagtaaaggacgctcaagctaaggtagatgcaatcaacgacaagttagcaaactttaatactattactttgcctgctggatacaaagatgacttaattgcatactataactattttggtaatagtaactataatcaagatgaagcgaataatttagcgcaagatcttcttaaatatcgtgatcaggcaatgagccagaataaatttaaggataatttaagtgatgatcgagtggtagatattgataatcttaattcaacagatcgagcagagcttagccaatttgttgcttcacttattaatcaagttcggacacaaatgggtacaaatcttgtgatctcatctcctgcagcagatgattatgcagaacaggtatcacaaaattataataaagataattggaattctgcagataacggaaagcatgatcaaagtgctctcaataatgcaactgatcaacttaatataagctggaacggtgaaaatatggggctggatcagtcaatttttacaacagactataccgtattgactgatggaaccaaattaccaactggaaataaacaaacaattaatgatctcaagcatttgatttatgatgattttatttcaatgatgtttgatgatgcagattcagcttggggtcacgctactaattttgctggaattgataactttgcagctgaaaagcaagctgttggtttttctttagataagttctacaatacacactatgatttagttgaagcaaatcaaaaagttgaagaaaatagttatacattgccttcaattaatgcactaacacaaaaattagctgatgccaaagacgatttatcaatcaagcaaactgatcaagcatcaaagcaaaaggctaatgatgatgctcaaaatgctttatcttctgctaatcaagtactcgtagcagctcaaaatgatgttaaagataagacagctactgctcaagaggctaatgacaacttaactacagctcaaaatgatttagctactctgcaaaatcaattaagtgctgatcaagctaaccaaaagcaagctcaaactacttttgattcgtttgatgctgaccttgcaacaaagcaagcaaaccttcaaaaggctactgatagtcttaaagcagaacaaggacgtttagcaattgctcaagctgatttagataatgctaataaggctttaagtgatgctaataacaatttagcccaaaagaaacaagtagttgaaaatgataatgaaacccttaaagttgataatgataaactagttcaactacagaataaccttagtgacttacaaaacgctcctaagttattagctgctgctaaggaacaagttgcgactgctcaaaaggctttagctgatgcacaagaagcttacaatgtagctaatgataaattaactagccttaagcagactgctgctggcactacaacaaatgtttctaaggcacaacaagctcttgcagaagcaaagaataatgaagatgctgctaaagaagtattggatcaagcacaacaagcattaactgaattacggcaaaaagaagcacttgctaagcaggttgcggaagaacaagctaaattagctgctgaaaaggaagctaaagataatggctaccatatcgaaaataaccaagttgttgacgctaaaggtaatagtgtcaatggctggacagttaagggcaaccaaattgttagtccaactaatgctactgtagatcccgctgtttctgtaaccaccaatgtcaatgttgatagtaaaggtcaagtacaaccacaaactagtgttactgctaatagtgttaagactgtagctgcaactgaatcagcaaatccagtagcaactactactgtgcaaacccgcgaacaatacaagcaacaattgaagagcaataatcaattaccacaaactggtaataatgatagtgctgttctttcacttgctggagtagcacttgcagcaatgttgagtttgttcggtattaagaaacgtgaatactaatttagaaaatgtaagtattattatgtaaaaaggttcaaccaaattggctgaacctttttgtctaaaatttaaggagaagttttatggatatgacccctgaagaatttgagaatgttgtaaaaagacttcatcaagaagctcaagaaagaaatttaacctacgtgtttcctaaaggtcgaatctttaatgtagaggaagcgtttgatgatgattattcatatgcaaagattaatatcaaaaatgggaaaagaaatatgttttcattggattgaatccagctagaaatggatcacccttagcggtatataagaaaagagctaaagctaaagaacctttggaaaaaatcgttgctaacggttctgcatggaatcgtgcattaaatcatagtggaaggttggaagattttaacgagttaggatcgatatattttcttgatatatgtgcaaccggaaccttacaagcaagtgatttgaagcaagttcaagctgaaagctatatgaagagtatagagtttatctcaaaatatatatctaagtatcttagcaattcaaagatagtattatgtccaggtggaaaagcaaatagtaagaagattcgtaaagctctctatgaaaaaattataaaagaaaataaggatcgaatatatatttatgggttatcaagaggagtacctagacatattattgggagcaagggtactgatttaagactcataaaggatgatcaaattagtacagtttcaggaataaagtgaacttagagtatcgataaaaaagctgtgtttctttgtcaagatgaataaaacacagcttttttttaagaagtcatgagtaaatgtacgaattgaccaaaatgtaattatcttttagtatagaattgttacttttgcgtaatggctataagaagcagttatattaaaaaggagcataaaactatgtttaacaacattaaaaatataaataaagtgatggggggggggtaacgccagccctctagctgttacatttttagctactgctttaaaaagggcggtggcttaaaatgactttactaaccgaagatcaagttcgagatcgggcaaagcaaatattacattttgaaaatgatgctaatgcttttgctggaactgggcaattaacaagtttcaatacactaggtaaaagtttttctcaaaatccttggaagagcaataataataagcctgatggatggtacttacctaaaaataaaaataagccggccttaattttagaaactaaatctagtactaaagacttagacgatgtggcaatacctgagttgcaaaaaaatatgtcaattgtacttaaaagatatccaaacgtaatggggattgcttataatggacaggatgtgcgtgtttttcgtaatgaggatccgggaagcgatacatttattgaagctcaattatctaaaacattagagaataaggattattacattaaagtctttactgataaacctgttgatgtaaatgaaatttatacattgacggcgagaattaataatgctttgcattttaaatttggcattcgtaatttatatgatcgcatgatttttacagcgggagctttagtcgccgtacgttatggcgcaaagcttgaccctgatgatgattataatgttttacagacttctatcttatccaagctgaataaaagtctagaaccttcactaaaacagaatttaaaacttaataatgtaattgaggtttttcgtgatattcaaacgaattttgacccgggtcaagaagccattaaaacctttgttaataatataaataaaattagtcaatctataaattcaagccactggcgtggtgaagatgtaatggctattttctttaatgaatttaataaatataaagctaaaagtgataatggacaggtttttacaccacaacatatagctaattttatgtatcgtttaattgatgttagtatggatgattctgtactagatgctacctgcggttccggaacttttcttaccaattcaatgtctaatatgattactgaagctggtgggcctgatgctaaaaaagcaaaaataatcaagcaacaaaagctttatggaattgagtttgataaaactatttttgccttagcatgtgctaatatgatgattcataaagatggtaagactaatcttaaccgtgtggacgcaatgaccccagaagcagcaaaatggattcataatatttcatggctagatcctgaaggtgagcgggataatgatgaatatttaatacagaatgataatcaattgaaacctcaccatataaccaagatattaatgaatcctccatatgaacataagtatcatcctttagatattttaaataatgtattagataatgttccccaaaatactgatgctgcaattcttttgcctgattttaaacttgaaaaagaagggaaaaagaaagtaaagcatctactagaacataatcgattaacaaagatcattaaactacctaaagaaacatttaatagtgaaggtgtttcagtttcaatttttatatttgagactggtcagccaacaaatcctgatgatggaatattcacctgcgagattgcggaggatggacttgaaactgttaagaatcagggacgacaagatataaaacaccgatggtcagcaattgaagacttttgggttagaactattaagcgttgtgatacacaagcagataaatcttgccaatggattacacctgatttaaaaaattataaacaattaagcgttccaatccctcagaagccttttgtgatctatgatgaggactttatgaaaactgttatggactatgaaatgtttaaacaaaatattaatagttcaaagttgcaagatgctttaaaacaaactgtactttatcagagccaagtagtagaaaataagcaaaatattgatattaaaataaagaagggagtaacaaatgaatcaattgaataatgatagatattggaaagaatttaaattgccagatctagaaataaattcatatggtactcctacacttcatttacgacaagttgaggcagcttctgaaattgatcctgattgtgaaactattaattatattacacgtggtaaatttaataatggtgtaaaattaagagtcattaagaagccaaattttaatattattcctaaaaatactattagctttggcggtgaaaccggagagtttttctatcaaagagaaccttacgttacaggacgggatgtttattatattgatacatcaaaattaacagaaaatgaagcgttatttttattaacaatagttaggaaaaaattgcacactcggtcaacattcaatactattatgactgcttcaattgttaacaatacttcatttcaattacctgtaaatgagcaaaataagccagattggcaatacatgaatctatatattaacgaattacgtcaaagggcgttagaaaaattaaacattatcaataacattaatattcaaccaacatctatcaatagccaaaattgggaaaactttaagtttacagagttatttacagtaaataactctacaaatgttttaagacgtgaagtcgatttcggtaccggttcaatgccctatataacagcaagtagtatgaataatggagttgtgtcttatattgatgcaagcaatttacccgttgatgaaggaaactgtttactaattggaggaaaaacttactctatttcatatcaacgtcaaaactttgtatctaatgatagccataatcttattatccgattaaaacctgaatataagcagtatgcaaccgagaatgtttatttatttttagctagtatctttagagcatatagttactattataattgggctaatgctgttaacaaaaataaattaaagtcatcgactcttcatttacctataattcaaaaaggagtgccagattggcaatatatgaatcaatttattgatcaaaagaagagccaagtaaaagataagatagaagcttttggtaaaatttaatgagatttgatagtgtaaagtaaggttttctaaagaaaaatctgtattccttgttaagatgaggaacacagattttttttagtttaaaggggagtttacaataatggataaattatttacggactattatttagaatggattcatatgtataaagaaggatcagtacggcaagtaacattagataagtactacttaactcatcgagaattacaaaaaaggtggccactcatgaaagttaaaagcattaatcattataattatcagaagttaattaatgaatatgctgaaactcatgaatacctaaccgttaagggatttcatcatcattgtaaagcagcaatcatggatgcaattgaagatggactacttgtgaaagatccaactagacacttaacgatcaaggggaagcgtccaaaaacaaagaaaattaaatatttgagtttgttagacttgaagcgtttagttaaccagttggacttaaaggctgatttaaatatagattggctaatcttattgatagcaaagacagggatacgatatgcagaagcattaggaattacagttaaagactttgattttgaaaatcatcagttgcaaattaataaaacatgggactacaaatccaaaaatggcaagtttcaagagactaaaaataattcttcagtaagaaccatcagtgtagacccgattacatcagaacagtttcaaatgctaactaaagatttaaatcctgacaagcccatttttctacaaacaggtaagcgaatatatatttccactattaataatcacctcaccaaatattgtagaaaagccggagttgatgttatttctgtgcatgggttaaggcatactcatgcctcgttattaatctatgatggagtttcaattcctagtgtggcgaaaagattgggtcattcaaacacgatcactacgcagcaaacttatttacacatagtaaaggagttagaagcgcgagataatcaaaaaatactagaaaatatgattcgattgtcttaaactttgtccaaatttggacgaaccaaaagggaaaataccttaccattttgaatttaacttagtaattattcggtttaaattaggaaagattacataaaactgtaaaattttggcttcttactcagaaacgaaataatgctgagtacgataatgcaatgaacgagtacaatgcagaaatggcaaaactgaatcaaggcgcaaacgcgccggtcattacaacaaacagtgttaatcaagctttgtcgttaaaaccggaaaataatgcaactgttgatatcgaagcactaaatccaagaattacatttaaacgagttgaagaaggtactaagtatgctgggtatcagatttttgataaaaataatgcatatgtcaacaatattgacggagaatttctacgagttacctatacgaacttaaaaaactcaacatacaaaggatcaaaaattagcaaaatcgtagttacttattctgacagcacccctactggcaatcgtattactcaaagcggattaaatgctgttacagaaggtgctaacgataactttttagtagttttcgaagacccagtgcggggagatatgcattcaactactgtaacagcaacttatcagtattacgatgcaaacggtaacttgattgatttttccggaacaaacaatgcatggctttcagtaggatctctaaactttgatcagggaaatgattatcaaggaggtaaaaatgaaggtaatccaacaagtgggattagcgaaggcgttaaactgatttccggtgctcaaattaaacaattagctggatcatcaattagtgttcatgatgatggctgggcttatgccggtttcaataattatagtggtactggtatgaataatggtatcaatactgataacggtggttctggctgggatatggatggatctcctaatgcatactatggtgcgattgtttttcaattaactggatctagtgtttctttacgacagggtttagtctcatggggtggagctgatattgcttcccagtataataatcagttcctaaataatgcttggtttactgctggaacaaccttacctgaaacacaaattaaacaaccaattcgtaagacttccgaaacacactatcactacaacccatccgtcattcgcttataatcccgaacaatagacgagaatagtttctttcttcataccgcaaaataaaaagcgccaaccaaagtcagcgctaagattactacttgagtaaccaattaattagatgtttaatgtgcttactaggcacaattagaatgattggccaaatatggctcatggggttcacccccagttgcacttataattagagattggtagtctcagagtgcttaattattgtaccataaaaaaagtatgttataatgtttatattagaatgattagccggagtgcaaaacggaatcagttggttacttattccgaaccggttggggcgcttaataggcgctctttttgttttaaaacactaaatcatctatattgttcggaaaatataagtcaatagcggatgggttgtagtgatagtgtacttcagtagtttttcgttgtggaatactaccgttttgtggaataacggttgttaattcagcccaagcgcccgaaacacttctatcagggaaagcattaagatcaataacgccgtcttttcgcttagttcgagatgcctgaagagctaaatcactagttgcatgtgcgtgccatcgtagagataacgttgtaccagttaacttgataagtccagcaccataatattgcattggcgaaccagttttatcccattcatctaaattatatggtgagccccactgcttggattgattatctgaatcagcataaaagtcgttaccgttatgaagcttaactgatgagcctgctattgcaaaggcttttccaccagcaagaacttggcacgcttcaaaaacatttccagcattttttctactccattatccatatagtcataacgaccgccattaagagacattggtgaaatgtaagcactgatttttgaaaaatcaattaatttaccctgatcatcatagtactgaatatccgtatcaatctgtccagaattataatttataaacttgactggattattgaatacatgaacagattgcaacattttatttgcagttgaaccaatagattgaccattacttaaagttactacttccttaacgatggcatgtttttgaccagtttcgtctatataaaacgaatgtgtaaggttagtgaaggttactgtaccgattaatccggtctgattatttccagcagaagaaaagtctatcgtatcatatttgctgccatcagcagcaacatgattttttgtaatcagatattttgaagatatatcaactgaagcatttggttcattttgcaaaactaaattttgaacaatttcatttggattagcaccatttggattacttggtgtactatttttccattttattaattcttgctgatattcatcattgttttgtttctgagtaactcaattaattatctttataatttaaatatttaatggcaattgtacgaatgattttagaatgatttcttaaatagtttgaaaaaacactaaattttggcgaaactttgaaatatagaaaaatagaataaattctcctttgaaaaataaattaatttgcaaaggagattttttttatgattgtaagacaaaaatcaaaagttattccaatcgaaaaatcatctacacattacaagatgtataaaggtggaaaattatggctaacggctggtattactacattatcaatggcaggtatgatggttgctgcaggtgagttgcagacagcacatgctgatacaaccacaacagctaataacacacagcaaactgctactggtggtaatgcgataacggctactacaagtggaacatctggacaagctggcacaattacgcagccagttaatgttgatcattcgcaactgaataatgctgttgatcaagctcgtcaagctggattgactgtaaatcagcaaccaacaactacacagactgtaaatcaggatcaagttgatgctgccaagcagagtattcaaaatgatgaagctaagcaagcgcaacagattcaaacgattactcgacagcatcaaacagaagtgtccaatgttaataactttaacggctctaagggggatacttcccaacttgatgctaaggtaaaagaggcacaatcaatccccggattaactgttgtacatgatcaagatcaaaccactgtaaaaaaagcttctgatacacaaggtatccaagaagcggttaataatgctacccaaagcaataatgaccaagctcagagtattcaaaatgctatcgatactcagaaacaaaactatgctaaataccaatctcaattaaatgatttagcaaaagatcaacacgttacagggcaagttaattgggataatggtggatacatgaatgctcatccaacttatgatattacatggcactacgacttacagcgtaagaaagttgtcgtaactaacgttcacttaacgattccatcaggattagcacctaaaacaggtggcggcttctgggacacttatgtcattaaacgtgcaattgatcctgcaccagttaaagatccaacaagatggccttttgggaaacaaggagatgcaactggtgtagacggaaactcgttaaaggagaaatatttcccaggatcacttgccttctacgcgcacaataataagacgcaggaagaagtaaaggctattaaggattatcatggcagttatgatgctatacagaatccagacggaacttggagcttaatcacaatttatgatcgttctggaacaagcattcagcatgattatccaaggtatggagacccagcgtgggccgaatggggtgaaactgcaccggtggctactgttacgttacccaaactaaataccacttcagccaactatcactacaacccagtgatggtacctaagactacaattggtgatcaaccagtcaattaccaacttcatgacttaaatgttaagactacgcctgaaaagaactgggttaatggtattcaaagcgttaacaacaaggtaggaatcaatgacgatgtggtaactaccaaagttgatatgaattatcttggttcaaatcagattgaaggtggtttgcatagtcttaaggttactgacgattattccaaatttgctaataatgttgactatgctggagcacaagtttacgagaatgaagaacttgcgacaggtaattatgatattactaataatggccaacaggttacggctacacgaaagaaccctgaatctgctaatggtggtaaagtttccttagtaattgactttaagattaagccaaatgttaaaactggaactgtctttgaaaattcaggatccggaactatcaatgatcaaactgtaccaacgaatgatgcacaaattaaaacctatgaacaagaaacagtaaaacactggatggaaggcaagaatattgtcgatgataaaactgaaattaacggtgatattgttactactcaagttcatatgactttgccagaccaaagtactttaattgcaccattaagttatgtgtcaattgacgataactatactgattttgctgataagacaaatcttctttcttatcaattatgggaaaatggtgctaatgtaactgatcaatataatattactaacgaaaatggtcatttaacggctgtccgcaagaatgcttcagcagctccagcaggagaagttgttttaatcggaacattcaagattaatgataatgttcctaatggtactaagttagtaaatcgaggatctggccggctaaacaatcatacagttgagactaatacgccagcaattgttacctttacgcaaagcgttgataagcattgggtagaaggttccaataccgttgatactaagacctatattgcagatgatgtagcaactacaaacattacaactactttacctgaccctaatagtttagctaaaccattaacatacctgtcaatcgatgatgattacactaactttatggataaagctaaattacaaagttaccaagtatgggaaggcaacagcaacgttactagtgaatacacggtaacagataacaatggacacttaacggcacggcgaaacgatccaagcaaagcgccaggtggcactttacgcctagtagcagtttggaaaattaatgataatgttccttctggtactaaactagtaaatacgggttctagtcgaattaacaaccatacagtagaagccggcaaaccttatgtagtagtttatacacaaactacggacaaacactgggttgatggtaatcaggttgttgatgataaaacttacgttgatggtgacaatgttaatggtcaagttactatgtccttgccaaatccaagcgatttagccaaaccattatctaatgtaattattcgtgatgattacactaaatttgctaatgatgttgactacaagtcagcaacagtaactgaaaatgataatgatgcaactgatcaatataacattgttaacgagaatggggtagttacagcaacccgcaagaaccctggtgcagcacctgctggtaaggttcaattaaatgttatctggaccactcatactggtttacctagtggaacaaagttagttaacagtgggtcaggaacgattaatggtaaaactgtaaatacaccggaccgaacaatctatactttccataatgatagtgataagcactgggttgaaggaaaccgcaaggttgatggcttaactcagattaatgatgatttgattcatgctgaaatctctaccgctttaccagatccaagccaattagctaaaaagcttggcgaaattcaattagttgatgattggtctgacttcaaagacaaggctaaggttactagttatcgtgtaactgaaaatgataaggatgcaactgatcaatataacgtagtagttgataataacggttttgttactgctactcgcaaagatgctagctcagcaccaggtggcattgctaaactattggttgactggaagatcaatcatgatgttgccagtggtactaaactaagcaatactggttacactttgatcaataagagtcgtgtagacgttcctactgtcgacactgttacctttaccccaaagacagataagcattgggttgagggtaatcaagacgttgatgataagacttatgttgctggtgatgaagtgcatgggaatgtctcaatgacactgccagaaccagagcagttagctaaaccactttctaagattatcgttattgatgattatcgtaactttatggataaggttacctatgagggtgctaatgtctacgaaggcgataaagacgtaacttcactctatgatgttaagaatgaaaatggaattgttactgctactcgcaaagatgctagctcagcaccgggtggggtagtttatctgaaagctaactggaaacttaatactgctatccctaacggtacggtcttgactaaccgtggttcaggacagattaatgatgatctagttccaacacccgatcgtaacatttatgtctttacacaaacagcagaaaagcactggaaagctggagaccaagatgttgacagtaagactgttattaatgatgatgtaattcattcagaaatttcgatgtcattaccagagcctaatagcttagcaaaatcattagaagatgtagcaattgaagatgattacagtgacttcaaggataaagttggactaccaacagttaaactttatgaaaatggtcaagatgctagtaccgaatataatgtaaccttaaaggatggcgtgattactgctgttcgtaaggatccatctaaggtgcctgcaggtaccttaaccatgaacgttacttggaaagttaatcacgatgtggcttcgggaactaaattcactaacaaaggtaccggaattattaaccgcagccgcgttaagactaatacaccagatgtagttacttttactccagaaaccgataaacattggaccaatgataatgatcaatctgttgataatatggtcttcatagctggtgataatgtaagcagtaaggtttcaatgtcgttgccagagccacagaacttggctgaaaagctcaagaaggttcaagtaattgataactttgcgactttgcggataaggttgatcttaaggggtattccattaccgaaaacggaaaagatgctaatgatctttataactttgaagtgactaaggatcatcaaatcattgcaacgcggaaagatcctgcaacgacgccaggggaatcgtaattctacgggcgcaatggactttgcataaggacgttccaactggaacagttcttactaacaagggttctggtcaaattaatgatgacctggttccaacccctgatcgtcaaattaagacttatactcaagatacagataagcattgggttaataatggtggccaagtagttgataataagcttgcaatcaatgatggagttgttactgctcgtgttgatatgacccttcctaagtcctcaactcttggtagtaagattcataaaattcaattaaccgatgacttctctaagtttgctaaagatgttgaagtgcaaggagtccatgtctttgaaggtgataaagatgtaactgatcagtatgatatttctattgatccaaatggtaaggttgttgcaacccgcaaggacccatctaaggttaataatcatcaaggtgaattgccagttactatgcaggcagtaatgaatgctaaggattccttagatactaataatttagtcactaaagcaactggtaacttaaacaataacctttttgccgctagggccggattattcaatgcttcctttattcaaactcatgtatcttcagctaatggcaagatcaattcacaagttgatatgcaacttccagaaactagcgaaggggtaaataaggtagcagtaaccgacgattatactaacttcagcaaatatgcccaaccaggagctgttcatgtttatgaagatggtaaagaagccactgctaactacactgtttcagatgatggtgctggtcatgtaacagcaactcggaatgacactgaaaatcttaatggtggccaagtttcaatgaaggttgactacaagatcaagggtgatattcctaatggtactgttcttgaaaatcacggttccggaacaattaacgatgagacaattccaactaatacaccatcaattactacctatacccaagaagctgaaaaacattgggtagaagatgatcaaattgttgatggccgggtagttattgatggatccgtagcacatgctaaggtcactactaccttaccggacccatcacaattaactgatccacttactaatatgtcaatcaaagatgattattcgaaattcgctaaggatgttgatcttactgatgttcaagtccttgagaatggtaagttagcaactagtgagtataaccttgaaaaaggtgacggttttgttatcgcaacgcggaaagaccctgcaaagacaccaggcggtaatgcacaattgctattaacatttaacattcacaaggatgttccatctggtactaaacttgagaatgctggatcatcgacaatcaataatcatacggttaagactaatactccttggattgaaaccttcttaccaaatccaacgaaggatgtagtaattagtgttgataatcaaaagggtctcaatggccaaaagattgagttaggccaacgttttgattataagttggttgggtcacaattgccggctagtgtaacagcgcttaatgaatatggttttcacgatgattatgatgaaacgcatgatcaatataatgcgggttatacagtcctcttaaatgatgatattacgttaaaagatggaactgtgcttaagaagaataccgatgttacaaaatacacaacacaagttgttgatacagaaaatggtaaagttgatattgaatttgataaaaacttcttggcaagcgttgatctttctaagtcatcgtttggagcaacagcttatcttaagatgaagcgagtaaagagtggaacagtacaaaacaagtacacaaactcaattaacaacattgactttagttctaatactgttacaacaactacggaaacggaagaacctaagaagccagaaacaccatctactacacctaagacgccggaaactccagttacgccaactgaaacaccaaagacaaccccaacaccaactcctgctccacaagtaacgccagtacaagaaccggttatggctgcagtagcaactcctgctcaagttgccactccagcaccacaacaatcaagttctgcggctcctcaagaagcattgccacaaactggtaatgcaaatgaaagtggattagttgcagctggattagctggattcctagtaagtctaggcgcatttagtcttaagaaaaagcgaaattaattagtttgttttacacataaaaatttcatatctcctttaaagtaaaaaggctcagcagtttgctgggcctttttgcgtgaacagtgtcaatggcgaaacttctttttttctcctttagtgtaatagtggattttaatatatagagcaattttgatattggacgggattaaaaatggataaaagagaatttagcctaaaactttatcgaatctcagataataagttatattacttagtaactgcctattctcaaacggatgcaatagactatctccttgaagaattaggacttgagacaagggataaaagcaactattcgattaaagaaattgatatttcaacgccaggccttatttataatgaaacaatggtcatgtcaattactcagcaaaaggaatacagcgctagtgaggtagcaaaaatgattgggactactcctaatatgatcggacgaattgctaataagttaaaaataaaatctaaaacatcatgtaatcaatatggccggtgggtttctagtaaatcgcgttattcaagtaaagaaataactcagtggatgtattatcaaacagcaattgacttaattaggaatacatttagcaaaaagaataagaagattagttatcaggaatcactttttggagaagattatgaaaaacacaattgatcaattatcattaacccaattaaaattcagtcaagccggaatgaatagagacactgctacttggttagctttagaagctaaactgccattagaacaacaatgtgcttgcatagaagccttagcgttagagcctaatccaaatgagaaggttaaaagattaattattgctagaggatttcaacaacggcaaaggcaacgaattcttaacaggtaatgaaaacaattaagtaaattaagttactgtgaatttgtacataattttcttaaatttaattttcagacaataaataaaaaaagagcgcctattaggacgccctctcaaccgactacttgtgagctagaaagcacccacaacacacggccttatcatattagtaactatattataacacaaaataagtatggcccaataactaggcacatttgagcaggcgtaggaaacctgactagtgcagagaggaggcaactccttatgacgcatttgtgtctaataagcacattaaaaagttaattaaaaaagctatgcgactattcaaatagctttttcagcggtggtatttggttactgtcgcttttttattttcctgaaagatagataaagaataaaactacaatagcgattaatggtgcgaaggctagtagaaagaaaaatttactaatcttccagaaaatccaaagaataaaagtaaagccagtaaaaaagaatacgttggagttaaaattttggaataaataatcccatccaaatgtggcgaaagggtaaaaaagggctagaacacatagaattaaacaaaagataccatcttttttatcagtaaagttataaagaataaagataacaaaataaactgatagatagtgagaaaaaatataacctttatctattctgccaatagttctgttatataaatttaacattgatgtaaccgcccttctatttatttgttgcctctattttacactttatttacatttatgtaaatacaaagtttacaccagttaaagtgtggcgaaagatactaaaaagctcattccaatttacttttgaagaaaaagttaaggagtgataacccatgattcgagttttctataagcctaattgtaaagcttgtctaatgactacgcatttttttatcgttcaccacatcaaatttatcgatattgatctttctcaaagtcctcagtatgctaagagtcttcatgataaggggcatcttaaggtgcctgtagtcattacagatacagaagaatggtcgggatttcgtcctgataaacttaatcagcttctccaaaagcaacggctaatgcgggtggagaggtgatcaacaatggctgcagttacagaagagaaattatcaaacgtagataaattgtgtcggcaatctattcagaaatatttagatattaaaggaattccttatgaaaaacaaggctattatttaagactaactgatcatgattcgctagttgtcgatacaagaataacctcacagaagccatacgagactttctattggaattcgcaaggcgttggaggaaatctgtataattttttaagatcatatgaaggactagaaaagaaaatagcactagatcaattagaaaaactagctccagaattagcaaaggcaccacaacaccattatcaggtagttgaataccaaccagaaaagtggccaggtagtcggcaaaatcaacaaatgattaactatttcactaaaactcgtaagttagacgagcgcttgattcaagttctcattaaacatggcttaattaggcaattacgtaacggtagtgcattcttttcctggagagataaaaatatgaaagaaattggtggtgatgtgcagggaacgatagttgatcataaaagatttgggaaacgtggcaccattaaaatgattgcaaaaggttctgctagggaatttggctttcgttttaatgccaattcaaaaaacgatgacactaaaaagctatatatttttgaaagcccaattgatatgctgtcctattttcaaatgcatggtaaccaaccaggtgctaaaacttttctatcgcttaatggtgctgctaccaaggtaaataccgttagtaattacataactaaatttggtgttccagatgaaattcatttagcgttagatactgatacagcaggattgaagggtattatacgcattaatgggaggcttgaaacacttagaaaagaacaaggttgggataatatgaaaattatagtagatcagcccaacagcaataataaagattggaacgatgccttgaaacttaatgacaagcaatactatgctgagtccatgcacgactttgctaatcgtaagactaaagaattaggagtaaaacggattcgacaaattatggatgaaatgctagctggtaatatgggaaacagtaaagcaataaccaataaagtaaatccacaaaaagctagttttaaacaacattttgaagataagcgaaaagaacgttaaagttcaaatgatcacgtcatgaagaaaaaattcatggcgtttttactttgtccaaatttggacgaaattaggcgaaactttggtaaatcaatagctactgtatcttaaattcagttgaaataagaaaatcaggtgaaattatgtttgattatttaatcttaaccgaaaagaaatcagcatttgataactttgtcgctgctcttggtggagaaacaggaacagttaatggccatacatatcaactaactcatgctcaagggcacctactagaattcttagatccagtagatcaagttgcaccaaacttgaaagataaatatgaatcttgggagttaaaagatttgccctggaacttacaagatttaacatggcgaaaaaaagcgaaaaatggatcagcacagaaaatgattaaaaaaattgctaatgagagtcgtcaagcacaagcaattgttattgcaactgataatgatccaagcggagaaggtgaacttcttgcttgggaaattattaatgctatcaattggcgaggaccagtttatcgtgaatatcatgatgatgaaagtaaaaagggaattcaaaaagcattaaggaatttacgagatatttctagtcagaaaaaagatggtgactacattaaagcggttttacggcagcgatgggattttgcgtctatgcaagcaacaagggtttctacaacattagctcgtagtgaaggttatcggtaaaagttattaatcaaggacgattaaagtcagtaatgcttgcttttacttttgatcaactgcagcgaatcaagcattatcaaaaaaagccttactacgaagttaaatttaaggataataatggccatgtctatgctcgcaaagtaagaaaagaagacgaagaactaattaaaaagattcgtcatgctgatattaaactagcgaaacaagaacaaagcacttactcatcgcccgcagaagtcaaattattaagttgtacacgaaaaaaacaggtccctaatacattaattgatatgaccggaattgatagtgcaatggcagcaaaggggtattcttctgcaatggtcgaagaagtttaccaagaactttatgaaaaacattatctatcttatccgcgaacaggagacaaggtgattactaatgaccagtttattgagttgatgaataatgctgatcaaatcgcagctgtaattaacgtcgatcaatcgcttttaacacaccgacaaccaagagaaaaatttgttaaagactcagcgactcatggggctaatcggcctggtgaaaagattcctgaaacaa

SEQ ID NO: 50 - DNA, 165920 bp, Artificial Sequence
  Based on Lactobacillus reuteri
atggcaactgagaatgcaatggcaattgtaaaagctgctcgaagtgataataaaataactgctaaagaaattatagaagaagtattttcagattttattgaattccatggtgatcgtaaaggaacagatgattcagcaattcttggaggattggcaatactttcatctacaccagtaacagtaattgcgactaataggggggaaacagttggtgaacatttgagtacacattttgggtgtccaactccaggtggctatcgtaaagctttgcgtttagcaaagcaggctgcaaagtttaatagaccaattatatttttagtaaatactcctggagcttatccagggaaaacagctgaagaacaagggcaaggatctgcgattgcgcaaaatattatccaaataagtcaacttccagttccaattattactattatttatggtgaaggtggcagtggaggtgcattagcattggcttgcggtgatcaggtgtggatgctagagaatagtacatattcaattttatcacctgagggttttgcctctattttatggaaagatggatcacgtacagaagaagccgcagaattaatgcaaatgaccccaaaagccttgctaagacataaggttattgaaggaataattccagaaagtaaagatcacaaagtaacatgtcgagcaattgctaatattttagataaacagttacaagaattaggaaaactttcagcggtagatttattgattcaacgaaaagaaagatatagaaaattttagttagtatagtaagaggagagaatacattacggtgcacgacttattatcgcttaatagaattaaagaattatataaagagaaagcaatgacaaattgcaactttttttactttaataaagtagattctactcaaaaaatagcaaaatattttttagaccatttaaatatcaataaaccatgtactatttttgctggaagtcaaacgagaggctatggtaaaagaaataggctattttattcaccacaaaattcggggatttatatgagtataattattccacaatacgaaatgcaaaatgaggatattggtttattaacaatttcattagggagtggaatactagaagttttaaagaagtattatcctaaaaaaattttttatttaaaatgggtaaatgatattctattaggcaaggtgaactactcggccataaatgaccgagcttctgggaacacgaagtagtatttaggatattacacaagtattcttgctacctaacttacagaactccgttcttttaccaaggctagttcctagccaacggcttttaatcctttttgcaagatgttaactgccgcattaacatctcggtcgtggtgaacgccacactttggacaagtccattcgcgaacttcaagtggcttcttgccactgttaaagccacaatgcgaacagatttgactggtatagtttggtttcaccaagactagttgtttgccataccaagcacacttgtattccagcatcgtccggaactgataccaactagcgttagcgatcgacttcgctaagtggtgattcttttggagattcttggctttcaaatcctcaataacaatcacgtcgtactgcttaactagagccgtcgttagcttgtggaggtaatccttgcgcttgttggcaattcgttgttgataatgggctttaacaagtcgggcgcgttgccagttctgataatcattgagtgctaacttggtatcttggtggttgtgattccattggcgaacggcaacggttgcccggtggcgccgcttgctgaatttactttgccacttcgttacttgatgttctaacaatttagcgttgaaggtaccgtacttgacaccatcagaactaatcgcaaggtcggccaggcctacgtcaagcccgaccatttgccccgttttcggtaaccgttcaacggttgtttcaacttgcagggagaggtagtaacgacccgtcgggtcataactgaccgtataacgcttaattttggcctcaccaataagagtcgttttactcgtgcgtatacttccgagttttggtaattgtaaccgccgcttggcaagtaccttgcacgttgatcggccagtgtaggcctgataggccacatggcggctcttaaagcggggatagccaccttggtgcttaaacaatcgtttaaaggcctcggtaagattatggttcaccactaggaaactggtggaatcactttccttgagaaagggatattcacgcttgagctgtttcaagaggtagttcataccatactcattgacgaagtggctactgggattgttttggtaacgctccttagccatactgagcatttggttccaaacgaagcggtcattaccaaacatttgccataactgatcccgttgggattggttagggtacaagcgaagtttgatccctttaatgaccttgttcattctagttccacctcctttttccgttgatcatcaatgtacttggcaacggcttgttcattaacggccccaatactttcaacatagtaactgggcgaccacaagtgacggccctcctttttccaatagcttcgctgtaattccggacattcccgaaatagctgataggcagtaccgcctttcagccaacgaacaatattcgtcaccgataatttgggtggtgcactcactaacaagtgcacatggtcgtccttcccaatttccatgtgggcaatttcaaagccatatttagcggcgatctcatggataatccgtttgaaggcgatctcgacccgaccggtaaggactttgtttcggtatttggttccccaaataatgtggtaattaaggttgtagaccgatgttcggccatatgtaagtctgtttgtatctttcataccaacgattataccataattcacgtttcccatatacgcccgtcgggcgtaaaaaaggggggcaattcatcacgtccttaaaagaacgtgtttccttgccccttttcaaaaaagttgccggaattattatagaaagacaattagatcttaatggaattgattttcttattattggtataggtataaatttgataacagctgtttttcctaatgaattaatggagagtgctacttcgattgccagtactatcgatatcgatttcgacaaattaagtgcggatttagtagctacagtttttttagtagtttctaactatagaacaaaaaagtttttagatagttatagaaaacacttaattttaacaggaaagaaagttaaagtaaggctaaataataaaactatacaaggaacggttttaggagttagtgataacggaggcttagtattaaagtcagaaaacaataaaattcaaacgttaatgagtggtgatgtaataaaagttatatattgataaaatatggacctttagctcaatgggtcagagcaaacggctcataaccgttcggttataggttcgagtcctataaggtccattcttatataaattgtctagaactttttggctatcagcaaaaaaagttaatacaaaaagagctaactttattcaattacttatttttcttcccaaatatatcaagccagaggtgataagctcgcttttcatcacttgaaagtgagtttatcactcggtcgatggcctgatcgacagtttcgttctgagtagagatactcagtgcgttttctaacgcgttaattttcaatactgtttgcttttgcaaccgtaccgtctggtaggacttacgcccgctcttgggcgacctactgggcgttttttggttgtcgttgcagtgctgctggtcgacttgcttgcggcctcttccagttgctgacttaccttactagggtcatagctttcttttggtttagcaatatccgtcttaacaatcggacggggaactttctgttctttcttcttagtgcttttgtcaaattgaaactttgccattattgattctccttaatacgttccacaatttcgctagtgagctggttataaatatagtggaaccgactatcatgcatatcgtatttgataagattcttttcggcgattccagtccggtcgtagcgcttcaaacggataacttggtcaaacagcatatccttgccaaagtcctcttccgcgtccttaataatctggttgtccagtccagcgttatttttcagtaagacagcaagcacgccgagaatatcaaagttaatttcagcgtaatcattgtacatttgctggaggtactcaaagaatgtttcagcgccatccagtgacctttgctgcttttgcaacacgataatgatgccatcgttggtgtagatagcggaatcagtaaagatggaaagtgttggtggcacatccaggataatgaagtcataatcagcgtttacttttgcaagctgcttggtaaagtatgaaatccggagctccttaatccggtccatttcggcttgtagggaacggctgttgctaatatcaacgttccccttgtctagcatatacttcatttccaaatagtcaggataatttttgaagtcctcagaggaggacagtaagtagagattatccataatctgggtaatcgcagacgggatattctcctcagtcagcgcgaccatcattgttttgttgattttaagctccttgctgttttgtaagccatatgtccgacttagtagttgagtggcatttgcttgtggatctaaatcgcaaacaagggtcttataaccttgccgcgcaagctgataggcagtcatgacggagttcgtcgtcttaccgactccgcctttcatattgcccaacgtactcatgtagtagcttggtgaccatagatggccaccccagtattgggattgtttgatttctggatgtctcttgaggaagataaaagcatttcgacctttgagggccttaatggcgctgcttggcactttactgggtggacaactaatcagtacatgtacgcggtcgggcataacttccattttctcaattacaatgtcattatcatcagccaccgagtgtagtatcgacttcattttatttgatgactgttcagtcacgaaggtctgattacggtaaagtcattaatttagctactgcagccgcatgtgcgtcttccgttggcaaatccatgtctctagctgccttttagtacacattgaaagtctcctcatatcggatgagccactccctgcggtcggtctcattttactgatatgagaagccttttcatgagagtggtcgcctgttcagggggcagggagtgggagcatatataaagaaaaaccacctagctaaaaagctaagtggtcgaaatagtcgctaaaccatgctataatattaccagtacgaatgatgaatattatattcaacaattaggctgatagtttagctggttgcgctcttgttctggtgtactgcaatacaccaccagccaagcgcattagagtacaccctcaaggatatcagcccctaaatcttacttgtgcattggtggcagccagtgcacctttttattatatcattttatggctggttatactagctatattcttacagccacaagggatttcgagctttgttgtttagccgcaatcaatttggtcaagcagtttctctcggctaacttgatccaatccaagatatttcagtgtcattgcttcgctagagtgattgagcagtgacattactaagccgatattgtagtttgattgcgtgtaaactcgatatgctccggttttacgcatggtgtgggtaccaagatagttgatgccaagtaagtcgcctgttttggccataatcttatagaattgtttttcagtgatatgttggtcttgatgagtgattgacgggaaaagccactcagattgtatattattgttctgaagccacgcataataatccagtaaatcctgtttaaccggttttaagtataaaatattgggtttattagtctttttatcgcgaatgtacgcgtttttcttgatagttccatcgtcatcaaagatttcatttcgtctgagagctaatacatcactcactcgaagcaatgttgccttaccgatttggaaaatagtgtagtttcggcggccatagcggaaattattgagtaaagtgttctggacttcatggagaatgttggtatctttgatgggtagaacgtgttgtttcatagtgattgccctttctggtgttcgtattataatataagtataagagatggttgatgaaattgttcatgggtttcaccaacacaaaagcccctcggtaatccgccataattaccaaggggctttaattgtgggttaagctgtcactacttgcctatcgcttgcgatggtttaaccaatacgccacgcaaacgggaattaccgctaatgataattgtgctaggtaattcaaaagaggattagaaataatgtgttacaataattacagaataagaataagtagcagtgcatgctagcgaaattaaccacttcgcaccagctggtccaggagcaccttaactaggtgctcttttttattatataaataacttttcagattttattactagttgtatgattaataacagttaaataaagaaattgaggaattataatgaaagcatttcgtgaagcaatgagttggattattcccattttaatcgggttaataatcgcattagtaattaagcagttcttctttcaaattgttcgggttgatggaccatccatgcaaccaaacttacaaaataatgaacgagtattttgtttgaaaactgccaagatccatcatggaagtgtcgttgtatttgatgctaatggcgttgatccgcaagtatcagttaaaaccgattatgttaagcgagtaattggccttcctggtgatactgttagctctaagaatggaaatatttatgttaacggtaaaaagattaatcaagactacattagcaagagtcaacgaacaaccggaactggaaactggacattgcgtagtatttcagttcagaatagttggctaaaaaataatggtgccacaaaagttccgaagggtgaatactttgttcttggggaccaccggagcgtctcaaatgatggtcgttactggggatttgtacctaagagtaagattgaaggggttgtaaaagttccatcatggactggaacaaagacgactcgcgaaaatattaataaagaatggcaacacttctatgataaataatatttagtaggtagactttaatctaccagtaataactgcccaagtcttttagttaaggcaatttaaattaatagcttaaattttgatcattcatttacgagcatatcgtatttgaatgattttttgtttccggaagcttcaacttattaattgctaagtagcgaaatagttatatctggggatgttttcgagggtcaggaagggtggaatttagatcacttaaaaatgcactatgtagcttttatataacttttatgtagcttagttatttacaataactaaaattcaatatatacttacagtgtaaacaaaaaaagcacatcacaatttgtgatgtactttattagctaaggctgttcatcgtaccttgctatgctttgtttagtgtttgttcttggtcctgctgcaacaggacttttttagtttaaatgacaaatgattgcaacgatagtcatacaaagaattgcaaatccaatgagaccaattaaagcaagctggactagttgtgataatccgtgcattgcttctacaatctttgccaatccgcttaaaggattgaacaatggtatgctcctttttaatctcgaagcataccttactaaaaaagtataactccggcatagaaccacctcactttctgattcattcaaagtgaacatagcaaggtgttaagccttagcatactttaagtatacttattagttatttaaattacaatagttatccacaggctgaccaatttttatcaaaacatcacaaattgattctgctaaaataaatacataatgataaagatgccggcgtgcaaaatggattcagttcgttacttaatccgtaccggtaagcagggtgccttaatcggcatcctgtttttgttacaataaaatgataaaagagattagctatagtaaaatctaatctcttctaataagtgaattatattttctaaagtgcaacaattttgcaacaaaattggatctatctgttgttttttatgaactttagtctaagttgcgcaacttacatataaggctaaagcgctaagcaatgggggctaggagaaccaacctactatatgataaataatatttagtaggtagactttaatctaccagtaataactgcccaagttttttagttaaggcattttaaattaatagcttaaatttttgatcattcatttacgagtatatcgtatttgaatgatttttttgtttccggaagcttcaacttattaattactaagtagcgaaatagttatatctggggatgttttcgggcgtcaggaagggtggaatttagatcacttaaaaatgcactataggaaaaattatctgctatctgatgactagttatttcaagctcattattccagtaagggaggcctaatacctgtggaattgaatacattccctttggccacctatctaatagctgtgaaataagagatagagggagttcgtcaagctgtagttgggaaatgaattcggcaacattttgttcatgtattgctatatttagggaatcgacttttcgcggttgtttatccatccactggttaagttgaaagtttatgtttctctggggatgagtaattaaactttgcaaactactatgttccagatctttaaaatgagtgtatatagtttttgcgtattgaacagttaaccatcttagttcacataataattgatagttattatctagggaccacaatggttgtaaaagaacaggttgtcggaaagtataataatcattccaatcaatcatatgcttgtaaaggtttaatgtaactgcagtcatttgacgctcacgatgtgggtaaacaataaaaggataaccatatttgtcgctgctatgagctaaataggtaagattatatgtttgcataatggtattaagctcatgttcatggccaaatagaatcggttgatcgtaataaacgtttgctgctggataaaagaagtgaagatatccccaaatttcctgttggttgatacacttcggtggtaaataacgggggaggcctttaccttgcttattaacaagagacgtattaaacatccccaatggactgctaaaaatatcaggatcgttaagtgctgctttaagcattttgcctggaacaaaattaacttgccattcagaatgattattaaagtactggcagaaatcatccagtgtcttagtgtaatcaaataagtaattgctaccaagcaagaattcagctacatcaaggtatgcttcactcactcctgttaaacgcacttgtaaattagatgcgtgttggtataaatcagatagataaattctttgtccatcaattgttacataagtttgcataattcgattagcgatgtttgataatttgcgtccaacgttattaaactccttaacttttgtagttcgaagtgatccatcggttacggcaattaccatttcaatttccttatcaggattttgtaaagcatattcaatgtagttacgaacctttgatgcttgtcgatcgttagtctctgttcgattatctaattcgataaatagttcatgtctccggtcgtgtctattaaaacttaccatcatatctgcaataaaaggcattgcatcatgttgagcaaacttattggcaaattggcgattaaaactccggaaatcaaaatcctccaaggagaaagtagggttgcttattaggtcgatagccttatagaaatgtccaatgaaattatcagagaagcgcttgggttcagaacgatcaaataatgagtgtggctgttgatctacataattaattcgtgatcgataggaaacggattgatgttgctggtagttagctaatcgcaatagtacctcaatatgagcattagttaatgtaaattgagagaattgcttatcttttagcaaagcttgagatagatcactgccaaccggaaacgagtgggggaaagtagagtccaaaactattgtttctttctctttgggcttatttagtgctgattgagaattacttaaaggtattttctcgatattagagatggccggccaccggacggcccaggatttataatagtaatttgctatagtttgatggtcatcggctaccagaagcttattaacatggtcaggcaccgcctgaccttttaatttaccctttctaaggtagaagcgaggatatttaccccacgctctgtggtaacctcccccataattagaggtattattaggggatgataatgatatttggcgaattttagtgatattcccgggtaatttgcgcaagaaaagaggggaagttatccactcataggagtttttaaccggtattttaacataagtatcggctttttttaggtcgatttcatgcttattatcattgctaaatcctttaatatcaatgcttttagacctcttatatagggctgaagaacctatgttttggctgtgttgatcttgttcctttcctgtggagatattgcgggaattatgtgctaacaccccgttgctttggaggtaactagtctttttcggcgttttattattatcagatggaggtaaagacattgattggtcccgttgattagtaaaataatgactatttgggttaatatttgctcctaaaaatcgagacattacacttttattatctttcttttcatgatcattacttgttttcgattgattggtaaaaaagggacgcgttttatcatcaaaaaacgaggattgattagtagttagtttatcttccatatcttgaattccccagagtttttctaagtttaataaacgttcatcaaatatcttttcagctatcggttcttcagtagacttcttgtcttttttattatgtgtatagttctctccaggcatcctcccaacggttttatccttcttttcagataaaccttcatctttacttagatttgccctagagtgcttctgtaatgcttcattagttacacgatctgatcgactactacgattgccttttaatagtctgcttatctgaccttccctaatcgttgtaataaggtgtttaactgcagatacagaataatgaaaatctgctttagtttggggacgagtagatgaaatcatttgaacatctgttcgcccagtggcttttcttaaatcgtaaggcttttcatccttgtccaagagattcttatcagttcggacgggattttgctccctttggttggctgttgataaaacagaggtcggtagcacggttgagttgtttagtaccctgatcaaagtggtataagcatcccctaacaagctattacatggcagtattttatttacttccaggggatataaccgccagtaatgtctagaccttaactgttgtttttgctcatctctaaatacgtggttgtctcctgttcccacttgctgattaattaaccattctgcatccccaagtaatcctaagagtctgtctaataaaagactattattgtttgtgagaatagggagattagcggtgccggtcatccctgaattattatcattgttacctggatgcggtgaatctttactcgaaacaaaatggctcgctggtagctcactatcaaataaagttcgcggtgcggtatattcggataggctagtctctttggctttacaagaagataaacctaaatccattactcgaattttttcggtagggagattcactaataaatgaatttgtagagaaagtggcaacgcaaataataaagaatcatagatagttatggaaccataacatactgataaaagaagattaagtttggctgttaataacgatataggattaaaattaacggtgttgatgttggatagacgttctttatttttattatcagtgagagtgttaatgtcgttttctctatagctatactgactatgtttagcggggttaatattatttgataattgactattatatggattacctcgtacagataattctggttctgtaccgttaactagtaagtatttatctagctggtttgttaggcttactattccactaccactggtacttgtattaagtaacatttttcgtagactttctaattggtttttatccaacgtaatcgtagaagtctttgctgcctgttttagtggctgggagacatcgttctcccagccttcagccaccggctggatttgttttgtagatgccggggccaccgtgcccggcttcttgttatcagttgtgccagcatcgtctggcacattaagagtattatttacttctatatttccattaaacattggattgctgtaaatagtgtgttggttgtttaaagtcatactactagtcatggtaccaaatgtacggtacttaaaagtagcagcatatagaccttgcacaattacttctattgcttgctcattgtggctattaagactaattacaggactttcacttgcttcctttgtccataaatgttggtccactagaagttgtctaccattcttattcaatatatagacagttcgtaacagactatttgttgtctgttttttagatttacctacttttttcattattccaccataactacaccattcacgtagaatagaacgtgtcaagatggttggataatggctacagatagaccagagcatatctatttggtttatgttagcaaaaccaagatctccaatcatttttagtaacaataagttagatttagtcaaatttataggatgcttatgtcgtttattggagtattggatcatcagactacttccttccatatagtttatttatgtcttaaagtagcactttaatttgagagtttggttaagtactccaaaaacgtgaattatcaatgtttaagtgacacaaagatgaacgaaatagcatcgatataccactttatttttggtgttatatttttgattttgaaaatgtaagacaggaggatgctttttgaaaaaagagataggaaaacaaggatcaactagagctaataaaattctgttacgttattataaggcgacacattatgcgacttaccatgcctatcgaaaaggcttaacaagggcaacgagattgatagaattggcaattttgattttgatgatttcgactatcatttcaataattccggctacaagaggattggccgattatctattatcattgagtggccttattggagttatctattttctagtttattatcggattaatgctaaagggcgttatcttcggaaggactcaaagaaagcaatgagaatgattgcaacagatggctttgtacccaaatcatggaacatttatgatggggtatatagttatgaaggactagagtcgatagaaatagctttcgtgcaggatcatagctatttgaaagatatctggagaatattgaaggataatcgtcctacattaccacctgctaaaagagatttagaagcgttacgtgaatatattcttcgtctacaacaactagagcttcaagatgaactaggtattcaaattaactacattggttatggaacactcgatggaaaattagttaaacaattaaaggaagcacattttaagctagaagaaatagacgatgattttattacaaaaccaggccgtttggattatggagctgctacaggaacaataaaaaacgcctttaggaattatcctaaagactttaaagcgtatatcatatcttttgatttccatacttatctgaaacttcaagatgagaaaaaacatcaggataaattacgtgcacgtcgccgtactcgattaaataaccttgcatcgtctgaggcaaagtagtcaaaatagtaaagacgatgctataataaaagtgtacgtttttatgtgttttaactttttaatagcaagtagtctattttatttcgtttctgttttgctaagtagcattttgaatttttattgtttatgtcgtttttatttaattttttattttagaaaaggatcagctttttgtcttgctggttcttttttattaggattttaatttatgtctaactatttaattaaattatgaggattgaagcagctgcattggtagctgtttttatttttaactggatattggaggaatttattatgagtaatattgaaaaaaaggatattcgttttattgcagtcaattttgatgaccaaaatgttaaggattttatgagtaacaatacaaatgcctttactgaaattgacaaacaaaagtttgatcggtcagttgatggtttaagtactagctatcaaaatatgaacaactatgtttcattaattggacggctagttaatagtcctagaacaattacacaaggtgatcattcttttatatatgctagtttatcggtagaaagtgggtattttgataagaaccataattaccaaaagcatgagtttgttgttccgctacgattaaacatgaagcagaatcgaatcatgcttgctcaagctggagacatgcttcaagttacaggtcgaattattcgcttcatcggacaagatgaacaagatctgcagaaagctacctcttattattatcttgatgttattaattgtggtctattgattggtctttcaaccattcaaaaaaatgtagtatacctcactggaaaactacaaagtgatccagaaattattctcaatcattcacaaagcgatactaaatttgtatcagcaaaaattgtaattccagatggttatcgtgatggtaatggagaattccataagcatactgaagttattatggttaggttttacaatcaaattgatgagataatgactgcaaaacaaggagatacagtgcatcttaccggtaatcttagaagttggggaattgttgacccgcaaaaagatacaatgagggcaacgcagtatttgtatgtaaatgttaaaggatttggaattatgtatggatcgtcaattcgtaaacaggttaaggcaaagttttatcctaaaccaagaccacaaactacaaataatcaaggaactcaagatataactaaaattcttgcaaatttaacgccagctcaaaaagcagcattgtttagtgaattaagtgtgggtaaccaagaaactcaaccggcagagcagcatacatctactactcaagtgacatcaaatgatgattttgcaaatcaaaatcaacaatcaatggtagaacgtgagttggtttctgatcaagagaattatcatacttctattcaatctcacactcctcattcaaaagataatgaacgagagaaatttatagaattaagtgatgaagatttgcgatctgcaatggagaaattggattaaattttttgctaaaaaatagaaaaaacaggatatgacgtacgaaaaaggagggttacgatgccttccttttttgttttctaaaaaattttacattttccacaatattattagtttgaccttattattaaggtaatcgataaaggaaaaaggaagtagggaagatacatgataagcggattagatttttccagcgaaactatcgcttccactgagaaaaaatatattgaacaattttataaaagcgatgatccattgctttcagatagcattagatactacagtatcttgttccttacatttttacagactcatgaggacaaaaaattcagccatcaagatcgtgctaccaagaaagtgatatttgataaagaaatgtctagctttcggacagctatgcgttatgcctttaataaaggccatcagattgcttttagtctcttgcttatgaaacaatcacaagaatttagtcaagatttttttgaatcacctaattcacacgacgactttttgtatacttacgagactatggttaccactgatgtttttaatgatactttgcgaagagatgccattgataatttaattaaatatactcgacgtaattttgaaaatgggtataacgaaattataagtttgggcactcgcttttataaaaaaggaattggcgttggatttgagcaaattcgtaaatatattgttcaacgagattataagattactggatattcaaaaatgctaagtgtgccttataatcagagctttactgtgacgcctgcttttaaagccactttttcattggaacaccaggactatgaagagtgggatctgcattgggatgaaacatatggatttaatgctgctaaaggtatgcttgctaaagcaatgattaatcgtcttaatgtaggagacgttcgctcgtatgcacagaaggatgcctcaacatataagatgattaatcaattttctagtcaggattttcaggacagtgatgtagtttacttaattaggattgattttctagtaacagatacagaaaattttccgcgtttattgcagaacagtgaatacaatgcaataaaactagcattaaagcagacaattcgcagacgattgaaggtagacaacagtcatttatttattactaattaagaaggggagagcttatgaagaaagtattgcttgcaatggatgaaggcattgcttcaaagcttgctccaatgtttgaagaaaattctcagtcactaaaggtaataccgcaatgtgtaccttactgcagaagcattatacagtcattatcgaggtttaaaccggatattttattcttgtctatgaaacgaataaaatacgataccaaggatagtcagcaagaactatttaacactatctataaaattaagactgatcctgaattttctcaggttagaattgctgttcaagctagtttgcccaagaatgatccgtttttaagagaacttgctaagttacaagtagaagatatttttattcctgatggtaatggtggaagcattaatatgctgaacgtcataaaacagttgtctaaacctgcaaacttaaagaatattgaccggtttttggcaataaaagcacctaatttacataaaaatgaaatattaggaaaagaagatcatattcaaaatgataacgaaataaaggtagaatcgcctaaaaagaagaccaaaccaatagaggagaaaaatgaggagaggtcgcctaaaaataaaagacggattaaattagagcgaacagcaaaaacaaatcaatctaagccagtcaaaataattagtaagactaagccgtctcctcaaaaaaaggtatctatcccacgtcctatcaagagtgaacatacatcaaaagtggaagtggaaaaaaattctgttccagaaaagaaaataaaaaaggtacaaaagcctcatataagtcatagtaaaaaaaatctaacccaaaaacatattattgttatttgtatcttattagctgtctgttttgttagtgcttatatttttcatttaagtcgttctgctattaacacacctccatatacctctctaattaaccacggaaaatatgtgcaggctgctacttattatccatctaaagctgtagaagtagaaaacaagatgcttaatgacagcaatgtaaaggataaagcaactaatacaagtgaaattgcagatatttcagatgcagatccaataaaatttgatgatgcttattttaatgggaactttaataaggttgttactatctacgaggattctaataatcagtacttactaaaattgagcaatgcacgtcggacaatgttagcttatagctacatgaaaactggggatgtacaagatgctaaggaagtagcaaaaccgttaaataatcaacaattaaatgacaagatcaatgcctatgagaaatttcaaaaagccaattcaattttgcaagacaaattgaagagcggacaattaaatgattctgatcgtcaaaaagctcaacatgaaattcgaaaaaataaattagcaatgaaacagctataggaaggtatgaaaatgaaaccagttcgtaaagagatactcctaaagagtgaaagcgcaaaagatacagtattaaaagcaaaaaagaaagaatataaacaaccatcagctaatactcataaaccaggacaaaaatcctcgcccaacaaaccaagaagaaaaggaaggtctggagggaaaagaagaaataatcgtcaaaaaataaataaacagcctaatgagcaaaaattctttaccaaaaagagggtaataggaactgcagcaatcgttggagcaattggtgctacaacagtttatatagcagaacaaggccaaaacactacgaagcaaaatttaagcgccacaagtaataataacgatgactcaactttaggatttgggacttcaagtaaaaccaagcgacattcttcagacaatcgtgataagaatgggactaatcctgaaaagaaaaaactcaataatctgcttaatgatactaaaggatcgaaagaaaattctcgtggaaactcgagtgatgagaatgctaaagatagatctgcttccaagattgaagatattttgaatggttcttctaaagttggcggagctatgggaaatacattaaaacaactacttaaagatgctgataaaagtactgcattggcagcagcaattggtaatccggttgatacagctaatggcttgactcaaaatgcagataagggtgttcaacaaacgttatctactcaaaataatgtagaacaggtcaagggatcagaaaagtcggcatcaacccctattagtccgtcaaatacaggtatcataccgacaccaatacagccaagtaatccggctgaaggcataacaacgccaacgcaaccaagcaatccaggtggaggtacaacaacgccaacgcaaccaagcaatccaggtggaggtacaacaacgccaatacaaccaagcaatccaggtggaggtacaacaacaccaactgaaccaagcaatccaggcggaggtacaacaacaccgactgaaccaagcaatccaggcggaggcacaacgacaccgactgaaccaagcaatccaggcggaggtacaacaacaccgactgaaccaagcaatccaggcggaggtacaacaacaccgactgaaccaagcaatccaggcggaggcacaacgacaccgactgaaccaagcaatccaggtggaggtacaacaacaccgactgaaccaagcaatccaggcggaggtacaacgacaccaacacaaccaagcagtccagacggaggtacaacaacaccaacacagcccgaacaacctgacagtagttctactccgggatcaagtgcagagccagttagttcatcaagtagcaaaccaggatcaagcgcggaaccgggtagttcatcaagtagtgaatcagggtccagcgcggaaccgggcagttcatcaagcagtgaatcaggatcaagcgcggaaccgggcagttcatcaagcagcgaaccgggatcaagtgcagagccaggtagttcatcaagcagcgaaccagggtccagcgcggaaccgggtagttcatcaagtagtgaatcagggtccagcgcggaaccgggcagttcatcaagcagtgaatcaggatcaagcgcggaaccgggcagttcatcaagcagtgaatcaggatcaagcgcggaaccgggcagttcatcaagcagcgaaccgggatcaagtgcagagccaggtagttcatcaagcagcgaaccagggtccagcgcggaaccgggtagttcatcaagtagtgaatcagggtccagcgcggaaccgggcagttcatcaagcagtgaatcaggatcaagcgcggaaccgggcagttcatcaagcagtgaatcaggatcaagcgcggaaccgggcagttcatcaagcagcgaaccgggatcaagtgcagagccaggtagttcatcaagcagcgaaccagggtccagcgcggaaccgggtagttcatcaagtagtgaatcagggtccagcgcggaaccgggcagttcatcaagcagtgaatcaggatcaagcgcggaaccgggtagttcatcaagtagtgaatcagaatcaagtgcagaaccgggtagtgatggttcatcaattactccaattatcaaagaggaagctgcccaagcaaccactggcttagggactgatgcaagtaacaatgttccgctagccgaaaatgttgagatttcttacaataaccaaggcccccaaaaagttgactcatttggtacgggatttaatgacgaaggtcaatatgtaataaaggcaaatgttgatcttcaagatggcagttcatttcctttaataaagacagtaactgtgactaaagacgctcttctgcatgatgctgatattaatactgaagtaaagcaaacgttagtatctaagccaataacaattaaaactggtgacacattaagcctgtttgatagttatcaagttacagctgctaatgatgcaaaagttacttcaaatggaaataatggaggtatagttttaaatcaaccggggaaatatcgaattactttcagagtgggatcaactgaattcattaaggatgtaactgttcaggatagtcaaaatattataaacgcatagtatataagaagggctacgataacccttctttttttcaagaaaggtgaatgaatatgtcaactgttatcttggcggaaaagcctgatcaagcacgtgcttacatgaagggactcggtattcaatttaccggaaaggccacaaaaggtgagggggaaacttttttagatgacaagacggttgtagtagctgccgcaggacatctgatagaattaagtgaaccggaacattatgataaagcatacaaggatcgaaataatattgatattttacctttagttccagaacgtttttcataccaattaaaaggggataagaagcaattatttagtcaaattaagaatgcagttaataaagcggatcgcattattgttgcaaccgataaagataatgagggtggagcaattgcctataatattttgagactatgcggtgccctaaaatataagaaaattgttagagcatatccaacagcattagataaggcagctgtaatgcgacaatttaagcatcttgaaccaataaaaaatacttggttacaggctaaagctgcaattgctcgttcaaaatcagattggttaatcggtatgaatgtaagccgtctttatacttataaattaaaagggattggaattaatggcaactatgcagtaggccgatcgatatcaactactttgaatcttatttgccagtggtataaagaaatagaaaatttcaaatcgcaacctatctacgaattaaaaggtaaaacaaaaataggagctgaggaaattttactaaaatctccaattagagttgttggtagcaacgataggaatgctaagattgaatatattgatagagtcaaaaaagcaggaattaataatagccatgttaaagggattgtaaaggcagttgatagtcaacgtaaatataagatgccaccagtcttaatgacaaagggtgacttatataaggaaatgtcgagggtagcaggatggacccaatcaagatcaaaaaagataatgcaactaaattatcaacaagggtatcaaacttatcctaggacggattctggtaagattacgaaatatatgtatgattaccttgctaaaaattttaaggattatttaaatgcaataggaataaagaatccaggtaatccatttatttttcctgaagaaaagttgaagcattatttgacaacagaggaatctgctggggctcatctagcaatcgttccaacggagaaaattatgaccgctgatagtgatgtaagcgaagaccaacgacttatgtatgaagttgtagttaggaagtcacttactttgttagtggtcccatatacctatgtttcaaacaggctaggagtacttgtaaatggtaaattgccattgatgactcaaaatacagtcatgattaattcaggatggaaaggtttactattaccgggaaaaaagaagtccaatacggctgagaaaaaaggaatcgattttagaaatatactaaaaattaatgatgtgattgatgttgtattaattaacgtagctgataaaacatgcccaccaaagcctcttaaatcaattcagatttatgataaaggcggtttaatggagaatgcctataagtatgttgaaaatgaagaatatgctaaagtgcttaaacaagttaaaggattagggacttcagcaactcgtgaccatgcaatggctagtcttgagtcgaagaagtatgtatcagttaataatcgggatataattacggttacccctaatggctggttaataaactggcttttaagtaattcgcaaataagtgatccaattcttactgctaaatgggaagaagcatatatgcgaatagctagtggtgagataagctctcaggaattgattaatacaacggctcaattggtatatgatgaatttgattccgctaataaaaactggaatgcgcaaaagcttcggaaaatttataacgaaaaggcagaaatttttaataaggaacaatcgataggaatatgtccaaagtgtgggaaaccagttatcttcgttaaagatcaaaaaaatgctggaaagtatgacgcatatcgttgttcaaataaaacttgcgattttgttatttattataatttccgtggaaaatcaatatcggcaacaaacatgagtcgaatactagatggaaaagcaacaaataaaattaaacaattagtaacaagaaatggaacgcattatgatgctaaatttaaacttgcctatgataaaaatcatgatcgctattatctagaaatattcaaagaacataaagactaaaaagcctgctcttgaaaaaatagagcagacttttttcgtagttggttctttgcctttgatataatttagctgtagtcaaacgttagtaggtagcttgtaattttcaagctgggcatatgcagcaatgctgcgataatagcttaatgttttttgattacagtgcaatttttccattaattgttgatccgttaaatcagtacgaagaacattggataagcaaaaactcatccataaattcgttggagaaagatccaatcctaatttttcttcatctccgttgatttttctgttaagtgaagtgaatgacttgatacgatggtcctcattcttaaagcgagtatcctgaaaaagatattgctttgaagaaattggaaaatttggatgtttctccaaagcagcgagtaactttgtattattaatttgaggggtaatatctgcccatgtgagagtgaggagattatcacctttatatccgcataagacagcgagaagaagctttatagtttctggtttagcgatctcaataagttcgataagatgattatgccagccaataacatagtgaaaatggcgatcaaacgatagccctttaatgttcattaaaggatagtgatcaattagtttagcctgatatagatatttaaaataagtcttcaagtatgaaatatatttgtttactgttctggttcttaaaccacgctcttctttgagatatacaacaaactgatgaatatcactattacgcacgttattagctgaacggccatcactatgttgatccgcttgaaatgagaaaaagctactaattgcgaacccaatttgtgagattgtagtatcagaaaataatgctatagttttgcaccaatgttcatagttgtcttgaaaaggatacaaacgctactcctccttttgtaataattattactctaactatataacattttgcggaggtttacataatggaaaatagttgtaattttgttggctttgtaaaacggatgtcagatttaaaagagagcaaaagcaataatcattatttgaaatttacattagataatcctgtaaggaattaccataactatattccagtagttgcttttcgatctattgctgaagaatttgataaagaaatttcagaaggagattttatcgctgtaaatacttcgttgaatatcaataactatgatgggcaaactaggtattcatttactttgagtgattttcatgttattgatgtttcttcacaggcctctaatactactgatgaggttaagagggaaaatatcaacgaggagcaaaaacaagaaaaaggagagaatgtttctacagaaaccaacaaaaataatgaacaacatcggataatttcatctgatgacttaaaacgtgcttatgaagacacaattggtaatgaaaaaaaggtggtggggcaagctaaagaagagaaaactgaaacgaaaagcatgataagttcgtcaacaactactccagcaaaccggtctactttagctggacagtctagtgatgaaactgataatggatcatctttctttggtaatagtaatggggagaatgatccaaatgatttctttaataattttgataaacaaaactaactagttttatttttgggcgaaatccaattaaacagggggaaagtaaaaatgcaatccgctaacatcgtagctgcggagtttaatgtctccgtaaagaaattgcgacgtattttaaaaaatgcattagaactagagatagtttctgacaaagtaagctcaacggatttgattaatacgatagagcaccttaataacgagaatagtatttatccaattagtgacgctatcaaagaagttttaatagatcaatataatgaattacaaaacctggtttcacttagagaagtagctcgtgaacactatgtgaaagagagggcgataatttcttttattaaaggaacgctcggaggtatgaagaaggctctagtagctggatactttcagtataatattttcttaaaaagtggggaaccagaagttaatcgtcacaatgctgataaactgatgaatgttttctttactgatctagcaggaaggtccaggcttaccaaaagctttcaaaaggttaatggtaagatgatgagctttaatttactggaagaagtgaaagatgaacactcatcaagaggacatattataggatttgctaaggatattaaccaacgaataacgccaattgtagcgtatagtaaaaagaatgtaattgtctttatgcctaagatcaataaggttaagggaaatgaatttttaagtccttcgcaaatattagatgaaaaccgaccgccaattgaattcatgatcaatttaagtgaaattcaaggaggcatttctaaaattgaaaactcagctttaaatgtattaatacacgctttaaataatcgtccattctctattaactcattaagacaaagagataatctgatatttatcattactactaattctttccgattaaatctagatgaatactatcctcaacaagacgaacttaaacaagatcaacgagtaaaaagagatttatttggagaaatttctggagctcagatggttgagtttttaaatgcacatctaaaatctcacgctagtatctcttgttctaagatgaatgatagtctcgtatctgttaaaagtcagttagaaaaagttacactttttgttgaccgtgatataaaaaaagagctaatcaatgaagccattgctaatcatgttactatctctatgatgatgaatcagtggctttcagttttaaaagttattcttaataaaaatgactatttgggagcatatcaacaagtattagaaattagcaaacagctcaacgaaaaagaagataatgaccgggaaaagcgaggtgcatagatatgaaaacaataacttatgcgcagcttcgtaccggacttatgaatatcgataatgttgcactttcagggagaagggctgatacccttatcgctacacagctgagacctattaatgctaatagtgaaagtaatcatcacaaatatctttataatgtagaagattataagagaactcgtagtcggctttcgtatataagtaataattatgctccaatagctaaaattgcaaaacgtcttggctttagtcgtactactattcgcaggattattaatacctatccaggtaaaataaagtgcgttcagccaccatttgttgcttataaaagttataacattaaggccgttaaaagatatattggtatcagagaaatagctattttgcaacatgatggtaatatctatgttccaatgctcaaggtacgtcttggtgaaaaaattggctatcttattaacagtgaaaaaaataagcgctataaaaataagcactataaatggatagttgtattcaaagatgaaaaacgaatgagtttatcgcagttctgtgaacaggatggacagtttataacaagatcatcacagcgtttggggacatttactcgtcatggtgttgccacacgtaaggaattccagtttgagagcttcttacataagaaacaaatggagaatttcattgactttttaatccagtgggttccaaagaactgctatacaatccaggtctatgatactgaaaagattaaagttaatatttcaattcgtgagtctagttttgtacttagtactaatgtggttccttataacgaaatttcagcttttatccgtgtctttaacaggctttttaaagcgcatgaatgcatggcctccatgcagattatacctaatgacaataaagtaaaagactataaaattacctttcggaataagcaaaagatgatatatctaactctgaattctaaggcacacgaattttataagaaagaggctatgcttcacggagaaacattgaacaactatattgctaagtttctcgaggaagaatttaaaaatggaaagagagaccatatctaaaatatggtaaaatataattgtaaatattatttacaattatatttctgacttttgttaagttacgtttcgttttttaatgcttgttgcattgctacttttgtttttttgaagcatatctaaaatttaaataaattaactaaggacttactagttaaagctaggggtccttttttctttttggagggatgcaaagaagttatttgctttttatttgtcatgaaattaggtagaaaggaagttatttatatggataaggaattagtacaagctactcaagaacttgttgattatgcttggaatcaagatctatcaggaatcaatgttgggttatatttaaatgagcaacatgagtactgcatttatactgattcagatgcagctcaaaatggtttaaatactgcggatgctttaataattattaaaggaggtattgctcaggtagatttggtgcaattcactttgatacagctatgtcaaaaactacaaagaaaccaactagcttatttgtataatactttgattagcaacaaagtaatcatgccaggtacaccagctaatgctatcaaagttactccaccagttgaggccttcatagctgcactatttccacaagtattagatgatttttataatcaggttgtaaaacatgctcaattaaaaaaggtatgcgaaactattaataaagatttagttcatgaataggagtaataaattatgggagtagataataaaagaacgttaaataaatgggttgtacgattggcttatgtaatgcagttagataggcaaagtagactgatgactaaagcattattcgatgaaaaccatttagacgtcgatctcgatctcactagcattaacgtttcttttgataataaggttaagctcgctatttacgagtggtttaatggcttgccagaagatttgcttgaagtacatggtataaaaagaacttcagctgactttgaacgtctttatcaatttccattagaaaaataccttcttatggatgaagaacagctaagtcattatagatggtaaattttctaaagcttattagaagagtccttcctcgggagggcttttttatttttaaacggaattctaatttgctagtcattatcaatattttgaaaattttagtaatcctctttttacagatatttcagtcatactaaaaatgaaaaaatttaggaggaaaactatggattcacttgtaccaaaatatactaaccaaactttgagaattagcaatgatcttatgaagataagtgaacttttaccagtcgagtgtggtcacgaaccagtaaccctgattgaaggaatttattgtatttgtgactccatcaattacggggatgttgatgatagttctagtgaccaatatatgcaattaattgatgatgtggccattaatcttaaaggattaccgctttattaccatatacagttattacgtcagtttaccaataattattttgaaaatatattaaagattcaaccgaagcgaagaaatcttcgtatcgttgaacgagttactaccgatatgattaatgaaagtaaacaagtactacagaatacgaagaaatgtttgtcaccatttgaattgttatatctatatgctgattcaattattgacaataaaataacggctagtccacatcaatatgatgatttcatggagattaaagatcatattgcaacacaaaaagatgtagttcttactttccttgataaatatgaaaagttgtatggagatgcgttaaaaaaagaggcacaaaagtatgctaaagcataggcctctaaagattatagtaatttgttgtctactgttatttatcacggtgttatcagggtgtgctcatcaggatgtattaacaaaaaaggagcttaacaatagctttaatcagagtacagactatcttctggaaacgcgaggaatggttgccaaacagttaaaagatcctacagtgaaaaaagtaacagtaaccactaatcaaaaaaagtatattgagcattatcagcaacaagttcgtaagcaacaagagataattagaaattcaaggtatttaagtaactatccaagaagtgtgtatcagtacaataaacaagttgtggcctacttaatagctgttaaaaatgaacaaagtcctcaaaacattaatagaaattttcatagtgtcactaagataggtacctttattgttgttaattacctaagttcaaggcctacaaataattaccgattagtaatggctattgatgactattcacgtacaaatattgatcaccaacgttccactgctaaacagaaaaaaactacacaatatcaacagcgattgttagttcaagcaaatattatgcttggaatttttgctgtaattttgattattttgatctatatccaaccaagtcatcaaacagacacacttgaagcactaacagatgtgcgcaactcaagatccttatttgatcgtcctaagccacaaggagcgaaccttgctgtaaattggtcaacgaaagtctttctgataattattgttgttttaattttagtaactaattatatgctggggaggtaacaatggattacttaagaacagtatttaatcaacttagaaaagtacagtgggcccgcataaaagtggctgcgcttgatactgttttgtgcatcatagcaatattaatgattgcagctattttttatgggatagatatgggtgtaaatgagtttgcgcaaaaaagaatgtaggaaatggggactagataatgaaagaaaatctagatgttcatagtgagcattacttctacaaaaaaatccttagaaaaattaatcagaaaagtgagcattaccggcatctttctgatcggcaattacaggcaagaacaaaactctttaagaagatgctgaataatgggaagcagcttaaagatatcttggttgaagcatttgcgactgttcgtgaagcggatcggagagtattaaaaatgtatccgtttgatgaacaagtcctgggtgcattagttcttaatgcaggtaatttggctgagatgaaaacaggagagggaaaaactctaacggaaactatgccggtatatttaaatgcgttgaccggtaaaggggttcatgtagttactgttaataattacttagcacagcgtgatgctaatcaaatgggacaggtattcaagtggctggggctttcagttggttataactcaggtgacttaaattttgataagaagaaagaagcttacgcagctgatataacgtatagcactaacagtgaattggcttttgactacttacgagataatatggcgttgacaaatagccaacaattacaacgaggattgaattacgccattattgatgaaatagactcaattctcattgatgaagctcgaacacctttaattatttctggagaaagtgaatcatatccagaaatttacttgagtgctgatagatttgctaagggactaacagaaaaagattatcaaatagataaagaaacaaaaactgtatctttaacacacaaaggagtagaaaaagcaaatcattactttggcattaataatctttttagtccagataatttggtacttactcactatgtgaataatgccatgaaggcaaattatactatgaagaaagacatggattatgtagttaaggataatcagcttcttctagtcgatcaatatactggtcgcattatggttgggcgaagatttgctgatggcttgcatcaagctatagaagctaaagaaaacatggaaattcatgaaatagctcatactgatgcaagtattacttatcagaatttctttcggctatatagcaaattagcagggatgactggaacagcatatgaagaaaagcaagaattctatgacacctatcatatgcgagtggttcaaattccaacccataagcctaacaaacgaaaggatcttccattaactctatatcctacattacagactaaggatttagctattctaaagttagttcagaaactaaatacaaaaggacaaccagttctaataggcactgcgtctgttgaggcttcagaacgaatacataagttactaacccaaaactggattagtcataatgtcttaaacgctaaggataatgagaaagaggcattaataatcagtaaagctggccaaaaaggtgcagttactgtggctacaaatatggctggtcgtggtacagatattaaattaggccctggtgtacgggatttaggtggactatacgtagttggtactgaattacacgagtctagtagaattgacaatcaactaagaggacgtgccggtcgacaaggtgatcctggcatttcaaaattctttgcttctttagaagatgatttaattcagcgttatggttcagaacgattaaaaaagattgtaactgtgcaaaatattaaaggttcgggtaagagaaagaaagcggataagcaattgaatagttggttatgtttgcatttagttaaaactacacaaaaaaaggtagaaggaactaactttgagcaacgacgaaatgttcttcgatttgatgatgtattgcgattagaacgtaattctgtgtatggtcagagacaacagattttaactaaccaaattgatcttactaaaacaatagaggggatgctaggacgaactattgaacgtaaagttaatcaatatgctcaaggaaaacgtaattggaaacaaaaagaattaattaatttcattaatggagagcttaacttggattttccagagaataaaacctcaaagcccaaagaaattaagcctttgaagatgtatcttaatagattatgtgtaaccaagctaaactcaatttacaagcaattaattcagacgaagcaaataaatgagtttcaacgggtgatattactaaaatctattgatcaggcttggaaagagaatatggatatgatggaacaattgcgcttgtcagtttctttacgtggttatggacagcataatccattagtcgagtatcagaatattgctcattatcaatataaaaaaatggtggcccaattagaggaaagggtcactaagaatgttttaaatgcagaaattagacaggcaggtgagacccaatgaaaagaagctcgtacaaatatcgtggcttgggtaatatgattagccgttttgcttatactatcttaattctggttatatatcatttattgtgtctcctaactcttcctggtgtgaatatgcaatcttttcagttggcaagtattatacccgcgattaatttgttaagtcttttttctggtggtaacttcgatcgcttatcaattctttctgtgggtttaactgcatttgttaatgcgcaaatagtggtacaaattttacaatcaggtatttcaagtacactaactgaatgggcaaaaggtggtcaacgcggtcatcataaattaaaccagttaactaaaatattgacgtttatttttagcattatacaggcaacagctgtcctatttggggtaaacaatttagcaaatggcgaatttttacttagtgagaacgtatttgtctatataggtctatgcttattactagcggcaggatcttttattactatatggcttgcagatcaaattaccctatatgggcttggaaatggagtttccgtcatcatttcagctaatattattgcccaatatctaacacaaggattaacaagctatccgtatctgaagttggtaatcattattgctgtggttgttttgatgaccttctttatagtctttattaataattcagagcgccaactaaatgtcttttatgcgaaacgggatttttatggtgatcaacagtcatatatgccagttaaacttttaacttctggagtaatgccagtagtatttgctagtggtgtcatgattattccacaaataattttactattctgttcaggacaagaattaaatactttctaccgattaattttgtatcttttttcttggtcttcaccatatggaattgctatgtattcttgcctaatcattggatttagttttctatattcagagattcaacttaacccacatatgttagcagagaaccttcaaaaacaggaagcctttattgagggaatttatccgggaaatgatacagaaaaatacattattaaacttcttaatcgaatgtcatttatttcttgtgtcattctattgatgataactgttttaccaatggttataggtaattattggttacatatacagtttttaggatcgataggatcaagtttgattatcatcgtaagcgttcttgtagagatttttaagcaagctcgtggccttattcagcgtaatgattatccatcatttcttgatgatcatgttgattttacagaataggttaattaagaggagatactgggatgagatttaaggaagcattagtgaagatactattgatgatagttattattttttcgctttttggtatcaaaatggtttacgaatttgcttattcaccatttcaggtagctatgaggagccaagataatctagtggttttctatcggccaaggtgttctcgatgccatcatgttgcactaagagtgctcagcaagaattatttttcgataaaacgtacttattatataaatgctaacagattggataacgaagaattaaagcaagcgaatctgacgattacaccaggttttagataccatggaaaaacaatacagacagtgaagggggatgaaattgatagaattattaatgattcaaagtaagaagtacaaagttactttaactataatgaaaaacaagacaatataaagaaaacaacatataaggttcagttcataactgattagatttataataaatattgtaaatcggacaaaaataaattaattttcaattaattcaaaaaaaccatatttttttcgttttggcatatttggatttgctacactaaagatgatcaagaaaggggaaaagataatcttcaatcttgtgtacttagtttgttaattaatttataaatttagggaggaaacctatcatggaaaagactatgaaaaagaaagctttagttgcaactactgctgtagccggtattactttagtaggagaggttactactgttcatgccgctgacaatgtacaacaaccggtaaacgaacaaaatgttaatcaatcaagccaagaagaaaagcaagctgctcaaaatcttcaaaatgcacaatctgatgttaatactgctacagaagctaattcaaatgcacaagacaatttggcctcagctaataataacttaagtaatgcaaaaaaggcagttagtgatcaagcagctaaagttgctgacgcaactaaagctcaaagtgatgcaagtaccaaagtagataacgataataaggttgttgctgatgctcagcaaaaggcggatcaagcaactcctgctaatattgaaaatgctaagcaagctattgaaggtcaaaataaggttattgaccaagataatgaaaacattaagtatagtaatactgaccaggataaagctcaaaataccttaaataatgcacaatcaaatgaagataaggccaatgcaacattatcaaataagaagagtagtcaagcaagtgcccaaaacaatgttaaacaggctgaagacgcgttaaatggtactcatcttgtagaagcccaaaatgcttttaaccaagctcaaagtaatgttgagaatgcacaaagtaaatatgatcaggctaacaatcaattgagcgatgcacaaaagaaagttactacaaatcaaaatgacctgactgctaagaataaggctttagataacatcaataatcaagtagatacagatcaaaacaatgttaacagtaaccaagcaactgccgatagtgcttcttctgcaacacaagttgctcaaaatgctgttgatcaaaccaagcaaagtctagataaggttattgaggaattaaatggtttttctgaaaacacaattaaagtacctgcaggtgcccaagaggcttacgaagcatttattgatgcagttgataacaatgccgatcagtctcaattagatagccttgctaagaagatgtatgatactcttcaccaaggtcaaggtacgaatgggatcaatcattttaatagtagtaagtatgatcaaaatcaattggttgatgtcgatcatcttacaacagatcaattaaatgaactaactcaatttgcagctgatatgatcaattcagcacgtaaggcatggggaagcgacaaaaatgctgggactcttattccaacacaaggtgtttcagaaatggctcaacaaatcgctaaaggttacgttagtgataattggcatattagtcaaggtcatgatgttaaacgtgttactgcagctgcaggactaatcgggctaaacgatgcaggtcaattctatgaagatgcaagtgaaggatatgttcatgcatggccatgggaaaaagatagttataccatggataatttaaaggaagcagtatatgattctattcttggaatgctatttgcagatgataatagtggtaatggccatatgactgatttgcttgggttacatgtaaatagaaaagaagatcaccaatacttcggtttaagtacaaatatgtgtccaggttcttacatgggtcaactacactttatcattgttgaaaatgatccggcatatattaaagatccccaaacctttaatgctaaaggaggaacaaccaagattgaatacattgacccgaaagttcaattaaatcaacaaaaagatatactaactactactttgagtactcaacaggctgatttggcaactaagcaagacgctttaaataaagcaaatcaaaatcttgcaaatgcgaaaaagcagttgagcgaagaccaggatcttcaaactgtagctcaacaaaaccgtgactcagctcaaaaagcattaaatgatgcaactgccaaggtaagtaatttacaagcaactgttaatagtttgagtcaagatctaaatagtgctaaagcaactcttgaccaagcaaagaagacgcttgagtcttacaccgctgatcacaaggctaagctagacaattacaacaacgccaaagctgcacttgatgatgctaataaagctgtagctgaagcacaaagcgctgttgatactgctgttaatgaaactaaaattgctcaaaataatttagaccaaaagaaacaagctgttactgatgctcaaaataaattagctaatgatcaagagtatcttgccactttgaagcagaatcttgctgatttacaaaatgcgcctcaaaacttacaaaaggctaaggaccagttagcaaaagatcaaattgcactagataatgctaataaagaccttcaaaaccagaaggatagtctagatgagcttaataagaaacttgaagatgctcaagtaaaggttaatgaggcgcaatctgcagctaacgtcactaaagcaactcttgaccaagcacaagctaagcttagtgatgctgaagcaacctggaaggagttacacaatgatgctcatcgttatgggaatgtcgttaaagtaactccaatcacaatggaagctggtactagtcttcctgatccagttattgaaaatggttttaccgttaatactggcactaatcaactatttgtctcattagctgctattgattcatctaataataatattccacaagggacaaaagcttcatgggctaaccgttctaaagcattgacagattcacagaatgctggtagctactctgaagacattttaattactttcccagataactctactgtaacagtaccagttgacttaactgttactgctaagaagattacagaagatcaaaaagcaacagaaggcggttatcatattgttaatggatctgttgtagataagcagaataacttggttagtggttggactgttaagaatggtcaaatggttgatcctgaaggtaacgttatcaaaacaacaatgtctacagcccaaggtgttactattgaaaaaaataatagcaagtccgggaatacaaagacaaacatgattcaaacttctttaactattgctaacaacaaggcaacaacaaacaaagacaaccagttaccacaaactggcaattacaacaacaatacaaaggtattaggattagctggtattgcacttgcatctgctttaactatgtttggatacaagaagcgccaacataactaattttcttacttgatgggtttctaaataaaaaatggactacttcagctcaaggtagcccatttttattattatagtgaagcagttattcttacgtataaccagactaaaatataataaaaatctattatatattaatcaacatctcggtttaatcgttaaaactcctctgagagctaattgttaatattgagttgtatagtaaatttcggtaaaataaaaaaatgaaatactttccccgaagtatttcaccccgtatcacactaaaatctccaccagactttttagtgaaaaatgtttctttaacctatagacattcttagtatattatgaatgtcttttttattatgttctttacgaacgtatgtacgcacaatgtgctcgttatacgaacgagcgttcgataaaatgtaagatataccgtgttttagatgaagactctggtgcttatattagtaacgtggccggatgtatgcaatcataaaaggaatcgcaggtaatcctgatacattctggatgaatattaaggattatattgagttttttaatccggatcaaattaaagaaatggagtaggctggaaaatatatcaagcaatctgatcgtaggaaagtgaatatagatcagacatcaggtattaacaggcaacttagtaatttctacgagtattatatgggatagagccaatggtgacagaataaacattaaataatgaaaatcaactaatacattaatatggacaataacagtattagtgataattgtgtttagcaactgttttaaatgtgggtgcaatcattaacataattgcaagtctgatcgtgacgaaagaaataatgagagtatttaacaagggggcaaaaaaattatattctggggctacgtcggggtaggtgcctgtttagcatcagtccttataaatatgatttcactagctttctaaattttgcattataaaactgaacttttataaaatgggagagagtccccaccaaaactacggttggtctttttgtattgtctaattgattttataataacagtaaatattccttactcaccgtatgaggatgccagattactatgttatgattagctgattatagttgaatattggcgtaaaatgtaacaatgatgatattatatcttccaatttgaaaggagtaataggcatggtacaagttgacgattcaaaatggacatatctactgcaaagattacacgaacaaagtcataagcagcgtgaaagctttgtgattaacttcatactcatgaatttattatcagacggatatacagatgttaatccagttttacaacaacctataaagcaagatcattcaagtgggaagcgcgaagcaattgacctttatttcccacaaatcaacttgggcattgaaattgatgaggaccaacattttaacgatgagaaccgtatagaagataagaaacgaacgcgcagaattaaagataaattgaacccagttgatattggtagttcttcatacactgaaaagagaataaatgtgcaaaagagcagaagtttgaatgatgtaattactgaatcccgacaagtagttcaattggttgaatttatgatcaacaatgcacgtcgaaacgataattatgagccgtggcttaccatggaagagaggcaagaaaaattcaataagcgtcctgtttatcgtccaggtatgaatattatgtggcgcactcataagctggcaacaaaatcctttgtaaatgctggttggaaatttgcgcttggtcagagtggtttagcaaatatctatagtgacgaaacaaaaactcaaaaaatagcgtcattttggtttccaatcatcaagactaaagaggaagcgattaaggataagagttcttggtttaatgaaattaaagcagaccgccgtgagatcattgaatattatattggcgacaaagtagatatatatgaaccggatttattgccccgaattacttttaagaagggatatgattactatactaattaccacggtaatcagtatttaggcgtctataagtatgatccttcaaagtccacactaaaggaaagacattatgtgctggaaaaagataagtcggtaattaacctaatagaagcaatcaaagaagaaaaaaagagagctacaaagaagaaacaaaagaacaaatagttcatttgagcttcttaaatacaaggccccttctgctattggtactagcaaaagaggtcttgtatttatataaaaaggctccgtatccatgtgtgatgtgggacccaatgccattcgtatcccgtacagggaaggattaatgaaactcatcgagatctaaatcctgctataaagccattaatacctcaacaaaatcgtcatacttgaagttggggaagggggagttgtacaacacaattgtgatattatatttttcacttagatcagtgatagaagcccaaagattgagctttccgtttgagtgcggctagaagtcagcaataatatcatcgacgcgtttaattgctagtctaacattacaagtttgatttttcataaccaatccttatttaacaaagaaacacttatgatacaataagaaaacaagcaagttttaagggcgttggccgattcctacgagctttaccattctgataggaagaaatttgtttaaaaaagaggggggagaccatgaataaacaaactgtcactaatctatcaaagttgcccaatatatggacaaagcatacaataaaaccgaaagctttttcagaatttgatttgcattctgacaatcgcggtttcttaaatccaaaatttgaaggcatagattcgggaactttaggaacagcaatcgatcttggcgcaagatatctcattcttaatgacgattgtgcatttgataatgcaaaaattggagcttttaattacgatttaaactccaatattaatcaagcatatttaaagcaatggtatattgagattggtgatacaaaaacggctaatgaactcagcaaacctcttgacaatgcggcttttcactttaatttaaacaaaagcgtgttagaaaacgctagaaaaatacctctaaaaaatctcgagaggttccagtgtgaacctttaattacaatggcgttctttgagtcatgttttagatctagacaagctcttgattatgatattccttttagattagatagaatgtcttttagccgcattagaactatgcttcaacgatgtgctaatttttttaggaaatatggagcgccaacacatacagactatactgttacagcaaataatgtttttggtgatggtgattatttaagcgaaaactatgtagcagatttcaaaacatataagagatcaccactcgataagccttataataggcgtcagattctattatattatgctatcggtaaatacgaacaaaaataccccgaatttcaaactatacgtcaacttattttctttaatccgagaactgataaagtttatagcataaatgtcgatgatatttctccagatctaattaattattatatagaaatcgccaacaatcccatcttagacgaaatgaaaaatcaacaaacatatagttaatcatttacttctctctgagagcttatttttaatgttgagttgcaagaaaaacttcggtaaagtaaagaagtagatatttctccacaaatatctcaccccaatattcatatactaaagttttctccaaaaaaatttagtataaatatgtttttttatagtctttagccatcctaagcattttagaatggcttttctattatcttctttacgaacatatgtacgcatgatatacttataatacaaacgagcgttcgatcaaattgttaaaggatgattgtaatgagtaataagatataccgtgttttggatgaagagtcaggtacttatatcagtaaagtggccggattcatacgatcagaaaaatatacaaaagttgattcagcctatgtctataataaagagcaagcaacgaagatagttaaattaatgaattatatgcgtacccatatgttgaaagaagggaatttaccttcgggtttagaggaaagtcttcgaaatcagactcttgccattattgaggtagaactaaaagacgtaaaactatctttagaagagattgccaaggctcttgaatcagcaaaagcaaagaaaatacccaaagaacaagcttttaggaatgctcaatgggaaagaattcgtcggtatcacgactattttgattatgatattagtacgccaagtcatcaatatatctatatgcgtaattgcttttaggagatgtttctaaatgaaaggaccaattctaaatcctactaaaaaattattacgaagagccaatagaaaaatagaggagatatacaatccacgaaagaaacaagctttattcgtgtttaccactaaccttgacggctatcatcttacctataaaatgagtttagatacttttgccgccttaggaacggcaatctctcctgttatgataagtgaaattcctgctaaagatatagatagcaaagaatatattttatttctcttttctatttataataaatggaacaagttacccatggtttttagagggtatactccagaccaggttaaatggtttatgaagaaattcggaaatagaatatataatgagaaatctacagttgactggtggcgtaatacttattaaataatactatgaccaagaatattgaatagggtataatataactagttgctattaaaagtaacgatttatcttcattggagctccaggacatcttcccagtcctggacttctttttataaaacattcattttacaaaaggtctggctaaactatgttataatagtgacatactatttaactccctaattttaaatagtatatttccattattaaataacccaggaatcattttggttcctgggtccctttttatctatatgatataatactagagcaggcaagttttaaggaaggtggccgattcctgactggaggtggttcatatggacttcaccattatgaaaggattatcggcacatgagcgcttaccaagcacttatgttaatgttagcatttgcgacatttattatcgcattgctgacttttattttcacattctgtgcataataaaagaccgtcctcatataactttggcgagttgcaggacgatcttttattagttaatctgtaacatggccaccgtctttttaacgggcctgctttttgtgtatctatattatagcatgaaagaggggaattgagtagttggtaaagatgacactaactattatctttctttttgattccattaatttctaaatgaacaataaaggctagtcctagacacaaaataaaagctaaaatagccaacaaaaagggtataattgatcgttgatggaatggaaaaaagttaaatagcataaaagatttgccatagagtgtgttgaatgtaaaacttttgttagctggtatattattaattaaaagtccagaagcaatccatgaccacatataaataaattggaatacacttgacttgactaatttccagcaattttcctgatctctactattgagccagaaatgccaatcatgtataaaatcaaatatgttctttaaagcagcaagtcccataacaaatgaaaatacggcaagtgcagctttgtgattactcccattcattgcaagtaaacctaaataataaaatccatatgtgaataaccattcgttaatagaatacaacgtaaccaagctaaatattattgttaataatataattaaaatggtacataatgtatttttattgcttttcaaatcttaatctccttaattgacactgaaagcagaaccatactaattacttcagttcatctttttttgtttggtttgatagaaaatcatcttaggatgatccatccatgatagtaaacgctttacttgactgacttatccaagaagaatcttgagtggggaagttagaaagcctcattttaaccagtcattaaaattcttgttttaatgccactataaacagtgacgccctcttatcatgcgtcttcatcgtcgtcagcaaaaagatttttccttttggaaaatctacatttctaaaaggaaaaactagtgcccattgactccaaaataaactaggcctctcatcatttataagcgactctgagactctgagtatatgaaattgatttagctcggacgttatcttttatttttctttcaaattgtataagtagtgttaaggggattaattcttctgttggtaaattttttgactatttgataattcatgctaaatctagcacatatatcaataagataacgactattgcaactgccagtcctatcgttaattgcaaaatattactcatgctagggatgttgaactacgcccttgttaactgcaaaattattaagaatttcattttcgcttcgcttcatattttggttgtcataatagcaaagactgattgttttatcctttttaaataatgtatcgtagatcgttggatatagcagtttagttttttgactattatagtcacttcgatatcgttggttaccgtgaccatcaacaggaaggcgcatgatatggtgaccataccatttatctttttcattatttggtgatcgctgattcaaaacggttaatgatgtcttttttataagaggaatctgaaacgcattgacgttatatccttgaggtaattgatggcttaggctctggtacaaggtctcaaaaagtgttcctaagttattcttgtcgaatttaatcccaaagaattctctgatatctttggttgaaccatgtaagcgatagttatcaactgtaactagtaactgtggagtcatcgtaccgcctttgataaacattaaatgggctatttcatattgcccatgcttctcatccttatcaaaacgaatgatgatcataatgtagcgctggttcttataggttacaaagcatgggtaaaccattgcctctgcttgtttcatttcttttaccacggttcgtaatatttgaaaatattccactgattgcagtttatttttagtcataacgattgtttcctcctacttaattagttacactttctccaccactacctgctcggtttaggagttgttttactgcttttgctccctggcattttacccaatgtaggcaattaactgcatttgaagttcttgttttccatttcatttactgcagcccaaaccacttacttgatttggtaataatgagcttttttagcattctcctcacttccactcgagtaatcagataaatagtattttaccttgtctaaatcgtagccaagatgaactacaccccgactaaagtcacgggatttctggctaatttatatcagtaaatttctaaaagaactgtgtaacccgtgccacaattgattgagtcttttgtgttggtaagtgaccaataacttcaccgtttgatcttgcgttaatgttcacagctcgtaagtgttgcaaaaggatcgtgccttgcacgttagctaaattaactgattcgaaaaagggtgaattagcatatttgggatcgttgtgatatttagctgaactactaattggaagtacaacagccgtattaaaaaagtgattgtagttttgattgctgataaccacacagggtctcgttttctttatctcagaccctttagccggattcaaattaatccataaaatgtcaccttgcttaatggtcattagtcaaactcctcactttcaatatcagctccccaattaggttcagctgtatcaaagctaccatactttttttcttgggcataagctgtttgccacatattcgaaactggctcagccttaactatgtgtactaacccattagcatcaattagatatctgatcttgtcacctggctctaaagataacgtttctcgcacttgttttggtacagtagtttgattcttagtagttatagtagatactgattcgcgttccataaccgtctccctccttacttttccttacatatatattataacttcatgccacctattaaagcaagtaattgtaagaaaactagttgttgctgatggctaagtaatcattgttcccacttattcccattaatccagttttttgaattttctgccatgaaggcatccccctgcagttagattatggcgattttctactgctccacttcctgatgacgaagcatacaatgagatgaaaaataaaggctttctcaggagaaaggacgtgaatgcgacaaaaattctctaatctttggtaaggcttaattagtattttattgttgatttattgttgaaatcaataaccacatctttaacaattgccgccactacgctattatttaatactttttatttttgatatatcgttgattattaatgaaaagagaagagaaaatttacctccgtatgattagttactgtaaaggaattgaatcgctattgccaatcaagaagtctttcgcatcaccaatataattatatttctttttggctaagctatttattaaatcgttccaattgataaactcatgacgatatcggtcatcaatattatcattaattgtcgcccaggtttgtataaatcttggtgaaaaaatatcataaggcaaataatcatatatacctttattggtatctaacaaaatactacgtaatattctgcctgggttatcccgtccatcgctcctaggttctctcatatcttctaccagattagcatcttcagatacccctaaaagatatgttattaatccgcacattcttaataacgttagagatatgttttttgaaagatttaatatcgtatattttgaaacctttactgagggtaatacgggtgcttgtgcctttttttcagaaagtaacggaccaattttgtcaggaaaaagtaaataaaataaactttgaaattcttttttggttagtagcattttcaaggctctacgaccattatcaagtagtctaaatgcatcattttctatcccatatagctcatttgttccttctgctttacttgtaccagcatcgattaatattacttttatactatttaaatctaacgtaccagccggtgatagaagaatatcctttttagttccttcaaagtgaaccatcacatttttgggattcatatcaccatgagtcgtatttgcctgtaaataatttgtaaaggaaacaaccattgctgctattgtattgattccatattgaacaatgtttttcttcgtttcaaatctatttgagttttcttcatatagttctgcaagctctgttgtccaatcactaaaaagcttgccttccccaagctccataattgtatagagaaatttatgattattaatcataaagtttccagcatcgtaaactcttgcgctatattctctaagcaaattcagagcattctttcttgattccaacaaatccttatcataactatcagaatctaaatatatctttagaatctgtatctgctccaatagtttttgtttaacgccgtttgtaaaattaagttagaaaaatagaaaagccatttgtggtagacttttgaatacccctaaacaaaagaaaggaaaccacaaatgacttacacccatcttaccacaaacgagctgacaatcatcgcccattctttcgtgcaaaagcttaaagcgtaccgagtggcccaaatgatcaaccgtagcgccgaaaccgtttatcgcgtttatcgttacctggaaaccggtgcctcaattgctgattatcaagatcactatatgcgcaataagcaacgttgtggccgaaaacgtactcagttgtcactggctgaactcacttatatcaacgacaaaattgcccaggggtggacgcctgataccattattgggcgcgctgagcgcccaattagttgtaaccagcgaactctttaccggatgtttgaacgggggcagttcggtttggatgtccgtgctttgcccatgcgaggtaagcggcacccgaatggctatattgagcgccgcgggaaggctggccaattggggcgaagtattcacgagcgtgccaaggactttccgcactatgccactgaatttggacaccttgaagctgataccgtccaaggcaaaaagcaccaaggagcggtaatgaccctgaccgaacgccaatcgaaggtcgaaattgtactcaatgtgcacgaaaagacggctgatgcgattaaccaacacttaggtcagtggcttcgtaaattcccgcggcacttcttcaaatcgattacctttgacaacggaaaagaattcgccggctggcgcgagattgccaatcaatttgaccttcacacttactttgccgaggttggtgctcccaatcaacgagggctgaacgaaaacaacaacggtcttttacgccgggacggcttaacaaaacggctaaatttccgcaatcttcccgatgaattggtgacccaactgatgagtaagcgaaataacctgccccgcaaatcactaggctatcgaactccatatgaggtattcatgtcctacgtcactgatgagcaactactttctttctaacttaaattgacatttcgggtaactagaaaagttacaccatttttgccactgcctaaattttttattaccttaagtttgttttttaatcgtgaattaatttctttaatctcacgttttttatataaaattttattactatccaaatctacagagatcttggctttatcaagcttcatcttgcttctccttcatatatcatagatttcactttcatcattggcgattatttcttgtacccttattaccataggattgttttgcttctgatgcaaatcagctattcattgaaactggtaagttatgccattttcatctgaaatttctattctcgcagttttattaaaaaagcactaactcttatcatgaagtgccctagaattgttagacacaaatctatcgattctggagtattttttatgactaaatattcaactaaatttaaggttcaaatagttaaggcatatctagatggagaaggcggattttcttatttggctaagaaatttggcttgtccagttcatataatctaaggaagtgggttgatcttgtaaaagagcaaggatttcaagcgttacaattgtgattgtaactggtattattgcattcactgtttgctatacgcatccgcgtaaataaggtaaacaaaaaaacaccatcctacaagtttagccgactttagatggtgcttagtttctacgtcgtttagagattaagcattgtcaacagtgcttataatctcagaagagtcatgtggcagtatggctctttttgcttatatacgtataatagcttttgaaaaatttattttcaactaaaagtatacactcaatcacatggctgacatataattcatatttgaaactgtagtattcatgctttggatcgtaaccaaattatccgatttaccattatcatcgtgactttcttttagaatctggcatacagcctcccctaagttaccgtccatgatcatatcagtccgaaggtttaataattcttcgtcacgactaaataacaaaatggaaccaggttgtcataatgtttattcccatatttaagtaatagggctagcattaccagttagattactataccccaaaattggcggatcaccagtttattcaaagtatgtcacgaaaggaaaatatgctttaagaccgagttactagtagaatttctgccctgaaagacatcgcagaattaactgaactttcttaagactatgttcaatactttaatcatgtcagaacaacattaaaaacaaaaggcatgactccagtcgaataccgaaatcatgccttatagcagcttaatatttcaattatgtttaactttttcttgcacttcaaagttcttttctttacaaaatgctattttgcaagttgctaaaatttatagagatactaatatctcagttatttaataacaagattaccaactataaccttgtattgtgtttttcctaaatcagcttgacgtgtgtcgctctttttaatatttttaccaactgactcagcttcattaataatatctggattaaagaactcagcatagtctttgatattgagccaaaagacatctggattattagctatctcctttactattgggaatagatcattatctttatcaatagtttgaatgtatttggctatatctgttagctttttagggtcaatcccttgctcttggagtttctgtatagcaacagtttgatttcggttggcactttcaagtaatcgctgtgccgcaatctttgaagtcgagtttatcaatgcaccagcatttttagcgaagaatttgtgctgcttattatagagttgaactcgctgcgcaacaaccttttttgcgccctgttcagcagcgtgaacggctaataaggccttgtctttagacaaacgagaggaattacataagtcgtgagcgatctcattatttacggccctttcagcttcaacgacccctattttcttttgggcattgggatcaataaggattcgttctttaccgagataagcgtcatttacatcatgaaactctacctcaacgactaaaacagaaggctcattaccctccgctgagaaactgtaattagaaattaaaggattaggaaacggcttaagctgattgattttgtagttgtacatccgcttatttgctatttgataagcttgagaatgcttttcagaagaaaaatcagtatagtttagaaactgattatctgtcctatcaagcattgttttaactgcattcttcttcttagcagtaatatcctttagatagtcctcatactgaggtaatacgacattatcgaattcagtatcgtttaagaccccttccatcttgttaccaagtcgcttcatcatctttaactgtgagttgatagactggtaaatagggaatgtatagatgtatatctgatccctcttggatccttcaggaagaggccggtcaatacgcccaattcgctgttccaaagtcatagggttataaggcaagtcgatattcattaaagtaacggcatcttgcaggttttgccctgtcgaaatggtgtcggtacctattaccaagtcgataacggtattgtctttgatgagctcaggacgcttctttgatattggggagaaatgctctaggacatctttcttcgttgatgaattcttatttaacatagctgctgctttgccatcactgatgttagcagcacccgttatcatccccatcggcaacgtaatcttagaagagttgtaatgggaatagatcttatcatagtagtattcgaccgtatcggcgaattgggataccaagataatcttatggctaagtgaacgctccttatcaatgcactcaatgatcttatctaccttctcatcaatattactataggattccttgaggttggagattaattgcttgagagtaacaaggtccttattacagtcggtaatcatcttattgacagcattttgcgctttgcggttggttacactacttatctgtgcttcaagcttttgcaggtaccgtttctttcggataagggatttaacagattggtctgattcattattatctgtgttaacctcgtcctgataaaagtctttgaacaagccaagatcatttctactttcgtactctgtggtatggtatgcaagcctcaggaactctttgtagcgatttagtagttccttgcctttaaggtaggacatcgggtccaaatagatgttcttgagcttctcgagtttgtctacaatatgctgcaaagagtcagcgaatgctttccaacttgagtcggcacgcttcagaagcatcattttcaactgtttagaacccagctcctccttactatcgtcaacatacttaataggatcctggtatgggaatttgaggtccgcgattgtatcgaagttattgctgaagatctcatttttccgcggctcataaggaatatcgacacttgggaagttacgatgtgggaacttggccccctgccctccataggtcttacgagttctttgcagatatatgtcgtcccagaactccttgaaggcttgatcgtccacagctaaacgcttaactaccttattagtaacactattaggagacagcaggaaatattgcttatacttcctgtcattagcaatagcgtccacattcaggaacagtgaacctatattgataacgtcctcacgctggttattccagggggtcgcagttagcattaacccctttaagcgaggattaactttcttcatgtacgaaaccttgcgataagcttctgtgttgttatttttgaagcctaggtgggcctcgtcaattactaataaggtaaacttactgttcgtcaactgagagttagggattcctaccagcttctgacgagaaatgaacgagtagttattagacattacccctaccgcagcaagctcatcatgccactgatcctttaatttggtatcagcaaccaccagtatattgtttatcgcttgagattccagatacagccgtataacgccggcagcagttctcgttttaccaagcccaacgccatcggaaagaactgcagtatcaagggagtcaagcttttccttaacactgacaattccacttcgttggtgttcaaataagttttttacccaatttttactatcgtctaattcagcatatggcttaccgtacatattggcaaagtcataataggtctcttcaacaggcttatattcttgagtaatctttctagcaccatttgcccgaacgactttgattaaatccggtgaaaaatcactcacttcatcatcagatagccatagtgtattgtaccaattatgaagcgcatagaagccatcttgagttaggacatttagttctgtgttaccctgtagcccggcacgagaaaggttggaagaccccactatggcagtgccacgggcggaatttaacgatgcggcaaacagatagctcttagcatgaaaatagttagcatcccccgtataaaccttagcttcaatacgtccttcttcaatccagtgagcaattttgcctaagaattctttatcagagatacccttagcgtcagtatttgccttgtcatagataaattggtcataactttggtaattactcttatccaagacgtttacagtctcaccgttagtctcattacccatcaatattctgaaatggccattacgattatccataaaatcaagaaactcgtcttttaatagtagtaatccactaatatagaaataccctaccgcgacatccagctcgcgatattctggctgcgttaaaaggtacttcaatgcatcagtcatagatactttgcgattatcaataacacgccttgaaaataattgacgctcaattgttgtatcaaccattatttagcaccaccagttaattgatcatatttattcaaaattctctgttcatcagcatcaacgtctttagtatgtttcttagtcttgaatgtttccataagagttattatctcttggcgagtcatcttaaaattaatcattactcgtgcatttaattcagcaataagattctctgatagaatgtccctataagcatttccaggaatagactcgtccaaatcagtataatatcccttattcttctgcaataatgctttaacaatttgaatgataatgtcagcatccttaacgtcatttagctgtggtaatggaagctgcttcaagtagatctgattgatgttaattgatatcaattgccttaacacgaagtcaaaaacatacgaatttaggaaacccaaaaagaataatttttctctgtctttcatcttttgaggatctttctgtatgtttaggctattggttgctactgaatttgctggtaacaatgtagcaattaggcttctcttattagtagaactagcgactgagcgtaatgctatccgagagaaatgataatcatctcctaattttgccttagcattgtcttgattaattctataagctatttttgacgggaaaatttggaattgattcatatatttaccttcatataatggtaaatccgtagaactggcctcttctttattgatgaatttatctgcatcattggttctatggaaatcattccctaatttaataagattggaatctctaagtggcttatatgttagcctgagcttttcaaataaatctaataagtcttgattatgcgcttcaaccattgcataacgttctggttccatttgtttaaggaaagaaatactgtagttcaatttcgagctattattgtttaataagtctaaatctagcttgtagaaaaatgccttaaatttgccatcatcattcttggtatcacggttaaaagttagaacagcgaatttataccgttcatcaacagctgggaaaatttttcgtctatttgcgaaagagagaaattcttgcaaattataatcatctaataccaaatgccttaaacctgttgatccattgtcggtagcaaaattgtcaggtacgagaatgctaaactgggcatttggcttagcaagttgagtaaaacgttccaatgagactttatataaattcaagtctgacgaagctttcttaccatttacaacccagctttgatagtggaaactatcctcagatcgaatatatttagaaccagccttgatacgttcttgaacattactccattttttctcaagtgttgggaactgatcaaacaagattttctccaggtgctttttggctttcttattaggaagcctgcgataacttacatcgtattcagagaaaaactcatctgaatttggcttccaggcctcccaggggggattgccaattacaatatccagccctccatgaacatttaggttgccatcttcgttaaagaagatttcaggcaaagcaaattcaatgcatccgatttctaggaagcttgcatacttggcaacatcccctgcttctggaataactttagctgttaattcatcgcgcaatttaataaatttattaaagtcactcgatttcaacctacgcagtctttcaatatctttttgatacattttgaatactttctcacgcttatagtaaggaacagcattaaataacgtgttctggtgaattagagtacggccgatgagctgcggtaacttagtgtttttaggcttatgttgcaaagaagacagcgtaagagtcaaactggagataattattgctttatagtcaatatcaactccgtaaatcatgtgtttgagaatgtaatcttcccattgatattgactatctttggagccgttcaggaagttatatttatccttaatctcttgaggatagtctaacccggcaagcagttgatactggtcagctaactcaaggaatgcgccacgtaagaatgagcctccaccacaagtaaaatcagcaattttaaggtccaataaatggtcaagggccttagctatttgctcgttttccttgctctcaacggcctttttgacgtcttgatagcggttctgaaactcaattgacacagtttgctttaccatatagtcaacgaaccgctgatctgtatagtaggctcccttattcttttgttctacttcatcatcaccgaagaatacaaccggtttattggttttcttatctaatgtaatttgcacgttttgactcattgagtcttcgtattgcttttcaatggcttccggcggcatatcttcaaacctaaaactatagttacccgccttagtatcaacgtatggcttaacccattccagtttgttttgcttagctaattcttgatcaattttggttgctacctcaccaatactaccggcaaacaagtctccaccgtaagcaagcttgaattgctcactggcctttttactaagctcggtaaggtaatctccgctattttcgttaatttgaacatgtgatgtagcgtctagttcatcaggagtaaaaccattgtcgaagaggcttaactgaccaattggtgttttttggcggttaagcttttttattttagattcctcgcttacattttgtgctatggtaacagccttctctatcgcttcatcgagtgtcccattgcccacacctagggcaatcccatcaacattaaaagagtcagccccataatatccttctaggaagcgacgcattaattgtcgcaatgaaatggtatccaccacagtggacaagactgatttgtaagagtcactttggactagattattaatgtcgtttcgctttatgtaaactttagcttgatcagaaactaaatcatataagtaagttttcagatctgatgccgtaatccattctgacaacttcttgcgatacatggataccattgtaaggaagttagaagaaagctctctacggaatgctttcgcatcaatctttatttgatcttctgagccaaatgggctggattcaacgtagatgttttcatttcttaaataattaaaattgcgcttatataagtcgacgtcaatagtgtctgggtttagatctaatcgtgtatcacgatttccacccaatattgggaaaaacaccaaccgttttttcccaataaagccaacagcagctacggtaaattccaagtttaactggttgtccttaatatcaataacgtgttcgtaaagttttctgacctcaacggttgaggacttctcgtttaagtcttcaaccggtaagacagctataaccccactgtcattgttatcggttttatccgtaaagtagattctaagattactttccggatttatagggtttttcccaactgtataatcaagatagtcagcaagtattttagcagaatattcatcagcattcatactattgattagctgtgcttctctcgtttcattcatttgtcatccttcttccttcctattttaaatgagctcccgtcatcgtaaacctccaaaatctatattatctaggatatgttcacgagactcctggtctaagcccagataattaagtgttactgcttcactagaatgatttagtaacttcattactaaaccgatgttatggttcgactgttcgtagacacgataagcacccgtttttctcattgtgtgagtgcctaagtaattcaaaccaagtaagtcccctactttactcattatctcataatacgtatggcctgaaatgtgcttttcgggatctgcaaaggacggaaacagccaaggactatcataaactttaacgtccggattttgcatttgatatttcattaaccaggtttgataaactagaagatctgattcaacaggacgcaaatataatgtgttctgttttttagttttctgatcaactatgtatgcattcttcataatttgtccgttatcatcaaaaacatctgacttctttaatgaaattacatcacttactcgtaataatgttgccttccctacttgaaagattgtgtaattacgacggccatacttaaaattatctcttagggtttccaaaacttgttgtaaaatctgtgtgtccttgattgggaggactaattgcttcaaaatatcacctctttcccatagactataatctagtatatctctagtatagtctattactgaaaaactgtaaaattaagttgttgatttaacagtatttagcatagactataattacattatagtctatgggacttgtgcgatttatgacaatttacaaaaatgcctctcagacaaaacgaaaatgaattagacgggtaattcatcatcttagtttgtctgagaggcattttataataattagtcaaaaagctactttctagccttatttctagctagatatcaagctgattccaagaagaatatagtttaacccatatgtaaatttcaattattattcctattatgcaaagcaagattgaaggaatgataagatcagcatttctataaatagctattaaattaacagtacaaattaaaatcaaaaaaataaatattgatttccagtgtttcagtaatccgttaatttctttttcggccttagacattttatttatggccataacgaaaagaattgctgtaattatggttgatactgcaaaagcacctgtagctacagcgtaaacatataacattttgttcccctatttctcttttctttaagtgtaacatcttttagcttcatttccccaataaataatatgtaatatattttatattatttattatttatgcttaatctatgtgaactactcggccataaatgaccgagcttctgggaacacgaagtagtatttaggatattacacaagtattcttgctacctaacttacagaactccgttcttttaccaaggctagttcctagccaacggcttttaatcctttttgcaagatgttaactgccgcattaacatctcggtcgtggtgaacgccacactttggacaagtccattcgcgaacttcaagtggcttcttgccactgttaaagccacaatgcgaacagatttgactggtatagtttggtttcaccaagactagttgtttgccataccaagcacacttgtattccagcatcgtccggaactgataccaactagcgttagcgatcgacttcgctaagtggtgattcttttggagattcttggctttcaaatcctcaataacaatcacgtcgtactgcttaactagagccgtcgttagcttgtggaggtaatccttgcgcttgttggcaattcgttgttgataatgggctttaacaagtcgggcgcgttgccagttctgataatcattgagtgctaacttggtatcttggtggttgtgattccattggcgaacggcaacggttgcccggtggcgccgcttgctgaatttactttgccacttcgttacttgatgttctaacaatttagcgttgaaggtaccgtacttgacaccatcagaactaatcgcaaggtcggccaggcctacgtcaagcccgaccatttgccccgttttcggtaaccgttcaacggttgtttcaacttgcagggagaggtagtaacgacccgtcgggtcataactgaccgtataacgcttaattttggcctcaccaataagagtcgttttactcgtgcgtatacttccgagttttggtaattgtaaccgccgcttggcaagtaccttgcacgttgatcggccagtgtaggcctgataggccacatggcggctcttaaagcggggatagccaccttggtgcttaaacaatcgtttaaaggcctcggtaagattatggttcaccactaggaaactggtggaatcactttccttgagaaagggatattcacgcttgagctgtttcaagaggtagttcataccatactcattgacgaagtggctactgggattgttttggtaacgctccttagccatactgagcatttggttccaaacgaagcggtcattaccaaacatttgccataactgatcccgttgggattggttagggtacaagcgaagtttgatccctttaatgaccttgttcattctagttccacctcctttttccgttgatcatcaatgtacttggcaacggcttgttcattaacggccccaatactttcaacatagtaactgggcgaccacaagtgacggccctcctttttccaatagcttcgctgtaattccggacattcccgaaatagctgataggcagtaccgcctttcagccaacgaacaatattcgtcaccgataatttgggtggtgcactcactaacaagtgcacatggtcgtccttcccaatttccatgtgggcaatttcaaagccatatttagcggcgatctcatggataatccgtttgaaggcgatctcgacccgaccggtaaggactttgtttcggtatttggttccccaaataatgtggtaattaaggttgtagaccgatgttcggccatatgtaagtctgtttgtatctttcataccaacgattataccataattcacgtttcccatatacgcccgtcgggcgtaaaaaaggggggcaattcatcacgtccttaaaagaacgtgtttccttgccccttttcataaattaaaagaaggcgctaattattggaccagtttcaaaaaccacggtgaatacttatttcatacagtaccaaccgatgaaaatgggaattacaaactcgctgaagcaaaaaaactaggtaaaacccctgcatctcatggatgtattcggcttagcgttccagatgctttatttattcagcaagttccagcaggaacaccggtagaaattattaaatagttcgcgcatataaaaattcaatttagaaatttgtaaaagggataagccagagaagacttatccctttttattaaacgctgtttgtaaaattaaaccaatttccgtatttttacacatgctgattcattgattctaccatcaatgaatccttttttctttttttcgtaagtcaccgtccccattaaatctttcgatcctatgatactactagattgaagaatacattttaatttaagaatccctttcttacagttaacaagataacctcccttgagagagttaaaggtagctattttgacgtaagaatcgtcttttacaataaaataatttaacatttcgttcttattattaactgtcacactaaaaatttttaccactttagttttcttaggaaaatatagaataagatcagtactttggggttcatacaattttgtactactaacagtaacttcatattggttcattactaacgttcttcctttctaataagctaactagtgtgcaaaattactagttaaataaatggacagttaaaaaatttagttccacttttaaaggtactccatgactgatataccaggggattttcttcactagtaccatccatgagattgccaaaatgattgtgcattgctccatgatccataacgtccagcaacatattgatctgcgacttgctcttggtgtgcaggagaataatcaccacccagatatgatgaagataattgatatttacctacatattggccatttcgagcattgtaatttccgcctgattcacgcgatgcaatccatgccttagctgcagcttcgttgcctgtggcatttgaagtataagaacttgaaggtgcagcctgctgactcgttgtttgagcctgattattagctgcaggagctgctgattgttgttgagattgaactgattgaccggattgaacagtcgcttgatctgactgattagtcgaattaacttgggtattatcagaagtagattcattaatgcttagtgtttggccaacataaataaggttaccatcattttcaagattgttatccttaacaatttgatcaacagtagtaccattcttttttgcaagtccccaagtagtatctcccttttgaactgttacagttgatgcatcagcctgagtagttgcaaacgcttccgttgtaccagtagccacaactccacctaatagcataagtgcttgtttctttttgatattcattttccttatcattactccttttcttctttgtctaaacatactttataactcatttaccatcagtagttatcctattcaaaatatataaaaattgcttttccttgggtgtctttttttgtttcaacatagttaaagtaacttattctttttaactttatggatgttaactagcaaatacatcatcatatatccagttgaattcagaagagttcaaaattgcgtatttgaactccttacggtactcaaaacgtaatacaaaactattcggtaataatataggcattttcttgatagcaagtggaaaacgttgcttatcccctacataaaatgtctgatctagtgtctgatatttaacagcatttacttcctctaagagttttttatcaggcctatgagtaactcgctctgcgtaaacaatacactcgtatttattatcattaactctgctatatagcagatcgaatattgttttcttcatgataaacgtatttccgttatgaccttctgcaataacatccccgactcgtgcactagctatgctttgcggtgccatttcttgtagatatacctcgtttgcacctgttaacttggtcaatttatatttttttatttgtccttcactaccagaaaaaacttcagcttttacaatggaaacatattttttcattaaatctccccctgttttcctgataccaagtttttctttcccgaaatgtcaatttaagttagaaagaaagtagttgctcatcagtgacgtaggacatgaatacctcatatggagttcgatagcctagtgatttgcggggcaggttatttcgcttactcatcagttgggtcaccaattcatcgggaagattgcggaaatttagccgttttgttaagccgtcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgccgcgggaatttacgaagccactgacctaagtgttggttaatcgcatcagccgtcttttcgtgcacattgagtacaatttcgaccttcgattggcgttcggtcagggtcattaccgctccttggtgctttttgccttggacggtatcagcttcaaggtgtccaaattcagtggcatagtgcggaaagtccttggcacgctcgtgaatacttcgccccaattggccagccttcccgcggcgctcaatatagccattcgggtgccgcttacctcgcatgggcaaagcacggacatccaaaccgaactgcccccgttcaaacatccggtaaagagttcgctggttacaactaattgggcgctcagcgcgcccaataatggtatcaggcgtccacccctgggcaattttgtcgttgatataagtgagttcagccagtgacaactgagtacgttttcggccacaacgttgcttattgcgcatatagtgatcttgataatcagcaattgaggcaccggtttccaggtaacgataaacgcgataaacggtttcggcgctacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgttttgcaatcttaatttaaaatcccagaatgaagaatatccattctgtttgagaatttttgaaattttacgggtatcagaaaatcctaacatcctggttaattcttgttctgttggattgtctttcttctgacaaagtacttcataagtttggtggatatcattcatagttataacttttttataatgttgatattttgaaattccataatgggtaagaaacatttgtaatgaaccaaaatatgacattattaacctcattggcagtttataaaaatgaattaaatgctcccaggtaaaattagtctctcctgactttattatttcattcattctgcaatctatttcttccatagtgtaatatgtttgatcatcaagatatgttgcggagatctttgcagtttttataaattctctccagcttccaaatcttcgtacggcagttccacttcgtttaaagtctcctggatgaggtgcatatcccccgttttcttttgtaatttgctgcacatcatgaattagtacttgattcgtaaccctttgaaccataagcatatccccccgtatttgattattcgctgtaatattaacaattggatttagattgaagagatttacttatttattcaaaaaatcaacttttagcctaaaaaagccatcacaaaaacatttcattaaaaaacgaaatatctctgcaatggccaaaattaattctaaatattttttgttcccagaagctcggtcatttataaccaagtagttcacacgatactttggctattcatcattgtcattgcaaacagccaaaacgattatatctccctcaagaataatgctaataaacaatgcacttaaaatagataagattgtattgatatttggagcctctattaaacgctttacagcgacaatcaaaaagatttgaaaatatatcggccaccctattaataagactgcagcccaattcagatgtttcattgccattccccttcctaagcttagtttatgcttcattaccatctctcgatttccttatcaccctcaaattcccaatatatcgttttaagtatagcgattgtatattgagttttattaattgcttcagtttcttaaaaatgaaagaaatgggttaatacttttaacatagagagataggtaaaatcttctatactaaaaaagccaggccttaaacctggttttttagtacgcttcccctttataatttattttgtatatcctctaaattacgacgaatttctggaaacaatctatcaaagatctttgtggcatccttcatcatttgactatcaattgcttggtactctggtgaggtctcgtaagttgaatgtttatcaagtaaagctgtttgcagcccagcattatccatatacctctcaaagcaacgagcaaaaacctctgtcggagtacaataatactctggcttatctaaggtaacgtcactatgaattatatgctcacgatagcgattaacaatattagtaaattctggttgtaaactaatttgacaactctgtgactgataatcaaggaagtgaccatattcatgaataaatgagtgaaaacctgcagtaggcataaagatttcactatcctctggtccacgaaaatcaatcactatattattaacagcaggaatatacattcccatcgcatggtaattacctaagcggcgtaaacgtaaagctggtttgtttagaccaccaggtaatacattcaacacacgattaacctcgtgttcaaattcatgaaatgcatgataatcaacatcattatctaactcaagtttagaaaatgagttaagcaacgagctatgattcatcagtagagatgtatcatagttaatatgcttttttgtttgccaagctctcgcacgagttttacgcgcaatagcgtcctcgtaacgttgggaagctacgatattatagttatcaaagacaaagttacgtataaaatcaattgctctatttcgttgaacagtttcttgccattccttacgactaatgtcatgattctgtaatatctcggcatatgtatctggaagtgggcttttttcaaataggaaagcatacttcttattactataccgataggcaaataattggtgtaatagctcattaagagtctcacgctcaaatgatggttgctgctcatcataagcattttttatagcaagcaccaatttaccatacccaattaatttttttcgatttacatatccaaatgtaaaagttggaatgtcactaaaatatcgtacttgaccagtgtaagtatttccacaagtttcatctgtaactcggagaaaccttaacttttcacaattactagcagtatacaaagcaaagtctttctcaccttgatatagctttttatgagccttcaggaagggattgtctgcttcgtttacagccttagcactactaattgattcattatcatgatctgataaataaccatagtaagtaaggctaccaatgatggctgctgtttgctcataatcttcatctttccagtcaccatttcgataaatataaaatgctaacttacgaaagagagtatataatgtttcatttgctgttacagtaatcttactgtaacgggtaataccaaatcgttgatgcatcaatgtagttagagacatcaatgatgatttcttatgaatcttctgttttataaccatagctggtttgagatcaaccttctcattttttacagctattttcttagttggatttaccggtatatcaaatatagataattgcttaatcataattattttacctcctaaaacaaaagagaccgttgttataacagtctcttctaataccttttattcaattagttactataatttgaggttaagttcgcctaacaaattaatcctataattgatgccatggccatcgctatataaaccaccgattattattgcgtcaacatcaatcggactaagatgctttatctcactttccaattgatggttagacatgtatcgataatctggcacttggcgttgtaatacttcaatagcatcttcgatagctacgaatacctcataaacactatgatcatatggatcaaatgctattaacttcatatttatcaacccatctctaactaaaacttactgcaaatacatccgaaaaaagatttggattaccgtcaaatacatgtttgaggcttttcttaattccatctaaaatgggtatatctttgtcagtaaagtcatttaatagttttttatcactacctagttcgataatcgagcgacataaagcaaatcccagggcatttataattgcgtctttcagttcttcgatagaatgaactgctttcttattatatggctgaatttttggtacatatatataccatccattaccgttaaagccttcatcatcatcaatattagcccagcttacatgaatgccatcttctaacgtctcgttatattcatccacataatcaaataacttacctgaaattaataagctaataaaatcaaccgataatgatttcagctttattatattttccgaatctactagttcatttactttcaaaccatacccatcaacaatttttaaatcctgtgacattagtgtgtcctcctttaattttacaaacagtgtttattaaaaagggaaagtacaaattagtttcccttttattttctatttaaaatttaaaaaattatttaaaacattcagcatactcatcagtaacaaataaccgaagtcgtaacttagcaaactcaatttcatcatagatatccttaccttcaaccaatggtaaaataccgtcatcaatccactgattatactcatcttcagttaaaacagtttccattaattcttcgatactgtcacaaaaaatttctttatcttggccattaacatcaaaataaagtagaaaactgccatctggcaccttacctattcctgtaaatctacaactcatcttaaacctccacatattaaaaagtactttctcaaattccgttatgtatgatagataaaaagatactttacataagcatcccccttttcaaaatttaaaaacaaaaaggttattagctaaaaaagctaataaccttaattacgttttgtttaatattaatttatacaatcaaataaacgaacacatgctaattatgtgctacaaacacaatcaaacgaaacttactaaacatcttagtaaataaataataatcaataatctttgattcactatctattctagcattactgtaaataaaaaggaagcccgcaagcttccataggtcttttcgaatgtgttaaacatttcttgtgaaaaagacgtattttatcaatgtaaggccattacaacttttaacgtgacgagcttattggtttactattttcttcaattctttataaaaattctcgtgcggacctgctaaaactacgatgacaatttcatcattatcattaatagtataagcaattcgataatcaacacgatcgtatttaaatccataagcaaaatagctgcttaagtcgccctgcttttcatttcctacatatggatcgtttgctatcgtgtcataaattgcagcggtaaaactctttttcagttgcctattttttattttcttcaaatatttcaagactcgtttggtagggataacactataggccaatttccttctcaaactcctctctactcatctgcttgctatttgcagcttctttcgctgctgcatcaatcaatttatccattgcagtaggtatatcttttttcatttccttaaacttactaataagcttttggccttcatatccttgagctaccaaatctttcaaaatatcctcatcaaagtcaaaaaaatcgtcttcgttaacgaactcatagaaaattcccttgtctgttaatcgtgggcgtaactttgttccctcgctaacattaaatgctttaggaacggtaaccgtaagagcgttaccttgttttctcgttttagtaatatccatgttatcacctcagcattattatctcacacccgctcagtaattactagtaattatttagtaggtattatcaaaacttattactatgtctacgtatctgttttaccaacatttcctcccaagctaaaaaacgccacagaatttgctctgcgacgtttttgtttttatatcacatatcaattacaaataaatatatcattatcttatctaaaggcaacatctagtacgaataatgatccttccattttatagcaatcccaaccatggatttctccagatgcaagtctgtccatacattcaacgatagggcgtgctaactccatgtattctattttgctatgaactgagttattgtctgcaaataaacagttatagtttgtaccatcctttactttctcagcatctagcttaacaacattagtaattttattaagctcatttgttattgttaaaatttccatgataatttcctccaattcttattttctctaaaatatctgttttactttgccaactgcttaatcgttttaattaacgatttgcaattaccacaactaattgcgttattaatttgaccatctttggcaatattctcatcagtgtacacatcaactattgactcgctgccgtcaacataaacattaaaatgcaaattttctttgtttccacccttaaggaacttggtaataatctgccattgtaggccgttcattaatggcaaaatttctttttcttcattccataatttgtcttgtgctgacatttcttctgtgtataaaatttccattttattcactctcctaaaatattttttctaacttaaaattaagccggtattttcttgtaacgccaaccatgttcgtcaaaataactcataatttcccaagtatcatcagttgtatattcattttgtaaaaattctttccagtcactaattcccaaatgattcattgctttaattaatcgctttttattgaagtaaacattaaacatagtaggacaatcacaaaggtaattgtctctgttatcataaccatcataagctaatagcattttattcgctctccttaattacttcctattctagagtctaaatttgttgatcttctcgaatgcaacggtaactagtatcagataccacaaaaaaatctaaaactctaattccaaggatgctaccagcattctcaaggcgatgaaatgtttgtatatcattgttagaaaacacaagtttaccggttggatgattgtgacctatgatgatgttgtcggcattgcaaagcaaagcatgttgaaaaatagctttattgcttactaatgcttctgttgaactacctaacgcaattggtgcaataccaatcaactttaagtggcaatctaaataaaatgcatagacatattcctgtgcagaattaccaattaaatttttcaatagttctcctgtaaactcacttgaagttagttcttggccaattccgttactaaatggaatgttatagctaaattcttcatgctgaattttaactgaagagaacattttaatatcttgttttttagtaagtgacgtcataaataaccattccttttcttatttaatttcctgaaattttctttttaatacaagtaatctcgatattctactgagaagtcattaatcaaatctaagtcgatgtttccatctctatcgataacaccttcaataattttggctttattttctcgatatgcttgttttaatactttaatccaacgttttgggtcaattgcttcatctaataatctttcgctgtaattatcaatgttattttcgtaataataacccaattcaaagtcaaatccgttaccttgctctaatgggctacaaaacaaatcgtagtaaaaatcccacagaacgcatgcaataaattctcccttaatagtctttttctcacgatacttatcagcataatgtgtaagcactgtatcaaatgtaatacttgcactaagaaattttctccgttgttctggcgtcgcatcatgccatactttactcttaactaattcatcaacactaaatggtagtaaatttgcatcaatcatcattttcttcactctcctaaattatttcctaatatcaaatacaatagaccttttcaatcttaaagagacttgctaggtattatgtctactgcttgtacttgtcccaatttactaagccgataaaccactcgcactaataattcataccaacagttgtctgcataatttttagcgatcatagtttctggataagagagacacttttcctttttaaagtcgttaactacaaaaggcttttctaacgcgttagcagtagccaatactttattgatatcaaatttatcaacaatgctcttgttacctaatttggatattaagaaattattatgacattggaaattttcaccaactaccttaatacctggttcgaacagcactgcttgattattaacaacatcccagccgattgatttaccatagcaatcatcgttatcctggtttagttcatgaatatccattactaagccactaaaggtattgctattttggttttggactgcggttgcgatatcttgctttaacagtttattagcagccgtaagacacgcatcttcactatcaaaaacgccaagcgatgcgtaatcaaacatattctgcatatcagatttcaaaacatataatttcttcattaaaaattcctccttaaaaaataaacaaaaaggactatcaagtgactgataatcctcttccataaagtcaattaactttatgattaatatctaccaccatgagctatagaaaatagctgctttatataacgtggtttgtaaagcctcattaatttctttgcaaatttttttgaatcttaacaagtctgttctaaattgagcagacgtttcatagtagtaatcgtcatagacagttggcccataaaagaatccagaagtagtcggaaattctttctcagcgatctcttcattaccttgttgatccagcactctatcaattcgtcctacaatatcatcaattgtcacttcatcgactttagtaacaatgcagttatattctctattcgagtgaagttcatccgaattatagtaccgttcttcaaaataattttgaatctgattagccttacgataattagtcctggcatcttgaacgttaaataaactatgcataacaagctgcttcccgtcaatatcgtagacaggaattaaatcagtaggtgtgcgtggtccatcatcaaaaatgatacttgattcaagatcataaccagaaagatgctttaaaatatctttcttcattttgtttgactgtatcatgttgacagaatccttttcagttacaatgttcacaccaagaaattgatctaaacccatgttaaatccatcctttcattatttgtaaaattcttattcataacctaatttttaacagtagcaatatctggttctaaaaacactttattaagggtctttgcaggaacccaactatccttatctgaaatatcaaaataatcttctgcgtatcgaaaaataacttggggatcatctggaaattcgttatcacttaaataaattccagaaaccgaatcagttaattccaaattacttgcatccgcgtagtaatcaatggagtacacttctccatttgcgtagtttgtaaaaagcttcaattcgtcatcaaatacttccaatacatggcaacgcacagcttttgtaatacgactaacatggtactcttgacgaatgtctttaagcgatacaaaaatcatcccgcaaattgcgtaatcaaaacctgcatccgttccacggtaatactgaacttgtgtatgtttaaaacgagtaactggttgtaacaaatacccatgtttataaccaagttggtaaaacgcatctcgaaagttctcaaaacgatgcgaactcggattaattaattgagcgtagtcattttctccaagtagttggattaaactatcttccatattttggggatgttttccgtcatcagaattagacccatcatcaaataaccataacgtagctagattgtcccattcacgtgggttttcgccacagccatatgagtcatatgacaactgcacagcttcattggtctttagatttattaaatacataatctttactcctttagttagtaagcaccttgctacattgccatcaagcatttagtaataaacaatcactttaataattacattagaatgattgctaaactttttaccaaaagtattacctgccttttcaccctacctggcaacataattttttaaaataaaagaccactaattattgattagtagtcttaaatccttattctttataattttatagaaaacaattaggcaattaaatgtagccaattccttatagattaaaattaaaaacgtttaatatatactgagctattattaaaaactgacgctttggtaatttaccgatcagcttggcgttccgatttcctgaaggagaaacatcgagagtaaaaatctgaccagtattcaccttacttggttttgttaggccttcatcttcaaaggatccatttagggatactaagaatggtctactctttgtggtagatgtaatgggacaaacaataaccaaaggagatgaacgattatattcatcccgactaataaccaaagctggtcgtcttttctttatctcatgtcctttagatggttcaaaatcaacaattatgatatcaccttgatgaaacttattcaccttctgcacctcctggcacaaagcctgttgctaaaccatctgtatccatatctttatactcattttcagatacattagcataaatatcaggtaccttaggaattaggatcaaactgccatcagtttctttactaataaaaaattcagttccgagttcataacctaagcttttagaaattgttagaacaagtgagtttccttgttttctgattttagcagtttccatgataatttctcctttttattttagtataacacgtatcactcggtattacatatggtacatatatacataaaagctttgtgagacactattatggattcttaactaaaacacaatcattaagaatatttttaacttcatcgagataatactgagttaatgttgtagtattaggaaaccaaatcaccattggataatctacccatgtaatttcttccttaatatccaaaacagcttccacaggcctatgaaaattaccttctgttagttgtttataaactatttgtattcttttcttagttgccttaactcctaattcttgcaacataattttaatcgctaaatctgctgcctgtgaatatagggctaaatgcgcattcatccaatactttgtatcaatcaatttttcattttgcttattggtttttgcaacttctttaattgtggttgccatgtttaataatgccaatttttctttttctattatcttagtattcataaacagtttccttattttagaaaattacttttagttccaaccataactggtttcaactacccaattatctttagttaagtaatggcaactttcgtcccatgtgcgtgacaattgaaggcccaacgcttttaagtcaatgaagtccattgggttcggtgcgccattgtaatctttttgatccaaatgtttatcagcataccaaccttcggttaattcgtaataggcataatcttctaagctttcataaacaaatagctgatcatttttccactcaccatcatcaaacatttctaataattcttttgctaacgatggatcatttgcttgcaaatcatcaaaattgtcgtaccaggaccccgcataatcttcacatctttgcattttgatttcctcctcgtactattgaaatgaaaattaactgaatattatagtagtaattcactttaatagatcatattccgttgcgactcggccattcttattagttaaagtccaaaatgtgttgctatattttttataaacaacatttttcttaaaacctcggaatggtgttttcttcaatttaatagtaataataggtgaattgatatcattacctgctaaacgattactaattttctctaaaattctattaggagtttcaaagtcactaaaataccagatagaattttcaaaatcatccattgatattcctctagcgaatttcggcttaagacagcagtacaatttctggccctcatatactaaatctttgcaatctgaaggaccgacaaagactttccacgagaaaagattaggttgtgaagttacatctaagtgtcgaatacgaacttgacgactgtacacattaaaagaatttcgagaattatttacgtattctttaaccggtaatgtttctaaggcgaccaaataatattcttccttaacccttataagctgttccatacaagtatcaccatagtaaatttccaatttagcagggatagtttccactcttgaaaagtatgttaaagctttattgaattctctaataaaaaattcttgtgcctgcgtagtttctaattgtgtttgaaaatagctcactttgtccatctcctaaatatccttatgttatttccgtcactaaactaattaaataactatcattcagctatcagattaatcccaatggatagcaaatatatactctaagatagcttgcagttatatacattattactgctatagtctctgtgctgtcctattttccaaccatgctcttcaaataccatggtactcataccaatctcatcagttagatactcattttgaaattcagttaaagtatccgaattttctcgctcttttaacgcctgttttaaatacctgcgactaaaagaagcattaaatatatcattaccaacggtggtacttcttgaacgattcttcattactaatactctcatcttttcctccttgatcttccgatcgttatttatccgtacataaaaagagaacctacattggcctcacctccttaaaataaaagatctaactaattaattagaattagttagatcctctactagttattcatcattttatctgcagcctcaaacaaagcatcccattcggtatcatcttgactattattatccggcttacttttcacactgctatctgattgatgcatagaactattcgatgatgtaattgtttcaatctcaccaggttgaagtaaatcatcagtttcgtccatcttgttgacatcatgatacacattttcttgctttgcattagcgatctcattgaacgttggtcgagttaaatctttcgttacgattggttcaccatctgtattaacaagaatatcggtagctggaatagaatcatagtcaacatgcgtttcatcgctttgcttagttggttgctccttagcacttttatcaagatcctgagaagcaccctcattatcttttcttatatcatctatttttactttatattgaggagcaattccatctttacctagctctggagcttgtggaacaaacggttttatactactcaatatttgttctctggtcattaactgtttagttgctatttttttatcctcatcatgtttgtcactatttgtctttttcaaataatgactagcaaaacgataaacggaataaatcaataaagcaactatacttaaagctataaacaataaaaaaacagagataattaataaaattggattactcattttttcctcccttaattaataattaaattttaaaattaaaaaaggacctcaagaacgggccttaagatccttaaaaagatttctgaattaaatgttaatgtttataaacaaaaaaataatgatactaacactggtatcttacggaacgaaactactacccacgattgggtaaaaagaattgtaaatcaattcaatataattacaaattaattatatcaaaatagcagcaaaagttaaatatttttgaaacaatgatattattcaatcctaatttgatagaatctaatgctgaaatgatttatctattctcttaatattttcaatttgtgaatttttgacgtttaaattttaagaattatggtattaaaaatagtatttacgttttagcttattactttatgatatgcttatatttgaaaggagggataaaaattgaaaatggaagttagctttgaaatgactgatcttttgctcggaaatttcacaaaccaacttaagactgggtatcaattagatatggtcgatttatctgtccctccgattatttctttacataaagcacgcatagataacgttaatgaatattctttattaatgtcaacaatgtgtaaattagatggacgaattctaactctcaagactcctctagtttactcatataatggggatgtcaatgatgacctcaatttggtttgggaacgctacaaggctctgacaaataaaaattctccatttctttcaagaatttgtgatattttaaaatcatttggagtacagacagtccagataagaactaatactgagtctattaaaaggccagaatttcaaactattaatctttaatctaaaaattgctattccttataaataacctcctattttgaccaatcgaccaaagaggaggttattatccactattatagtgaatcactcatgcaacagtatctgaataaagtaatataatatcagaagcaataaatttatttttctcagtatcctgctgcacttctaccagtttacgatatattattgaaccattatctaagtcatctaccttaaaattgtacaagacccacctgctatgtgggtaggtaataaaaagtcataaaaaacattatggagtaataagtgtaaagtaattacaggctaatcaaaaaagcagtaaataataactatttactattcttaatcatattcccataaagcatagtagagaaaataataactatacttgcaatcattctgtaattcatagtttgaattgcgatcattgtcactgccccacttaaaaataacaataaataataaacacttttctttattatttctaacatattagtttcctttccatgttaaatattcttgaaatgtttcaaaatttatcaaattatttgttttccaatacataacttcctcactttcatcaccacttttttctctaagttcaataaccttttttaagataataaaaacttcttcaatagcggagcttgaagaatgataaaacaaagacttgtcattgatgcgtttttgaatttgctttctaacacttgtaacccattttttatctctcaattggtattctaatgcattgcagtttgcaataacttttcctcccatacttgtaagtactttacacaaataacctgttactgtagtatttccatttgaattacaagtacttaaaactaaacacggtttaccatctaagcgtaaggtatgtgaccaagtagaaagcttttctaatattaattttaaatctgacgaaatattatgcatatatactggagaagcaactacaaaacagtctgatttcaatatcatttcttctaactcgtaaattttggaatcaccatttctttgagtatagctaatatcatataacgtattcgggttgagtctcatcttgttaaagtctctacaaaacaaatattgaactttatactctttgctatctagattgttaaagaggctttctaaaaagaattgcgtcgacccttgatatctacaactgccgttcagtactaatatccgtttcaaattcatcatcctttcaaaaaagaggctgggaaaatttttcaccggcctcattctttatatcaaccttgttaagatatcatggggattaaccacaaggcggttaattactctagcaccatcttttatgagtaaaataagcactaaatgctgcaccactaccccaacttagacattttccagaagatgcacgtgatacttgaattgttgcccgtgaaatcgcagaagctgctggtgttgaatccacttggtattcacccataccttgaatttctgtcattttttgtaaactcatttcctcaaagttattacctacaattttttctaattcttctttgtccataacaaatacctccctttaatgatgatgcatagcatgtcttgttatattggctgtaagagctgaaaaggcagcactttccataaaatatccaggcgtcgaatctacttgatattcacccataccttgaatttttgtcatttcctctacagtcatactttcaaacgaattccctattacaccttctaattctttttcttccataattttcaccccctttcaatttccaaaagtaatggattagttttaagccctttatgacataataaggataaaccgatacccgaaagtccatcaaataagcctaacgcagaaaactttccaaatcttctaatagaatagtccttatttaatatgtaatttcctagcataatattagttagtaagttggtcttttccttccatttagtagaacccgtctgcataaaaagttcatgcataatcataattattcctgcttttccgtggcataatgtatcattccttggcgcattttctaaatcatttaatttttcttgtgcgtaattattatcaagttgcatataattacgcgctaaaagcattccagatactcctttacaccatcccatatcattcttcacaggagtaatttttttcattaaagcacttgcttggtctagctgcccaatttcatataagcacattgcgtctccacaattaccatgcgcaacaccgaatttacctgaatgcataatacaattcataaactttttttctaatctattcattacattttgtgagatgtatttaaatccaaataatcttttctgtaaatgtaaaagttttataattccacctaaaccattaataaaatcactaattagttcgcctttttcaatgttttgctcaatcttcttttcaagctgttttaaataagccacttcttcataatccaaagttttataaagactataatgaaataataatgggtatagtggcgataaaaatcccttaaaggctccttgtacctccagatctaatgacatattaatggatgcttttaatagtttcttcgcaaattctttatatctagcttcgtttttttcatatcctaattgtataaagaatactgttacaccactaattccacaatatagactttcatccataggtaaaatatcccaattgcctgcattattgatatttatggtcgaaataataacactattttcatcttcgaatgcactattcataatagtatccgcaatactgcttgcttgtctcacataattaaattcttgatctaacaaatctcgacttttctttcttacatcagtgattctatctcctactgataaagaagctaatagaagtcctctttctttttctatcgtttcgtaattgaaattattgattctatctaatgcaaggttaagtcctgatttcttaaaatatgcatcataattttttcctctactatcagtaatacttgtcttcccaactacagcagaaaaatagggaacatccccaaacagtaaatcttcaacttcactatttactattctcttatcatcatatggataagcagcaatatttaacattagcctttcacgatatttcatttcaacattataagatgggtgtgctgcataatttaacatcgtttcataacgttctgtactcttcgttaaaatacgaattctaaagtttgaaaattctttaacttgtttttttaactctttaatattattactaacaaaacttgtcattttgttataaccatctagaatcgctaatctatatttttttacattaacttctttattattacaggtaattggaatattttccccgcctttaacgtatccttgtcttctcatttcaaaatgaaaatttgaattttcaatatttacgggtacgagtactttatttttcaataaagtttctcttccttctagtccacttagttctatcgcttcattatttcccattggtaatttcgtgggtaataagcaggaaccctttatcgaatctctattcaaactcattaaatattttccaaacgcgttttgaggagtaattaatgaattttgaaacatcgtttctccatcaacaagaattggttggtccttttttgcaattatattctctaaatgcaaatcgtttagccctaataaataagaaataacaataaggtatccataacgttcataataatcggcacattcgtctttacttattacaggaacccgtgttacaaattcaaaaaaagcataatctttataaaataatcctttaggtaaaaaatctatatcaagtaaagttgaactagacttattaatccaattacaaaacttttcaaattgctgaagaattctaagatcacgaggtttatatactatttttttatgatttaattctaagattataactgtatttcctttgcaatgggaatctcccactccaatttctatattagttaagacaatgttttcttgtttaagatgtaagaaattacaaagatcatttctatgggtgccaattgcctcaccaagttttgataaatttgtcacaaaaaaattgacgcgcgttattattattctagataaggttggatactttcttaaaaacgctttaaatctagtttcattacaaaagttttcttttataaaagacgatagtacatctgtatcagcttgactaattcttataccagattttattttctcttttttatatttatacaactctagtgctagcactttcccactttgtctaaataaatcattgattagaaactcactcatagcttcgctggctttagtagtaattctaatttgatgattccacccatcgtctatcctctgcattgcatattctacaaaaggcttaaaaaatacatctagctttaatttatgcaaatgtatgttactaaactgaaatttttcaataatttcaaccaattctttttcgaaagggatctccgaatctactttaattaacggttgtaatgttttcttaaaatcatctaacagcaaatgggcattactacagtactctgttaaatcctgttcattaaataaagtgcgtgtgtttttccattctttataatatttatcatccagaaacggtttactatatatagcacgttcttcaacggtaaatgcatccgttaaatttaaggttttcatattacagtcctccatttgtatttatattttaaggattttctataaaaggaatactttttttattaaacgcaccatattatgaataactgcgtttatagctaacttcaaaagctattaactgtttaaggttcattctgtataaacaaacatatgaagttttctaaaataaaaaccgtcctaaaactgttagattgtataaccacaattttagggcagttttttcttaaattgttttattattcacctattttgagggttcatattacattttttgtcatcctatgaatttaaataagtttttttctttttggttaattcttcataggtaccagcttcaactattttcccattttttaatacatatactttattagtggacttagcaacagctagtctatgagtaataaaaagaattgttttatgtaatgtcattaaatttttaataactttatgttcagtaatgggatctaggccactggtagattcatctaatattaatatttttgctggcgataaaattgcccgagctattgctaagcgttgactttgaccaccagaaagaattaagccaccttcatcgagctttgtgttgtactttaagggcatttcatcaatttcattgctgatacatgctattttgcatgcatttataatttcttccatactcttttctttatcacatccaacgatcaaattatccatgatagatcccgagaaaaggtatgtttgctgaggcacatagcatataaaatttcgtaattgataagtactaagttgattaatcttaactccatctactaaaatatctccactatttgattgtaaaaatcctacaagtaatttagctattgttgattttcccgacccactttgccccagtaatgccactttctcatcatttttaatccgtaaatttagtttttttaaaacttctttattattagcataatgatatgaaacattctttatcactaattctcccttgcttaataaattaagattattttttctttgttgtagtgtgataccattttgttcttttttcgaaagcatcacatcatttaatctatcattcgctacctgtgcattttgcaatttgggctgtaaattaattaaattttgaattgaactagtaaagtaactaaataaagcattgaatgcgaaaagttgtcctagtttaaaatcattattcattattagatatgctgcttgccatattattaaaatatttaacactaactgtacaaaaacttttaatgattcttgtatcgaattagctatgttatatttcatcaaagtttttaacaagttagtaaagctattttcgatttttgcataaaattttgtttcagaatttaatgatttaattacttctataccttttatactttcaataagtaatgcttctaactctgcattcctgatcattactttcttacttaatctatcgaataacctagtaaaagaaataattattacaaaataaattggaaaagaaaatactgctagaaaaaataaatccttactttgaaaaaataaagcacttcccaacgtagtaacaattattgtatctagaaaaagtgtaacgactgaaccagctaatgcttctgtaattttatttgcatcattaaaccttgaaacaatatcacctgttgttctagacgaaaaaaatcctatctgcaaatcaaataatctttttataaaatttaaaagaatatttttcgataagttctgtcccaatactactagtgcaattttttctaaaaaagaaaaaattgcactaaaaaagtataggattatcaatccaaacactattatagatagtaagttatatttactttttggaatcaatgaatcaattacgaactgtaaggataacgaactaattatatttattaacaatgtaaagattgcaaatagcaaaatttttattagaagcaatttattactaaaaagttgcttaaataaatagttaaaattagattttctttcatcaataggaataaagttgtctgctttcgaaaaaaatattgctgctccactccattccttaataacttcatctatttctttttttatggtccctattgttgggtctggatcagcaatatacacttttttatttttaatttttaaaactacataataatgcaaaattttttcttcttttacaatatgaattataaaaggaaatggtaacttttcttttaataaaaagttgttttttgcttttaccgccaaaggctctaatccatactttttagaagcttctactaagccataaatgttcgtacctgaaatactagtattagcagcattacgcaaatgttctagtgaaactcgactaccaaattctttaagtatcattgctaatgctgccactccacaatcctcttcatttacttgaggaatataattacgataatacatatatcttcctcccacctaatcataactaaaataaattaattcgtatacaattaatattaagcgtatggcttttcgattagacgcaaaaaaaggattttacaactaatttagattcaattataattaactaaatttcaaatttattatattggagtaatgtatatgaaagacactaattatataaaaaaatctctagagaatcgcgaaattcaaaaactgactgaagatgaaatgaaagctttcattggtggaactacttatcatattaactacgatggatatgcgccaagtaggaatccatgggcttggctaactcactgggggcataaacactaataatgaactatataaatccattttacttatatgggttagaattttttgatttatttattaacacattgttaataaataatatagctggtaaaaggaaaataaatctactttcaatctttgaaataggagttatagtcttagtattgggctattatggatatacaatttacattgcatatgcacttcttttcttgtataaaaattttaaacataataagcgggtcttgaattttgaagcgcttattatgtttgtatgcagtttatttgtctttcttatctcaaacattaatagtttcattctaaacacctggtttttaccacattatagtaacgatgttttaatacgttttcaaatagtaatttctgttattatttctataatgttagttagtatttcgtttttttataatcctttattttcgaaaatttcgaacaatttatttttaaaatataaaggtccaattttaagaaaatttgtaattacttatgaagtttctttcttctttattataggtattgcttctattgctgaatatttaaaaatagaatttaaaattcaatggcttttaattttatgctttctatttctttcattaagcgtaattatactgaccggtattatgtttacatacaatagtaaaatgattcagctcgaggagattagaaatagttatattaataaacaattgtattggaaaagctttgaatctaactataaaaagttgagaaaactgcatcatgactatacgaatcttttaataacgttaataaggttaattgagaataatgactttaaacatgcaaaatcctatgctaattccttattagattacgatagtaaagtatattcgcctccttcattcgatattatacaaatttctcaaaaaatttataatcaagaattacgagcattatttttagaaaaggtgaatataataaaatctcagagaattaaattgcatttggaaatttctgataagatcgctataccgtctaaattattaattgatctattaataattattagtaatttactagataatgctacgagtgcagctttacagagtgaccaaaaatctatttctataagcttaaaaaaaacgctctctaattgttataaatttactataaagaattcaataaaatctaaaattaatattgaagaattatttactgaaaatttttcaaccaagaaaaaccatatgggaataggacttaataatgttatttcaataattgacagttcaccaaatttctttttagaaacaaaatcttttaatgaatggatcgagtttgaactaatattaaagaggtgatgtcttatgacgttagagatattattacttgaagataatcttttgcaacttcaaaaatataagaagataatccagaatagaattatgattaatcctagtaataaatcttatgatctagagcttgcactctactcatcaacttcagatgaaatacatcaatacctccataataatagtaagaaagatatttttgcctttcttgatattgaaatagggtctacgtattcaggaatagatatagcaaaagagattaaaaatactgaaagtcaaaattttagagaagtttgttttatttctacttatgataatcttttaataaatattattaatgatcatgtatcaccttttgactttattttaaagaataatggaatcaattacgttaccaaaaagattcaagagaatattgactgggcttatttaaaatataaagatttaattactaaatctaatcaagaattatttacatatgagtctttccccggatatattcatcgcattcctagagataacattctttttatatctactacttctttgcaacatcgtttaagaataacttgtaaagataacgaaatactttttcagggggaattaaaaaatattgattccaaaaataatgcattctttagagtagatagacaaattttagtaaacttaaataatatcgattatgtcgattttcataaaagaaaaatcttcttcaaaaattctaaaaacaaaaattgtaaaattagtctacgtaaaatccctcttcttagaaggctattacaagaaacgtcgtcgccggtcacccataagaaacaatgatattacattatatcaagagttgaaattttgcgtatttatttaatgatagagcgtagtaattcttcatccaaaaaccagcaagatctttaaatttgcagaatgataattaggtgaagcatagtagtatcactaacacaaacaaagccccttggcaatcatagtcgattgccaaggggctttgtttgtgggctactctcacgaatttcttaacgtttatgatgcttcttatatactttctgatctaactgatagtagtcatcaaaaggttgagcgttaacctcttttaggttcataaatggatctccagcctgcacatatcgacgaattggaaaattccatttatccaattctgttgcaagttgtgtttgcttccaagcttcataggacttctgatactcagcggccttttctggatcttcttcattctcagctttctttctaagtcgttcaatgcgatcattctcgtataacatttttatgtcatcttcaagaggaattccatcttccgtccttcttatcttgtaagcaaaactgaatgtatccatccacagaagagcataaccatttatattagctcgaaagaccgcaataataaatccttgtatatctgccattaagttcccctgccaaactggtagtgtctttcctagataacgaataaaaatcgttaatggaattgatctatctaaagagattggtcgttttaattctttttctggcgaaatatcaaataagaagtaacgaataggcgtgaattgagcaaacaaaagtgtttttaatacattaccactagccataaaatacaatgcgtcaagaaaaactgcaccccagcagcaaactaatgcaatccgggaaataattcttaattcttggtccattgaagtattcttaaggtttatctgccgtggtcgcaaaatcacacccccgcactcgttttagaaaatatcctttaatccttttgtaaaagtatcaagtaaattaatactctcgtaacctggatgatttgaaataaagttatgcatatttggtttagttggctgcatcactgcttcattaatataattttgaataccattctgtctacttctgaagacattaatcatatcacccttcaagttcttcaacttagttggatctgcactagaattaatcggattaacctgcgctttatctggatcgataacataagtaccagcagattcatgaatgggaagtttgaattcatatccactatccatccccggccaaatagtgttatcaaattgttctgataagactttggtttcaccatcttgaggatcaacaccagtcataacaacaccatcgtagttaccacgaatctctttgttagtaaagtgagcaaagtcatcaccataaactcgctcaccattggctagtgcccggcttgtctgcggagcatatggcatccccatgtaatcactaatcttataagggctactacccacacttgcactgctatttccactaacatcagtaaagtaactaccaatatctggtgccccgtatggcaacgatatcggaattcgtgattgaccactaatccgatatggagtagtggggcgatgcgtcattggatcaactctagtagttaattcaccacttggtgacatatcataatcttggtatgcttgttcattagcacttaggctaccatcaccagggcctaaattcccaatagtatggtagttaccagcactatccttagcttgaagcattgaataattatttgtaattactgaacgcagagagcccggagcaattcccgtcggttctccttgatcattccgctcaatcgggatcatgtttcgtacatcatccatcgtcatactatgaccagggttactgtacggattactactagtaagattatcaatgaatccactacctgatgtaggttgagctgattgactggcaagtcttcccatcctaggattacgattaagcatttgcgatccaaagccgaataatcccattacctgccttgtcatcctactacttgcacctgcttgagtagcttcagcggtaatttgatttaacttggcccactctgcttgtgattcgttagtagcagcataatttcgtaagttttcatcgttgaaatacttctcataatcagctggagtagcaaaattactctggtcatttcctaacatgtttggtgcataaatctttgagatatctgcacccgtgacgggtcttccactaaccgtcatgccacgtttacgcattgcataagctcgttgattttgtacttggttcaggagatcctggttaataactcgcacagtttccccatgacctgcaccgatggtttgaacaagacttttaccttccagaccttctgtagcattcagtaattgagatcttaacgcaggagtaacatttaatgcatctaattgcgagtttaaattatcaccgaaccgattagcgtcaatcatgctgttattaaattcagcatcattggttaaatcagtatgagctacaactcctccattagaacgaatatatgcttgatcaacagccttcatttgggcatcttgtagaccattacgatattctgcagtctgcttaaacttagcaaattgttctggagtcattgtctgaccagttttaagatcataagcctgctgagcttggtgtttagccgctgctatttcattagttgagatgggagttcgtacatcagcagtagcagcacccgcagcacctgcagccatttgtgaggctgcattaagatttcctcgcaaattgttcattgccttattagcgctggttatcatcattgcctgccgttctgattctggagtattgtcaaaatcgtgttcgtgactctttttccaagaagcataattaaatcccattgcttgtgcctttgcctgaacttcctgttcagtttttggcactccatgagctttatcataaattgaaccatctggtaagccattaataacctcacgggcgttagcttgcacatcagaattagggacaaagttaccgttaatatccttattcttttccatttgtatacgctgctgtttagcgttctctgatggcttataccctttcccgttcatactattctgataggctttaatattacgcttagcagcagctcgatcgtcgtcacttaactttgaattattatctacttgatcaattaagtcattgccttttggtcccggattggcatcaacacgactttgctcaaagtcatcaagagttttcccagtagcatctcgtaaagctttaacgtgttgattatgcgcccggttcatattagctcgttttaagcctagtttaaccagtccaccagcttgctggtttaattgtgcagcacgggccccaatttcaccaccagctactgataatgcagccatacttgctatattaccagtacctgctccaatagaagcaccgataagtcgaccagcgttagggccaaccattccattcattcgtgccagagcctctttagctttctgcttctgcatataagcctttccatttaactgttgaatagcatttcgacgtttcagcaatgatctactatccagagttccatttttctttgctgcttcaagtgctgattcatcatgttttttcttcaaagcttcagccgcaaatgttgcaccgtgcccagcactggataaacctgcagcggccccaccagctaaacctaacgccgcggttccagcaattgctgctcccgtagttaaggttcttgaagtagatgagtgtatacgatctaacatattcgttccaataccaaataaatcagcaattcctcgagaaacaggctggaaaagcatcaagataataaatcccatgactaacatctcaaagtgactggcaacagttaggtccttaccagtcattgtagttatttgagtgactgccgatgaaatagctccaggagatgtagttgatccagctagtgtactaagagcttgattatctttttctttagccgcattctgagcaagacttccaaacgttgatgaattaatccacaataagaaagtcattaatgtcaatgtaaatgcttgaatagcttgaataaagatagttccaatcagatcacgtaaccaattcattgttcttgcttttccaaatccaaaaggccacatcgctaagaatatcggtccaagaatgatcaaaataataaacaccagcatccgtgcgaaataatagaacttaatccaaattgctagtccaacagcagtgcataagtaaataatgacgaaaataatacctgcaaagccgtctcctaaccaattcccctttgtaatagcattaatagagttgtcatcggctcccaattgcaaacaagtcgtcatcaaagtatgaccattaccattggacattccttgtaaaaaattagcaaataattgaagaaatgctccgtccaactgcaatagcattctaatgaagactgggagcaaaaaaataactgatacagaaatcataatatcgataaagttttgataccattctgcccgtgattgtgctggactgaaagcttgtccccaccccatctttgttgctccaacaataactgctactactagcataacagctgctaggccatacatagcaggactaatagcatcaattgcagcactgaacttagaagaataggcagcagaaggaaacattaattgacttggatgattattaatcttgtcgttcaattgactagcaacatccgcatcttcaactttgccgtagccaccatctgttattggattgtaagtaaagacagtccctgcagcaccattttgttccaaccatttgcctaaacctgatgcccagaaaatatgaagtaaagccgaagcaatcttagacttaaacgatgagtcttcatcacttttagaatcatcacttgcctgttttgtatctttgttaatatctttattatttgcttgtgcttctttcttaaattgtggatcactttgggataattgctcttccagatattttttagcagttgccggcatttttccatccttcatgcctcggtcttttaaccctttcataatttcagcatacttagaaggattactcttcttcaaacgcgctaaagcatcccctgttgctgcatcccgtttagcgatatcacgctcataagtattaaagtcatttaataaagctgctgatttttcaccggaagttggtttatgactagggtttacagctttagcagcattatatttagcataattaaatgggcgaccaaaatagtacctaataggatggtcctttttctcttgtgattgttgcttagaatagttttttatccaagccttctgagcctcctgagttgcagctggattaaagactgaattagcagcgtaagcagtcgttgatacaaacaaaatgactaagataattaaagaccatttaccttttttcgaagaccagacccgcttaaaaaagccgggacttttctttttcctttttcctttcaagagttaagcctcctttactgtaaagagttattaatcatatctacaaagttcttctgttttctagcttggccgactgcccggtttgattcagcaaatttcatttcttcaggggatgggttggttctaatccaaatactttccccttcttggcgtaaaataccctctccaggttcagggttaccagtcagaatgtctaatgcgccatcagtcaaatcaacagtattcttcatcaattcacgatgttcaggtttggtggccaaaatatatatgaattctgagttagtaactaaggcctttgctcgtggattaccttggaatcgttcaatatcttgtgtaagccagcataacgaaccatttcgtttacgatctcgtcttacaatcgtttcaaagaactcaaacattactggatcgtcaataaattgtagaatttcatcagcatccagtacttttttagtcattgctttagacggattcaacatccaacgttcccatagatattgggtaataacataataagtaacctttttcatttcaccgcttaactgtgaaatattgaagtttacgtatttatagtcgttcaaagcagctgaacgtttttctccaaaataagtttggccatcaaaaattggacggcttcctgtacgaagatatggtttgagaccgtcaatgagtctagttactttaggatcttcattatcatcttcatcagtattttgatcgatcaatgcttgataaatgtcgcttaaagtgggttcaggctttggaagcttttcatacaattggccatttaaaataccaccatgatcttcatatagagaatcaggatctgcagtaattcctaaatcatcaattacctgtttaattgcactttctaatcgacttttctcactagtattcatccctctatcattgccatctgccgataagattaggtttacaaagccatcaacattattgatcatttgagcaactggtaccttctgcacatatttggtcccatcctcatgagtagtaattttccggccatctgagctatatcgaatggcatcttctatttcttcctcgtccatttggtgaccgttctcatcagtcataatttcttcttcaagaggagtttcagaaactgaaactgcacatggattaataatgaagtctgcgtctgcagtgatagttaggttcaattggtgtagttgcttagctagcattacatactcaccatcaggatcaattgaacggtgttcgtaacctaacaagctaatttcacgtgccatcttaatcttattagaggttgacttacccccaccagattcacctacaaagcccatattgtagttaattggtcgatgcgtattggtcccaaagatattcaagaactccgtattttgtgaaggagttgcttgattaactccaaacggaattcctccattaaaccggccggctgcattacgggcaagatccattttagccagtgaacgacgatcaacatttcggtaaatatcatctaggttgtacattcgtgatccaattggaattgattgtagatatccactttttactcgtttagcaaacggtgtaattgatatcccttcattggctaacagatctgatactgttcccacatttcgattcaattcccgatcactagtaccgtatacaataaaggagattgccacatcatatagacggttttcatcaaactgaatctgatccaaaaagttattaatatcgttgtacttagtgatattttcacgtaattgaaatgtttggccttgctgattttggaaaatagcatttgagtgaataacattcaaaatattactcaaatttttcattgattcccgtcgcgtacgtggcactacatcaatcgtgatatctacgtttccctgagcaagtacttcttgaaaaatatttgtatcaagcatccgcggatatcccgatggcggaacataaacaggcattccatatgtcctactctttaaattttcgcgcattacaaattgttcctgcatgaggtcatctgttgaccaatagctgggtcctataacttgtaaaatacttggctgacctaattcagttgacggagcatcctttttctcttggtattcctcgtttgcttgtttattttcatcatcaatattggcagtatcattttctaaattttcatattcttcataatcttgtgtattttcttcgtcctcgtcaccaaagtttacatgaagatcttgatcttcattaatttgatcttggtcattaatctcttcaaattcttcgtcttcatcatggtgacgattacgaaatcttccaaataatcccataattttcctcctcatctactggtcagtatcatccacttcagtagaaactgttgtagccggttcttcattcaaagctctttcttgctcctccgcatcctttgctttttgttgttcaattaaagcttcacgagcagtgttgatagcctcagtttcaatctgaatttgcttaataatttgtttaaactccttatcattttgatgtgaactagtaaaccaggtaaaacgctgtttcttaactatatcctccaaacgaattcggacagaactatccctgttaaaggttttatacaacacttcaactaatccaaacgtatccagctgagataatgaatggtcggcacgctttagtaatccatttgcacgttgaatttgtcgagttaatttttccattgccttctcgtgtacttgttgttcaatcgcccgtggagtatcaccaaagacttcatccggcttaacgatagctaagaactgaagatagcacttattttcaaagcgatctgttgcacgttgatactgtaaggtatcttcaataacttggtcagcatatgctttcatctgctcattcgtgcctcgcagatattgtgaatgttttttcaaactattcaaaaagtcattcatttctacacgttgactctgtgatgtgattttaagtggtgccgtaacactattaaagaaaacttccattacttgattattattggctaactcttcatcagtcttaagatacgggttagactgagccatttcagcaagcatgataaacattcgagaattatcaccagtctcatactcaatcatgccgttactaattctaattacaccgacttcttttaaaaggtcctcaaatgaccgccaatcatcataggttaaatcttcatcataaataggtgcttctgctggatcatcatcaatatcctcttcaacctcatcttcttcatattcttcatcgtcttcgtctctatatgattgccgatcttcaattggattaccattccgatcacgtggggtcatatcaaagtcccgttttcgccggcgccttataattatccaggctcctactgcagcaactatacttagaccgagaaaagaaaatattataataattgtgtccaccttcttaaattttatcgaagttaaaacaaacagctaaccgccactaaaaacggttagctgtttggtttagcggcgataatttctacgttggcgttttctacgacgagaattattacttcctttgccaccagggtgaccaaaactaaaaagccagcgccaaaagccataatcatgaatcgcttctgactgtcgacctggtttaattagaacaagcaaaacaacgcctgcaccaatggtaaaaagagctgcgaaaaatgccatcattccaatagtttgatcagaaaccagaatattgagcattaaaaatgcccagattccaactgtccaccagatcgcattattgcgatactttcctcgatcagtttttttaccattaattctgcgaacatcactgttcttcattatcgttatcatcctttcttactaacgcatatggcaaacgtgtatttactgcatgatgattagtttgaatattcaaatacgtcccagtttcattttgttcaaatgctcgatcgatctgtatctgcttactcatgtagtacagaagatttccttgacgatcccgtattggccaaaacgctatgtacaaaaatggtgcaatagcagcagtgaaaaaaagtagtgctattagtacagctacacttgcacttgctccgatagccgttagtaagaacttaataacggtaaaaactattacgcctaatacaaggcctatcgccgagatactgacttgtccccaagttgcaaaacctaagacactcttttgttcaccagacaaatcaacaattaattcttgtcttccatttcccatagcgactctccttcaatcatctatcaatgtctttcacagatcattaattattagtattaacgtttaaagccataccaacgatttgctttgcgtgaatgacaacaacagcaccaataataatgaatactaatcctaccagagtttcttgacgttgccgtggatcgccaaacatagctgaagtaccgatcttcattccgcagataattgctgcaataactaaaataacagctgctaaactggttaatgggccaataaagccagcaaaaacatttccaagcacgtcattatcactaggaacatctacatgcttttgaaacatagatgttggatcatcatcagcaaatgcttgaatcataaaaaatttacttgatagataagctactaataccgctaaaaatgagcgacgtgatagcttacgcatcaaagtactcttctttacagttgtaaacattgttcgtaacactcctttcactgattttaaatagcttataacaaagaagggattactatctctaattctttgtatattgctacaaatctaatcgtacgggaatgagcattttcgtggttacaatattcaaattccacaaaaatgagaacctacattctattaatatgtatgacgtttttatgtttatatagtgggtatattttcttgaaaaaggttttctgagcaatttccataacgtaaattagggggatgtttatgtaataaataaccaataattgataattttgaaatgagattcctatatgtttatcgttaaatcatgtgatttaagaagcacttagtctaactgttgctaaacgtcttggactatattagaaatggaagtaaaaaaatatgtaattaaaaaagccatgtgtggtaaccattgttatcacacatgactcaaagctttctataccttcatacctgtcaatatattattgtacttacctctaattaatcctaattccggaaactgatgctcataataagaagaaattttttgcattaaagactgcttaataatgctatacagttcattatctcgatagtcactgtccgaacggattaactccgaattaaggccaatttgctttaaataaagttcaaatgatttagcaaaaacttctgttggggtaatttctgccaaacaacttttacctttacttctagctcgtactttgtcagcgtaagtatttacaatttccaagaattcaggctctaagctaagctgatgatctgaatatttaaaatccaagtaatgcccatattgatgagcaaatgatcgaattcctgcatgagaaatggcagctatttgatggccacttcgaaaatcaagagctattttattgctagtcggtacatagataccgtaattatctaatcgaattaatttaattattggttttgttcgtcctttcggtaataaaggtaatatatgagccaattcatttctaaataatttcagaagtgaagcattatcctcttcactagtaagcgaagcaatatatgcctctaaaccggaagtaactaactccttattagtatcactctcattcactaatagtgcttgatctgaactcataatatatacctgttgtagagaccacgaacttatttgatgtaaataattttcaacataacggattaattgattatgcttatttagattttgccaaacatccttatctctttcgggataagtctgataaaacttttcttttgtccagtcaccctctttttttatcaaaaatagtctattattagtgacaaaactgtttcgattaatgagtaattgctgaactaatttaagcaaatcactaaaagaaaatatcaaattctcctgatctcttgtgtattgataaaaaatatcatttagaatttttgcataccccatgatagttaatggtgactcaaaaataatccggtagtttctctttcctttcacatttaacattctgacttcaccagccactttcaaccgtgaggggtcatcagtcaaaataatgaaacgtttgtatctatcatttcgttctggaataatctggatgatttggtccgttttaccacctactactgacgaaagatcattacaatttttcacccttttgactgctttaatccactcgtgattttcaagattattttgtccgaattcaagatatgatcctactactttactagctgatgcatgagatatttccatatcaatattattcttggataaataaactgcagttttttgaaactttacgatcaaactctctgttttttcaaaaaataatggattactacatttaatgccaaggcgacgtttaagcatatcatttagcttttccgtcatctgacgttttactggtttcttagtaggatggttaaatattagatttagcgataattgttctcctttaatcatgttttttcctccaaacaaaaaaccatcaaattatttgaacttgatggcttccttttatgtacttctaaaattaaaatgtcatgtctgttactcaaacatttctcctaaaaaaacaaaaaaaggataactttctataaagagtcatccttttttattaaaatattatatttttcgatactaaacaaaatttactcagcactacatagtgaagaaaacgaaactctgccaacaacggcaatagataaatcaaaaaatgattagataattacaagtcaataataacataatttaattaatgttgaccggaatcacttgatttttagttggtgatagttgatttttcaatctgtttctttagatcatttattcccttaccgtgattaacctcacggataatacgcatcataactgccgttgaacattcaaagtaattgctaagcattttaacagttacacgctcattatattttcttagattcgtgtaccctgctacaactgatgcacgtgacaaatgtaagtgactatcactaatcccataatgtttcttaaagttcttaaaggatccaaatacccgaacaactatttgtactgggaaatgatgcttttttgttagttgatgccatgtaaattcttgctccccaactgctttaatttgattaaccttatagtcaatctcctctaacgaacagcttgaccctttgataggcgtgtagggtatatttgcctttttcattgtctgctcccatgttccaaaccgtaagcgggctgttgctgagcgcttatattgtcgatagtgtggcggatatcctaatttatagtataaagatcttatttcctgcaaaatctgttcatttgatataacaccaattcgatcatagtatgctttaccctccatttgagcaacaaactggttccacgtatgatacttttttaagattacgcctaaatgaggcatttcacggctaagaggtattctgcccttctcctccttaattttctgataagctaccctaattccttcttcaactgccttgctatccatccttaactcctattcttgggacattttaccgattgttaaaagcccactcatgatatgcttttgtgtaattgcctcctcctttttctccctttaaacacataatatagccaatcactgcttgcttatcgattggcattggctgatatttatgctgggtaagcaatttcacttttcgtggttgagctatcttatagtcaactttttctttgtatatacctttatgatacttcttgctccgtgatctgaataagacctggtcattcttttgtaaaatgccaagttttcggaatgcagcatcgtagtttaaccacacatgatctgatactaaatttccttcttcatccttaagattcttcaaacaaattgttggagttaatttacgatgacctttctcaatacgatcaatcctttttaaggctaaatgatcaaaacttgcggtaaatgtttgaagttccccggttccattttttaatgattctcgcatattcacaacaccttcttttatctcatgactagtttagcaaatttagatcaatcataacgatttttagctttcttttttattcctacctgtaattttttcatacactttggtaaaataaaactgtattttagatttacttttattcttgctaacttgtttagcgtcttttcgttttctagtactttgttgtactttttatttttcgtttactttttaatcttgcaatcaaactaggactttagctctctaactatggtccttttattttttaaatgtttaagggggatgcttatgtagagtatctatttatttgtctgttaaaaatactttgatttggaggaatatataatgacttattttgatttagcttgtctcttattaggcaagatgatcctatttatggtaacaattttaattctcggtttcttgctttttaagctagcaaaacactggaggattattgttaaatttattttaatcattctttattgtccttttttctttttcaaacaactgttaattaaaattggtcattcatcaatctgtcataattcttaagaggtgagcttatgctttttactattattttcatgctaatattggctctttctacagtggtatttggttttatttatggtttactctacgaataccgaaagccgttggttagattagttcttattattttatatcttccaaccgctttaatcaccaatgcactatcctttattggtaaacgtatttaaaattattcataaatcccactagctgaaaatgttagtggctttttttgtacatttttttcaaattcttctcgatgtattgtagtgatagtgtacttcagtagttttttcagttggtgagactggcttttcaatattaggtttagtgggaggagtaggtttcttttccttaaatggagtttgaggaattgtagtagatggcatagcccatgtataaccataagttccctctggtccttgaccataaacatcagaactataagtcatagtataactgttacttccaggtgctattagtcctactgtagccccatagtattgcccggcttctcctgaattgtcccaagctatccatccatcctgaccatccttataatttcttattaaaagatcgcctttagtaaaattaccacctggtataccatcagctgaatacagatcattgttttctaaaatagcataactaactgaattgtcagcattgaactttagacgaatattgtcattaacaaagacggatcccatcttaccgttgccgaaatctgctatcgatgatccggccagttggtaaaagctaatattatttgttccttgaacatattcgtgtctacctttagtagcatttggtccagcattaagactggaaactgttatccaagcattattatcaaaagtgattggattgtcattttcatcaaaaagctgataagttactgaaacaggattaacgcccatgtaccagaaaccttctgtcggatcagtattgatgaaaagtaaaggccaatcagtactattaccgctagtcgaatatttttcaacgatcttagtaatcttatgattattaccatcatcatcagtatatgaactgttttgaagattagtaaaagtggcagtaacactaaaattaccttcattaatattgtttgcaacaaaagcgtactgggttgaaacttccccatatgagttccgacgtgttagcgtccaggggtatttgccccatgacaaatatttagttccactcatatcataagtaaaaccagtctttccactttgatcagcatttcctagattccaaccattggaattatttgttccttgcgcgttactaaatactacttttgccctggattctttgcccaatttcaagccttgattgaccattccagagcttataacattgccatgcattgcaatgttatttttatctaaatacgccgcccaatccttgttgaattttttgagatctgtttgatatttagccagatctttctgatattgctcattttcttgattgtattgtgccaatttttgttgatagtcagtattagctttattgaactcatcgatatttcgtttctgagtagaaaaaggaaaagcactaataaccttgttatatcaataactataggaaatgtttaataggtaaaaaaagcaaaaagatatatgattagccggttatttttgactaagttatctttttgctttttctattttattaagctgttttggggtacttttttaccaatactctttctactcagaaacgaaataacactgattttgaaaatcaaattaaacaatacaaagaaacactcgctaattatcaaaaagatctgacatcatctgtcaaaattgatccacataaagtgatcgaaaatcttagtattaataatgatgcaggagctattggaacagttgattatctacaagcaccatctcaaaaaatcaatgctcctcaagcttcacaaattaaagatttagagggtgctactacttcagtaggaggttactatgaccatgatttgaaaggtgatttccttagagtaacctttacaaactttaactcaaattctacgtatactgatatgaatggtataagtcatcacattggtaaaattattgttacgtattcaaaccttaatctcatacctcaacaaaataggaattcttctcaaagaccagcttttgtagtagcaaccaaatcagttcctggacgtccgtggaatggagttgatacattaagcgtactaggagcagatcaacgttttgatttctatgatgatgctgggaactatattcaatttattcctggaactgcgtggatgccttttggttcactaactcgttcatggtctggtattcatatggatcagtatgacgatgatcatattgaaatggtaaaagctatttcaaatgcaaaactttatgaaattccagggggtaacgctaccttacatagtgatggaaatgtttattcagatccaggttaccgaattcaagaaaaaggtgctgtcaattcacttggaaatgacgggggtgcaggaattgcttcaattcaaaacggggctacattccgactttcaattcaaccttttaatcatagtgaaccacaaggagaacataacggagatactcctgattggaactttttcatcaataatactactgctttagaaggaatttctcttaaggttccagttcgcaaaacgacgtcaacacactatcactacaatacaaaaaagcgaaaccacaaacaagtggcttcgctatgtaattaagtattagatttccttgaaacgtatttccgttcttgctacgagagcatcatctattcctttagcttttttcggatcccaaagtgccatagttactttatatcctcttttgtgtaacaagttaatcattgatttataatgatcacttacttgaggatttttaataaaatccatatcaaaagcaacagttactctttttacatgtaatttttctaaggctggtataaattttctgtaagaagcaacacctgcaaccgctagaaaatcatgaccatatttatttagttcttcctccgaaaagttattagggagttttgcagacgctactaaggcttttaaaccgccttctgttaaccatatagatttttcttggctaatataagtatttatctttgcgtcataaggctttaatttagcaatttcttgccggtatgcaacttgaactggtgtcttgtcagaggatcccatcagcttattagcagatgaaacccaataatatttaccaccatagataggcttaaatattatcctatctttttccaaaacaccacatcttataataatgggcttatcactttttttaggaatttttccataagtaatctctttaccatagggattagctttgttaaaaacttttacatggtatttgttagtcccaaattcaaaataaatcttaacacgccagttttgcggtttctcaataatttttgccttaatcgaaacatgatcgactcgtgtttgaaaacctattatttcattctgcagattataatatggaataagcattccatcagtactgcctgagaatactgggtaagaatacactccaggttcgatatcaaattttttatttcctccatcatatttaaatgaaatatttttttctaatttaattttcttgagataaaatccagggacacctttccatgattctgtggatactccaacgttctctaataaagctttccactgtgagttcacgtagcctttattagatgaagatatgtcaaatttagctgccttaaaaggcgaaatgttatactcttgtattcctttttttgacttgtaaaaggaaccaaaacctcttgtcccatgcaaaagaatctcactaggagtcaatccacggttaataagagcatcatagtgatgtttggccaaaggatatgccaataatacaagtcggtaaagtacatccttttggtcgtcattagcgctagtaacagttaagttgttattaaccttagatggatcaaattcaacttttttgccatcattaatcttaaataaatgccctccagctactttaggcttattatcatcagttgatctcatacaaatcactttagttcctgttgcattaactagacaccaatcggtatgatgacatattggacattgagcgccatcaaacgtaacccagtgaatgttgcaacttttataatcagtgtcaatcattgatgattcatgtaatcctccaggaaattttttatttaataatgttaaatccatactcataaaaacacctccaataaaaaaagcaccataacaattatgatgcctaaatacctaatttatgaaaaaatattttaatacaaaaaaacgaaaaaactgattaccaccggtaaaaaagaacgaaactactaattaactctatagtaaaaaattaaaagtaatacttaatacaagctaattatagcatagaactattttcagaattctgtttttcgaaattaaaggagacattaggatttgccaaagaatctttgaaaatacaatagcagtaattgttgacaacagttgctgctagaaaataaactaaattatgagaacttaacataatattttttaaatgctttttcacagggacccttgtataaataactttatatttactgcttttgtaaactccaaaatcattacttctatgttctatacaatttttgtaactatcattcagatctatataatctattacatttacttttacatcagacatccttataacctccaaatttattatttcatagtaagtttaaaacataaaagtctctgatagtaaaaagctaaaataaattagttattgcttattgttatagatgaagaatgactatatttgttttataattaatttaaagaattctcgaagagattcttgtaaactacatctaattaagagggagtcaccatgctctctcttttttcgtattgtagtgatagtgaatttgagaacgaggcgtaggggtttctggaataattgttgttggtgtcacccacggaccatttccactttctttggtctgatttttaagaagagcatatctaactgtaaagtcagagttttgcaaagaaattaatccggctccgtaatattcattaatacccttattgtcccagctttgaccatcatgggcctggaaatcccaggtaccatctggtccatcattatgattatctgcatacaagctaccatcatcatgggccttaattgacgatccagctaatccatatgctttcccaccattaataatcttagcagtttcagtatttgtaatagtgctgtttaacgaagttacggctaaccaggctgtattattcttaaaatcaatttgctgatttgcctgattataaaacttgtagttaacattagttcctgttgtattaagatatccgaagccgtcggtaggatcggagaaaattattaagccatgtttggtatcacttgcatccgggatatatgttgcaacaatttttgagatatttatttttttaccattttcatccacatagaaagaattttgcaatccagaatattcaactgttaattgcccgctttcacctgaattccaagaatagacaatttgagaattactatctatttttaaatcttttttcatttgggcaaagcttgaagtattagtgccatactctttttcatttgctgcagaatcccagcctcgtggccagaaatatgaatcatcacttttgcccgaagaactaataactttaagttgagcgttaggttctcgaccaagtgttaattgctgctgtacttgatcagagcttaattcattactactaaaattatgatcttgtttccactgatcccattttcgtttctgagtagaaaaaggaaaagcactaataaccttgttatatcaataactataggaaatgtttaataggtaaaaaaagcaaaaagatatatgattagccggttatttttgactaagttatctttttgctttttctattttattaagctgttttggggtacttttttaccaatactctttctactcagaaacaaaagtatgcagattggaaggaaagtgtctctcttaacaaagatggagtaaccatttgggacattaagaataacctgcaacttaatcatgagcctaatgcggccgttaatgtaaaacaattggtcgctgccgatgcaacggctggaaatggtaatgtcctatattacaaaccatcaacacaaacatctggtgattttgttcaagttacttatacgaacttagataacagttacatcattgactctaatggacaaaagcagaaaattgctaagattgtccgtacttttagtgacttagcaaaatcagcatccgctagttctattagcttcaaaaagggaattttaagtaatgattggcgccagccaaatctcgctggagatgatagcacagctttactgattaacactgatccagcgaacggtgctatgtatcttaatgctcttgggataacggtagaagatcattattatgatgaaaatggcaatcaaattgatggtgatggcgggtactatgttctttcatctattaataataacgatggctttgataaccaccacgagcatgttaaagccccaaacaatgatatgagcgctatcgctgttcacggttcgtcagtatctgttcagtcggatggctctctatctagtaatatcggtaatagtctacaagacgttcatagtgatggatcgtactctgattcaaataatactagtacttttaataactgggataatgttagttctgattatttctacttcggttctggattaatgcaatacacatctaatccagggaaacttagattttacacgggaatgagtggggaaaacagtaatgatgatgaaaacgccttttggttcactatcaatactattttgccaaaagttccagtaaatactgaggtacactatcactacaatacatcgcaagcatatcttttaactccgctttaacacttgctctctttctatacatagaaattagtttttttcattttttgacaaaaagtaataataaatagtaactttataattgacataatatctattacgaagctactttagctataatatcatcttacttaaccatagtccaacaccatcaaaacaagtttatttttaatatttaacagcaaataaaaaagacaccttcaatttagagggtgtcctttttacaaatttttactgaggattactaaatactaggcttttcttttacgaattcctaacgaagctaatcctaaactacctgctaaacttacagcagctaatcccataacagcaatattatcctctttgttgcccgtctgtggcatttcagaagaatgactggtcgtttgactaggagccactgaaattggctgagaagcgctaacgggtgctgctgttggttcagcagtacgttgtacagctggagttggcgtagatgctggagttgatgttggagctggcgtttcaggtgtcttaggagttaatttttcttccggagcaggcgttggctttacatagtttgttaccgtattagttggtgtagctttaccaaagccaaattggtaggcggtattagaaaatgatccctcaaactccttgttcaccttcactggtaattgaacctttaacttagaacctgtcttgacatatttatcaaagaattcttgtggatcatctgcttgagcaactacaaatgtaccattaaagcgtcctgctaagtgattatctttaatttgttcctgaataaattcaggggcttgagataaactagtgtacttatggaaggtaattccgttaaccttcttaccatcttgatcaactacttgtgccttactcaaatcatttaccgttaaggcattagtatcaatcggatcagcaaagtagaagccctttttaatcatatcaggagtggtatttacatccttactattagaaagatcccaggtcatttggtaattaatgttttgatcattatctaccttttgtccatcaattttctgtgaagaatcactaagatcctcttttacaggtgctggagcagttgctgtcttaattgaagcttgattagaagtcgtcttaagagttgcatttcctttaccatccttgaagactgtctgctgatcaaacttattaggaataagttttgattcaccattaacttttgtccgtaaatcgataactggcaatgattggctttctgtcttgttagcattatattgctttaagagttgatcatcatcagtgaaagtaagcttttgaccatcctgctttaagtgaacaagattagtaatatcttgtagcttattatccttatctagcaaatatgcattatatcctacaaaagtaagattactatcaagattttctgttatcgtccgagaagtaagatcttcagcacggttagctggtaatggtgaaacactaagtggccatgttacaactgtacctgcttctacaagtgacccagcaatactgttctctgtatcaccttgtacatcatcccctagttcaacatcttttgtggcagtaggcgtaaatgttgagacattaacagtattagatgtcttcttctcggtattctcaccattggcgtccttgtacccccataatgattcaaacttattaggaatagtttttgtagctgcagttgcttttgctactaaatcaataattggtgtcttaaactctgttcccttgtctttgttatatagacctagtagataattgtcatctgtaaaggtaagattttgaccatcttttgtaagcaatacatgattggtaatatcttgaagagtaccattagcatctagcaaatatgctttatagccaacatactccaacccactatctagtgtatctgttacaacatgactagtaatatcttgtgcacgattagcaggtaagccattcttatctgaaagaggataggttacttcggaaccagaagcaattacttgaccgttgatactacttggcgtatcaccctgtacatcatcccctagttcaacatcctttgtaggattttgagtgaatgtttgaatagtggtttccgaaggagttcctggaacatcgttaaccgtaacggttgcaacattcttaaaagtagagccgtttggcacatctttgttaatcgtccaagttggaacaattgtaacggtttggccattggctgttgaaggatccttcaaactaatagtagctagtccttgcttattatcattaatattccattgatcggtaacatcattaccattatcatcagttaccttaaacgtagcagtaccaacatattgagcataatttgagtagttttcagtaattgtgaagttctttaaaccaccctggatatctgcagcaactggtagggtagtcttaattgaagcagttgcaacactaccatctgaaaatacttgatggtccgcaatattagtaccatccgtaaaatgcttatcaacatttggagtgtagttcaccacattgtagtgatatgaagctgtaatttcgttaggcatagatggcttcgaaactttagctgtattgtagtgatagttggctgaagtggtatttagtttgggtaacgtaacagtagccaccggtgcagtttcaccccattcggcccacgctgggtctccataccttggataatcatgctgaatgcttgttccagaacgatcatagattgtgattaagctccaagttccgtctggattctgtatagcatcataactgccatgataatccttaatagcctttacttcttcctgcgtcttattattgtgtgcgtagaaggcaagtgatcctgggaaatatttctcctttaacgagtttccgtctacaccagtggcatctccttgtttcccaaaaggccatcttgttggatctttaactggtgcaggatcaattgcacgtttaatgacataagtgtcccagaaaccgccacctgttttaggtgctaatcctgatggaatcgttaagtgaacgttagttacgacaactttcttacgctgtaagtcgtagtgccatgtaatatcataagttggatgagcattcatgtatccaccattatcccaattaacttgccctgtaacgtgttgatcttttgctaaatcatttaattgagattggtatttagcatagttttgtttctgagtatcgatagctttatggatctcatcaccttgagactgataattcttttgagtgttagtagcccaattttttagccccgtcgtatcttctgcatcaaatgaactatcagtatctgaatccttaacaacagttaatccaggaatattttgagcatccttgacatcttgatcaagttgtctagtgtctccgtgagtctcattataagtttgataatttgactgttgcattgcactacgctttgcttcatcttgtcgttgctttaaatactgttgttgttgattataatcatcctgaatcttttgatcgatttctgcttgagaactaccagtgatagtttgatctggatcttgtgtaacactaagatgtggcgtgttttgtacactttgcaccgcttgatcgatttggtccttatgtggataggttgtaatcgtttcttgatttccattaccacttgcttgagtagtagccacctgtggttgatctgacgttgtagtatcagcgtgtgcagtcgaagctacactagttgcacctaatgcaacaagggcaacagcactagcaaagagccattgcttcccttttttgtacattttgaaattagtttgagcagagtttactgcttcaattttatttctcatttcaaaagttcctcctcaataaaaatttgtatttatcaatacaacattgattattgccggaacgtcaagacttatgttgcattattcaagtatcaaaaaaatgagaattctacttcctgcttatctgagttttttggtaaaaagtctttttgttaagggggcgatagcctactagaataaaagattttaattttactaagtttatttattgttatcactttatgtacttttaggaggaattcttacaaatggttagaaaaagatacagcacaaaattattttacaaatattacatgcagtggattcgcttatacaaagaagacgcaattcgccccgtcactctagagaagtattatttaacttaccgaatgcttcgaaaattggcacctgacctgcatctaaacgaattagaccgacgtacttatcaagcaattctgaacaagtatgcccttactcatgagcgcaaaaccgtaatggactttcatcaccatcttaaagctagtctagtcgatgctgtagatgatggaattattgaacgtgatccttctaggcgagtaattattaaaggtcagaaacaatcatccaagaagacgaaatttttaagtttatatcagctccaacaattacttaggcaacttgatcttggcccaaaaattagttgggattggtttatcttattggtttcaaagacagggcttaggtatgcagaagcgctagctttaacacccaaagactttaactttcaaaaatcggaaataacaatcaataaatcttgggactataagagtaaagtaggccattttcagcccacaaaaaacaaatcatctaatcgtgtcgttatcattgattggcgcactgcaaatcaatttaaacctttaatagctgaattagatcctgatcaaccaatctttgttccagagcacaaacgtgtttttaactcaactattaattccaaacttaatcagtattgtcgccgggcagggattccagttatatcaatacacggattaagacatactcatgcatccctattactatttgaaggagtctctatcgcaagcgtagctaaacgtcttggtcatgcaaatacgataacaactcaacaaacataccttcatatcatccaagaacttgaaaataaagataatgacaaagtaatgcaacatttatcaaaacttgattcataaatcgaataggagataactgattagttcaattatcaacctctcatatcaccgtacgtacggttccgtatacggcggttcgacaacttaatcacattgaattgactggagcgtcttggacatattcataagtccgagttgttccagttttctattagttagagaatagctcagggtcttagtgtatactttcggttttccaaaactatcctcgacaagcggtcagcttgttgttctgttttctgcgattgtcgcacctgattacaccttcgatataagttacaagttactgtcgttcagtccatcatctgattactcaaactactatgacctcggctgactcctgacttactcaacgatacatcactgcaccgcttgcttctgtggaattttatcttattcctcttgtcggaaacgtgtaggccagatctacccggataaggatattaactttcgtcccatgtcaccgttagctttactaagagtagcttcgagaagtattggacttcagcttgtttcgcaaccttatccagttacccacagccttatagctacttcttgttcattggtgcaatacttttccttagacttccttctcacgacggacacccttgtcctcagctcatggttccagctactacggcccatggtgggctttcaccgcctagctaatacccatgcctggcgtacaaaaaaagaggaactacaaatatgtagctcctctttctcgtaggaaagggggatactccctcctacaatcaacttgtcatcgcattagaacaacaagcgaaatccaattgtcatctatcacataattggtctacttatgatggatgacaaagatagtataacataaagataagaaatatacagcttaatcctttatataacaagcgtttatcttattccataactggaactaaatttttttaccgttgttcaaatattcgcttcagtttggctaaaacacttagtttaggcttagttacaacagcactttcatcccctttttcatcatagatagccagtttcttttttaagagcttgttttccagttttagtttgtcattatctacctgcaagtacttataattctgatatagatcatttgaaattgtaactgttccttgatttttcttatcctggttaatctggtttttctctggatgaaaaaaatctactggagatacgctttttttgttagatagatagttgcgcagttcttctacttcactaatcaatgtcacaacttggggatacgtcatttctactgtctgtatattttttttagtattaatcaccatcaaaattttattaaagtccgattcaacctgaaatgatataggcgtaatagtactattcattttgtaattcactccctttttattcacaagataaatatcagttgttcttgcatcccttcattggcattcatcttttgttttttatttcaatatgattatgacaccaatattaagataattacctgaataccaacaatcattatgattattgaccatgctattgctgcctgccacgcttctttaaggtcgccatcaattttatcctctatttgattacgctgttttgtttccgttaaggtatttcttgctaactcactcatcattgcttcaatttgttgggtctttatctgcttatccaatgaaattttaattaatggttttccacgtaagaattcccaaccataccccaaagtacccaaatacttggaatactctaacagtctttggaaaatcttgctttttttccgttggtaaggatatatatacgtatccccctagaattaacataatgaatagcatgacggctgatagtaacctaactttaacgacagtattaaaatttgcgggtccaaagtccttattaataatttcatcagtaagaatggtgcctttttttattatttagctagaataattggtgctaaagcatttacttttaaatattttccttcaaatttaataactttatcatatcttgtactcatcataatcttcctttctttacaagacgtaactaataattactcataatctttttgtaccgctcatagaacattcccggcgcaatttctaatggcacatcaatatcggctccatcaatatcatttaatagtccattcagattgatactttgagaagcaagtctagcaatctctctatcttttaaattaagttgtagtgcctgtttcttcatttcagctcgttgtatattatgaagacaattccatctaattgaagcaactgaattcatatatttaactaggccagttagtttttcacccatcaatctaacagaaggcttctgcattgttaagtcaattaatgctgtatcagttgaatccaagtctgacaatatttcagcatttgctagtaataaaccatattttttagagaagaatcgcctctgaactttatatactttacatttagaattgaaacgattctgcttaatatcccaataattattgttcttgtaccaatgaaggtaaacttcaaatccttgccataaatttgtatcaagatctatttcttgattacgacttcctacaattagttccaaatcagtgtttttataccattgtttaaatttttctggagtaatcatatttatattatttcctttaaaatattgtattttgccacacagatttaagtaagaaacacgttactgtattcttatcttatgacacagtattaagctaatcaccaggatgccaatgatcattatgaatattgaccatgctattgctgcctgccacgcctctttaaggtcgtcatcgattttatcttctatttgtttattactttgttgggtcgtcatctgcttacccagtgatgttttaattagcggtttcccaattaaaaatcttattacacaagtaacaattccaaaccctaccccaatgtatccaagtacttggaaggatttagcagtctttggaagatctgcttttattccgttgataagtatatataaggcccaccctagaattaacatataaaatagcatgactgttgatagtaaccgctctttaatttttctattcttcatttttactcaccacgcgtttagttcctaaaactacatatctctctttctgtttgtaagatgtaattgcaatatagataatctttcgtactaatagtctgccaatatattgaccatttttatattcatgattttacaacatcttgacactttcttagagttttagaatatattaatgaactacttcctgttttagaaggaatggaaattgctaaagtaattaccaataattttcttcctctttgaattttagcttgtatttgacagatggctgatattgttgaagtacttcgcctaatcttcttgccttatttttatcataaaatgtttcttccaatcgccgtcttctttttttctgtagcttattttggaataacttcttaaacattcttatcacctcatctacattttcagaaaagcaaaacattcttattcgttattaaacactggcgaactagggggtgttggtactctcatctctgaatcaactattgcatttccattgctgtagtcaaaaatatatcctggctgtacattgaaaatataaacgttaaaatccaaggatctgtcagttgagactgcctgtaggtttacccctcgcgccatcaactcattaccacgaaatataggagtaacctgatatataactttatggccattctcaattgcttttcgtaccttagcttcgtagattgtctgtaatttctgattactaaaagctgtttgtgtgaacagattcttaggattattttggtctcctgaagtactattagggtcataattaccatcttgattaataccggcagatatcgaataagcaatcatatggccccgattatagatctgaacccttccatgattattatgccaagctgttggatcaactgtttgtcgtactcgaagctcctcatttgctcgattatgttcttctaggaatccggtgttaggggatgatgttctattcaatttatccaaagcagaatagataaccttgttggaattccaagaattaggattcaaagtggacctaccattgtttacttgaattattgcagattgtcctgattgaaaatttttggtagctaattcatcgatttgcgtttgtgtaatcccaccgtaatcattagttgcagttgaactcaaatttgttgactgtccactatcccgaggatttaatgctgaattattgctttgttcactaaccaaagaagatgaattacgactattaggttgagttaatggattcggccgattaacacatcctgttaaaagaacaccaagaactgctataggttctaaaattttccataaatgtgtccttttcatttttcatcgctcttcccttttgcgaacaacgatggcgaaaaatgaaataggtcagctaatgcgttaagttcctgtgtagttggtcgtacctttaaactttcaatctcttctacacgattagcattaactaatccatctgttttgtcttgaatatccctataactgtactgttcatgctgcctcattagttttaaattaagcgcaaatatatttctcttattcacttattccacctcactttaaaattaactttatcatcatgacggggtttatcggcaattacttaataatttcccattttcacattttttgagcagaattcttttcatcttccttaccccctacaatcaaaatgattacaagttaggaggaataataattatggcaaagcatagttggctacacttttttaaaattcaaccaaaggatggtaataagagtactaagaataacaaaaaagaaattaaagctgaaaaaaaagaaaaacaatctaataaagcagtgaatgagcaagtacaatcatctacttctcaatcacaacagagttctgatcagcagcctaaaatcgatgtaatacaaaatgaagtacctgcatcccctaatactggtgttattttagatgcctctgagcaaccacaagacacatcaacatcaagtaaagaaacgagattaaaaaagaaggagcaatttaatgctccttccgttctggctaaaccaatcattatccaatttttatatcaaaagaaaaaaattgctaacgattatatttttactggcgaaattggtcaagctttagaccttactaaaattcctgctgttactggttatgatttaccagatgctaacaaattaaattactctgttacagatcatacgcaggtagtcccaattgagatgaggccacaacttattcattatcgactagttccagtaaccgaagatcgagaagttattgataagaaatacataaaatctctcaatggtcaacctggtgagtcaattgtctttagcaactttccacagattcctgggtatcaagcatataccactcgaatttatattgttcccgataaatcggatgatcttcagattacttatgcacctgtacaacagtctttgacggtagtctttatcactacttcaggagtaactttaggagaacaaactcttcacggcaagactggcgatccttatcgcattagcactaaagaacatcatttcgaaggatataccctaagtaaagatgatctaccgactaatcttgaaggtaattttgaaccagggaatcagatcgtaacgcttaaatacaaaccagttgagtctggtgtaacaatttcttttattgatgaacgaggtaacgctattcataaaccacttactttccctggcgcttacggtgagtcctatcacttaaataatttaccacctattgatgggtataaattattttcagatccaacactgctaattggtaaatttgatgttaaaatgcaacaaattgtactcaagtatcagcgtgcagaacaaaaagttaaagttcgtttctggtttgacgaaaagcatacagttagtgcaggagaagataaaatccttaccggtctaacagatgactcttataaaatgcaagtacccgttcttgatggttatcaccctagtacacagatcattagtggtcggtttaaggtttttagcaaaaaaatttttgatattgtctaccagccaattaaaacagtcattaaactatcactccaggatgagggaggccgacaacttcctaatgttcaatctttgacaaagactggagtctacggtgaaagttatacctttgatctgccggatatttcaggttatgtacggccacaagaaaaaattagcggcaaattttatcgcccccaagataccattatcgttaattatcgtccaaaacaagcaacattaacaattaactatcttgattctcgtacaaaaaagccaattccaaattacaacagcgaaacaattaatggcctagttggtactgcttattcaattgagccaaaaatgatcaatgggttcaaactaactgaactacctaaagaggcttctggcgtttataaacgggctcaagatgttgttaatttcctttaccaccctaatccggcgaaaatcatcattcaccaagtcgatcaggctaataacaccttatttgagccttttgagctcaagggttactttggtgatccatacaacattaaaccagacgaactaaagggctatgcatttgaaagctccagcgataagctttctggcgtttatcctgaaacacctaaagatatctacctctattacaaagcagaagtgatttcattcacccttgctcctgccaatcaaatggataaagttattgataaaaaatacaacttaaccatctccggaatggttggtcaacagttttctaacggacttccagaaattcctgggtattcacctaagaatgctaacagaaatatcggtgggactataaaatccgctatggctgataagattctcttaattgagtatgagcctgatgatgcacaagcaattattcactttgcttgtgctggtggacctcgtgatggatcaacaccgtttgaagactaccctcttaacggcaaggtggctgaacaattcaaatatactcttccagaaattcctgggtatcacacaaatactcctgtccttacaggtacatttactcccgaaacaattgatcttaatgtagtttatgaagttaaccaaatcacatacagcattcattacgtcactgatcaaggccaagagattttcacaactgcaccaacaaaggcttcttatggacaaacattagatgttatgccaagcctaccagaaggttatcacttaccttctggatccagtaatgaaattgtgctgaataataactccgattacaatattgtaattagtccagacagtatcattgctgaagtaatcgctaaaactaaagatggtaaagagcttaactatcgtcgacaaatcaatggtttctaccatcaacctcaaactttcccagcgccacatctcaatggttatcaacctgttgatgggaatgagttgacgattaattttgaattaggtcaaaaagaaattccggttatttatgagccagaaaaacggtctattactgttcgttacattgatacacaaggtaataatctctcagatccaactgttatctcaggctacttcgatgaaccttataagattgaagccaagaagtttgctggatttgttgttattaatcaagatagcactagaactggtaaatttggtctcaataacagcgatacaaccttcatctaccgcgctggtagcgatgaaattaacccagctattactccattagacgatatgctcatcaacaaggaagttgatgctgacactaattatcaagcagtagctgaagataattcaaataactcagataatacagccaatcaaaatacaacgattgacaccccagataacttattttctgtaaatcagggaagcaatgtaggaatggatgaccttattgatccgacttctgctaattccactgatccaaatgggactattagccgtattattcatggtagaaattaggtcgtgattacaatgcacttaatgtcaattaacggaagagagtttaattgtagctcattagcaagacactacaatcttccatacaacactgtcttgaaactatatcgtcaaggtttccgtaacgaagaactaattgaagaatcaaagagaatacaacagttacacgggccagtcattgtgaatggaaaatggtatccttctcgcaatgctgctgcaaaagcactaaaagtaccgaaaacaacattttatcgaaaacacaaatcataattaaaaagcggaaagaaatataagtctttccgctttttgtgttgctgtatcaaaaacggaagaaaattttagttccatttatgaaatgtcatctatgtatgccgcatacgcatttgcattactttttactggttctttttttcctttgcttaactattttctctattttaaagtactacaacctacctttttgtttttcctttaatatttgaatcaaatcttatggaggaaataaagcgtgaaaacaattagatctgcattagcaaagcacaaaattatcgcaatttcagtcattagttttttcctgctaattgtcttaattgtcattattattggtggcggtactcaagattgtagtaatggagacagtggcggagctagtggtaactggcaatggccatttgacggagttaaagatcctcctcaatcacttgatggaggacaatttggtgatagtgccgcctcctcttccgttcgcggtcactcatttcatgatggttttgactggtcctttggacttaacggggttcattctggatcaactgtaaaggctgttcacgatgggaccgttacgaaggttggctatgcagcgggactcgatacatacgtatgggttcactcagatgatggctacaacgaagtttaccaagaaaccttttcaccaagcgacgtaaaagtaaagcaaggtgatcatgttaatgctggtgatactatcggtactgcacatcttaatggtcatatgcacttagggattactaaagaaagtgatttcggtaaagctgagtctaaagccttcaccaacgatggaacatggttggatcccgttaaaactatcgaagatggtatgaagagtggcggtggcaactcaagcaacagttctggtagcggcggctccggcggtggcgattggacgcaaaaaggatcccaaggttataaaaatgcccaagcgatctttgatactacaactaaaactgatgggttttctggtgctggtggagcaggtgcagttggaaatggtatcggtgaatcaggattacgtactgacgtagttaacgcttatggttatgggggtcttttccaatggtctgcttctcgcttctctggctccggtggtggtcatgttaaggttggtgataaatcaacgtacacattagagaatgaattagctactatgcaatcagaacttaatggagcttacaagaaagtaaagaactctgttggacgtgctacagatgttcatacggcaacttataactggtttatcgattacgaagggatggctggcaacgaaaatcaatacggtacacaacgggatcctggggctcaatgggcttataaagaattcggtggagctaatatcaaagctaatgactccctgctaggtgccgctgctaatggtgctgccataggtggtgctggtagtgctacagagcaagattgtgatagtagtagtactgatgctggttctgccgatggcaatattgttgacgttgctaaaagtctccttggctatttccactatggtctagtacacggtgaatcaaacattggctcggttgatcatcccaacaaaaatggagttacagactgttctggatttgtatggcttacgcttaccaaggctggttacaaaacacctgctaacatgggatggttcaccggtagtatggctgctgatgcaaaaggttcccaccagtggttacaacaaattgatccgaaggacgcaaaagctggtgatattatcatctgtaatattggcaatggtgctggtagtgctggacatacagctattcttgaagaagcttggcatggggccgacactaaaattatccaagaaggtggtactggtggtagcggtggtgtaaatgagtcaaccgttggcccatcatttagctatctctttaccaacggagaaaccgttcttgctcgaccaatcaagaaataatgttaagggggatcataatgcattcgaattttaaaaaatactttaaatcacagtttaaaaaagttctctatctttttatcggggttgctattcttttcatcttagtacctgttggtttatggggataccaacgttatcaagataatcataccaagccacaggtaacagatgaaaatggacatccccaaactactattcttcataaaaatcaaactccaaatggtaaaaagagaaaaaaagttcccattaaatctgtttcagaaaaagcagcaacgaagaacgttaaaaatagtattcaaataggactcaaaattatctctgataataaaatcacagctggtcaaaatataaatatctcaaatctcaataaaaaagatactaaacagctctatcgatcatttcaaaacgggagcgtagtacaacagtttaatgatatcgttaactactctactcctaaggggtatgtacagtggggagacgctggatctaagtctacagatacttcaataaaaactccgaaaccaggggataaatatgttcttgatggaggcgatattcaccttacatcttcaaacgttgagaattactttttcaaagtcaatcttacttatcatgccggagatcaaccacagagaacaattccattaaaattaaccgttaatcgaattgccggtcagatcactaatgtaaaaagaattggagaagttaagattactaactaaaatccacaaaaatataatatataataaataacatataatatattatttattataaaaagaagggatccttttgaaacatagaaaagaacgatattatattgctaaaaatggtactaaaagtaagctagatccaacaaaaatccttttattcctaataggattgttaattttgagtattctcgcgtgtctagttgttaatgtgggaaacgctagaaaaaactattatactcagaaagcagaattggacagccttcgcgataaacagcataatttaaaagctgtcggtgataaaatcaccgaaggtaagtttaatctcgttgctaatgaacaagaactgggaaaaaattaccaggaattaatccaaaatgcatatggtaattgccataatattaaagacctacagaatctaaagccacagataattaaatatcttggtcaaagtggatatcggcaggtgcatgaacagattgtcactactagtgacggcaaacaggttcttattccttctaacaatgaggaagtacatgtaggtttttctaattacgactcatcaaataacaccattgatgttaccgtctgttcgatttataacgctaaaagttatggagtacagggaaataataacaaaatgactagaactattatttacatcaacactgtctatagttttgcaaccaaaagtgccaaccaaaccagtatacaaactgctagtctaggtactaataaatgatcggaggaaagaaacatgcacgagtatatctggcataaaaatgacaaacgttggctagcgattttgacagtagccgttgttagctgttggcttatactagctattaaatctagtattgctagcaattacaatcgcaagacggaacttatagcccagcaaaatttagtactcaaacaacaaatcaagcaaaagcaaaatagtctaaattaccaaatgcaaaaaaaggctgttaatagttccaatttagagattcgtaatagcgtacgtacaattatcggcactaatgaagcaattaatatttctaataaagcctttactacgctcaatacctacagcaatgggaaacaatatcgtaacaatcaaaaaacagtaaaaccatattttgatactaatacattaaaaaatcagcaactattcaagaaagataaagatgtaactggatactcctatattgatgcctcaaaccttaaatcaaaaagtgtttctgttgagacctctgctggagtcattaacaatgatcatttaccgttaattattaaaaccatctttaatcagaatcaatttaataaagatcatggtcaaactcaactggttatgatggcagattacaactataagacaaagaaaatcggtaatgtaaaattcattggaattttatatcaaggagcaatcgataattaattcccctcagaagctactctaagctaattcatttcatttttcgataatttccacgtaaaccaaaataagctctcagaaacgttctgagagcttattttagttatttttaaaagaattacgattttttatacgttgttttagcttatcaacatcaatctcaccagagtttttatatgcatttttataccattttacctcctcagagtcttcaccaaattgattaattaacaatttaagagccccctcagtatcagtaccgatatctttttcattaattccatgttccatcaaatagttgctaaccgttagccatattggttttttctcttctatgcgatgatgatcaccccttttatgactcccacttgaagattttctcgttttagggtgctttcgtttctcaatataactataaatagctttagatagatatttgacaatgtgatccggcttttttttcatattttgtgcaacataatgaagatgattatctagctcattaatttgcgcattctttagaaactcatcataaatcggatataacgtaccaaccaaagtaccacggtacttttcatctgtagtaactttattcatgtctagaaggccagaaccaataagtaattgcgaataccggttttgcaagaagtcagtcaatgatattttaaccgtctttggcttggtatcccctactaaccgctctacatccttacgcataatatgaaattttaacgctgtcactctacggccttgcttaatacgatcataagtaatgttgtactttgtatatttcgttatctctttagtaattggatcaaggacatagcgccttacgtcatagaaatcagtatactttttttcagttcctgttagtttacgtaactcatcaacagtaatttccggattagcatacttatcaatctgtgccatacgtcgcgtcccactattaacataatactcgtactgccgataattcatcgtaaaccaccgatacattgataccgcgtacttatttttcaaatgaagaatatcgtttaactgatattgtgtaaaattttctttcaagtcagtgataaatggaaggatttctggtgcaaacttaatagttgcataatccgaactgtagttgttgtcagcgtagtagattggtgtaattccaatatcgtgaacttcaccattacgttctgtcgtaaattcaaaatttgaattcttacgcaaggtattaagagccttggacagttgttgatttctacttgtccccttaatacccaacgcattataaatctgttttttattaatatggacttcatgtgaaggctctttttgtcgcgaatccattgcactaactgcaatttcaaacaattttaacgatagactggtcatgtttgcagtgcttttaattagatcgttatgctcagagacaatacgattatccaatttattaacaaccggaataacttccgccttcttttcgtcttttttaggcatattctttcctcaaattcttttaatcaatcgaattcattatatcacattaccggaagatatatagtttttttccgccacttcttggcctagctaaaattttcttccggttttaggtttagaatcatcaatttgctaaattttcttccgcagtttgtaatataccctaaattttcttccggtttttcttaaaatattagtaattctcaaaatcaaaaaaatagtgatgataatgttcatttaaattcacgctaaatttctttccgcttttttgctaaattttcttccggtttttcttttaactacaattacggaaggaaattttcttccggttttaaaatttccttccggttttcgctaaattttcttccggttcaaataaattttcttccggttcaaataaattcttttccggttttaatggacttaaatcccgctataccaaggttatagaaagttacaaactctttaaactctttaaactctttaaacttttgatatataaggtaccacacccaataatcaattttttaagaatataagtgacttacttttacatacttttctcaattaagataacaatgaaagctgaggtaaaggaaatgcaggatttatcatccaccataatactcacattaacttatctgttcttagttttagcaattccggttagtgcagtatttggattaacttatattaaccgaaatactaagcaattattagtaaactatttcggtgaacgatctcaaatatactgtggtggactaggcataattatacatgaattaagtcattttcttattgctttgctctttggccaccaaattactagtttcaaattattaataatgccctggaatctgaatgaagaagatgggtcccttgggtatgttaatcattcatgggataacaatagcttatatcagagtattggtaatgtatttatcggtactgctccgatttggggttgtactggagcattaattctaactactaaatattttgctaattcgctatatcagtcatttactagtgccattgaaagttacgggacaattagttcacttaaactcaatgttctacaactatttactcacctaacccttggtccgtttacttttcaaaacattattatgttattaatctgggggattctttcggtaaacattacagtaggaggtttcgatttaagtaacgctgatttaaaaggttcattttcatcgtttattttaacgtatgctattttgacagtaattctctttattttagtatattgtggcttttcgatgcttattagttattggttatatcggggatgcgcttggttctccttgataatgcttatctcctttctatggtcattattttctaatctcatcttacgcctcatattatttattcaagaaaaattcgggagtgaagatatttgaatactgcagatatattaattaattgcacattcattgctttagcagtcaatgagttctttatgctagaaataattattaatgcattacttcaacacagggatcttaatcgatgggtaaccactaattggaaattgcctcttttagttagtttcttgtttgcaagttgcgctcttatattcattcaaacaagcaggcatgataattatatttatttggtaagtcttttctgtaccattgtacaaactttactaatgctagactaccatcgcatgctaaagcgatatattaccagttcttggtatttactatcaacgaaaattaactggattattggtgtcatctgcatcttattaattatcacctgtattttatatggattaattgtaatagatttcaattagggaggtctcctatggcacttatgagtcgaaataataatattcacaaagaagaatttatggaagattatcggcatgatatttttatcatgctcctttcgatgggagttgatcgatcagcagcaattgcattaattaaaactagtaaaaatgatattgaaatatgggcaggcagtcgtccggcaactgggagcattgttactccacagatggctgcaagaatgatcgtgcgtgcatcaaatcttaatatagaaagtggtctctaaataaaaagctatatttttctcgttttcccctccccttttggtatatccttagagcaagaattatttgatactgtgaggaggaagcaattatgaacgaagcagtagagaaatacttggctggttatcacccaattacggctagcccacgtaaaagaatttatactagtcgaattgcttgtaaacgagatgaaaaagaaattaaatttatgaaggattacgctaaaaagcatgaacagccagttatctttcatcatgaagaggacacttatctatactaaaaataaaagagatgcatctaacctaatagttagttgcatctctttttaagtttgaaatttaatgagaggaatgcgttaccatgtttgataatgtaaaagaaaaaattgataaacgttttgaagcctacattgatcaactaaatgagtcgtcaattgatgatctacttccccgctttgagaagatagtaaaaatattatgggctatcccaatatttctatggagtttgtgtctaattttaactatctttccgtttcataccttgaatcatagtttcttgttaatttggattggtggagtggcagggatgatacttagttttttagcaaatcgaatgttaatgaatttgacaacgcggagaactgatattgatcaggatcatcgggtagaagaattactaggccaaaagaagacgatggattaccaagtagcaatcacttttggtggcctaactgcccttccatttgtttatacagctattccttatacccagttcttgttggataatccgactattcctggtgtaaatcggcaaatggtagaacttattgctggcccaggtctttttaataatattatatggactttagctcctattctttttactgtttatatgctctctcggcttagaaaaagtgagatggaacatcaaaaagaggtagaaacatggatgtctaaatatgagtaccataatgttaaactccataaagttctcaatggtgatgaatctagtgatcatgagcctaatattgttcttggaacatctcttgaaacgggtgatttcgttgttcaaaatagttctactaggagacaaaacactgtagcatatggaccaattggctgtggtaaaacatcacggtttttcttgcctcagattagacaagatatagatagttatctacagtacattcggtattataaaaaagcttctcaacaagaggggtggatgaaagcctatggggatgcgactcactatcttaatggctttaatgttatcgacccgacaaatgatttatgcaaggaagtttatacattatgtatgaagctcggtgtgcctagagataaggtgatttggctagacccagaaaatccacgaacccctggactgaatttacttcgaggacctgttgagaaagctgcagaaaatgttacgaatattattgcagggttaacctctagtaataatgatttcttcaaacaatctgagcgaacacacctcaagaatatgatttatctcttaaagttaacgtcagttatggaagacaaaatagctagctttggtgatttaattgagatgtataacgatattgaattagtttgggataagatggaaattcttgatgagtactgttctgaattaaaacagcgtgctgaacaagcaaggcaacaatatgatgatgataatagtgacgataataaaattgcttttgaagaactagatgataagtatgcagttgcttggcaaacatctcaatggtttcacaagaatatccaagaagttacagtcggtaagaatgtccgtctctacgcttcaggaccccatcaaggtaaaccaatgcattacgatgcgcaagacgaatttgtccatggcctcttaaatcagctaggtgatatttctaaaaatatcccaattcgtcgggtcctttttcgagattctggagattttaatctcgatgatttcttgtataacggtgggattctcctttgtaatacagctaaagcggttgttggagatcagctagctgaaactttaggacaaatctacaccttatcatttcaagcagctacttatcgtcgagatcctaattgtcctcctctgcatccactatatgctgatgagtttccagactatctttctgaatcgttttcgggttttgcttcacaagctcgtaagtacaatgtacctatagaaatagttgcacaatctcctgctcagcttgcgtataaatatggtgatgattatttcaaaacattaatgtctgttatgctcacgcgggttacgtttggtgatttaggggcgaatgatgcagaggaattatctccctacttcggtgaacatgaagagactacagaatctttgaataatcaagaggtcgatttagccgcggatcaagatagtaaccgtcaaatgattagtgctcgtcgagaactggttcctaatataactgcaagtgagattatggggctagagcgatttacaatggcggttagaacgccaggtcaacatggttctgatatgtttaatcgggtacggactaaaagagtttcagatgagcaattaaacgatgatccatacaaatttgatatgactaacgatgaagaccgggagtcatatgaatatatgctagaacatgaagttcatgataatccagactttgacgaaattgataaatcaattatgaaagaaataaaaaagcgtccaaaagaggagaacggatcaactactacatcaatcaataatgaaagtaatagtaatgactcgacgtattttgatatcgatgatgccgatgatgaaatcagtcgctcactcgtcaataacggtggacataagactgttaaggatataaaacaaaaaaatgatctaggattgcttagaagtaataagaagagttctgagggtgaattaggacatgatgagtttcctcaccctaatatcaaatttgttgattttgatgccgatgatgatatcagtgtaccgagtcataaagataagattaatgaaagggatgaaaagtgatgatgtacttagatgcttataacaatcttattgttgataaagaagatcgatttattatggaacaggatcgcaagaaacgatatgagtctagtggagatgagttaagaaaacaagcacttaaagattttgaaaaagattggaaaaagattcttaataatgtaactattaatgattatgaaaaattaacagatttaagaaagttaagaaaggaaagatatcccctactcaaagctttatacccaagtagtgttgatacagtactggataaaacaatcgaccggattattgaaaaacagctagtaaaatttaaaaagaaccacagtattgtacatggtaatgatgattacattaaaatcagacagaaaacaaaagaaacaggaaagattaatgacataagtacagaattaaaaaacttagttaataaaatggatttttataaataatatataataaataacatgtaatatattatttattatatattacatgttttaagaaagtgtggatatgatatggctcttgaaacggttattttcgctcccaaaatactaaatagatttgataatcaacttatagcaacactatttaataatgatgagtctgaagaaaaaattattgtttcttctcggacctgttatcttcaagaaaaggggattatcaacctcggaaataatgaacaattattaaaaaaaatagttatacaatttcccagtaagcttgagaatctcatcaaaagctatctgtctttgaatattagtaagcgttatgctctgtctttccagaatctaaaagcaacaattctgttgatagaggaaattgctaattcacaaggatttaaacaagataatgctcctcttcacgctctagcctttttatgtagtaaatcgcaaaaagcgttactcacatttataagaggttatcaagttgaaggaaataataaggaatatctcaatgcttatctaggagaaattgttcatcatgttgattcttttcaaaatattttagaatttttgtggaaaatacatggagtaaattatgtaagagaagataagcaaataccattcagtgataaagagattgtgtttattaatgcttcaaaaatagatgataatttttattatcaagtatatcttttattttttagcaaacaaaaaagtcagattttttttgatcaacatgtaaatgaagaatataggtctcgtttttacaatacgaaaggtaaaatttacattaatagtgggatcttagactctcagatagatatcaactacgatctaaagaatttaagcgatatttactactcattggagcttagtgatcctgcatttttattacgtttgttttctatgacaaaattaaaaaagattcttgatcttacatttaacgatattaaattagctttattcacaaaaccaatatatatgttaaaagatagatatatacgaattcgactgcaagaaaacgtagttgaaataataaaagttaaggatggaaaattaatttctaattctattagccttatagaattttttaacagcttatcgaaaaaagaatatcatcaaaccaaggatgatagggtaatagacaatggaaatgaagctatgacaggtgaatttggtgattacggggcatcagctccagagttaaatggagacggttggtataatggttaagatttgacagcaaataattatttattatatattatatatgataaataatatgttacatattatttatcaacaaaggcaatacactttaagtttttcgtatagaacggtctacactacacgaaaaggattaacttaacgtattagaaagcgaaatccagttgtaagtcacaaagggtctacaattaaattagctgcaagtaaaatccaatgtgtattgtttttttgaaaagaaatatttctttcaaaggagcatctagctaggtactccttcttttttacggttaatcttatcgaatagtaccttattatatcttttagatattaaatagtatatatttgttattaattagtttctttttgataacaaatatattaaatatataaaagccgtgttatacaaatgatagcaattattatcatttgtataacacggctttgttttagtcagtagtatattctattattttggaattacaggtaaaaattcaatatagtattgagttaattgattattgttgaaaacaaatgaacttaattgtttaaaacagtctgctaactttttaatatcggtatctttatatacaaaagtataattatttttaatcaagtattgttttactttttcactatcgtcagcggaaagcatttttggcgaagcaatttgcatttgagttccatctctaaacattaatataacatctaaattttcaccgatagttgcaaaacctaataaatgaaagaacattgaatcaagtggaatataactttcagatccgtcagttaggtctataacatttatctctttaattggaagtttatcgattgcagctcttagttttacatgaacttgtgttttttcaacaaaagtagctgcatttgcggctttctgaatcttattgtaaacatcttcatttttattttcttctaactttttttcgactggtttatgatgcataattgtgtctttgatatctggcatttgttctgtcttctccttttttaacttcatttgtgcggcatttttttcttcagcttgtactgtatgctgtatcctgaaagttttattcggtacagatacctctgagtcagtttttttattaatatctctctgctgaattggagttggttcaccagttatgacttccaaagttggatgcggctttgtttttttggataatctttcggagcccagatttgtgtctaaattgatttctcctactttactgttcatattaaccttttcaatctttggactattttttttattatgtcttgtcgacgctctgccattatttatttgggatgatactatcgtcttatccttgaccgattgagatttggatattaggttgttttctttagaatgattgttgctattgttaaaattctgaagtgttttctcttttttaatatgttttttcttttcttcagatgaattatagcgagtaacaacaaggtgttcttctttcggtttgggcatgtggttgtgaatcaaatcaaataaattactatccgcatacttatttatctttgatcgggatattactgccataattgccctgccctcctttctttctatcgctatcatagcagtttgatttcttgattttcccattacttaaatagtttaaaaattgtattttttcttgcttataatttaagtgaatattaaagaaagggttgatcacagatgaattcaccaatacatcttattgctgcacatgatggaggcaatggatatatgaaggatgctatagatgggaagcgatatatttttccatctataatgtccactgttattgataatgcaaataataaaatcaataaaaaagataagaatgctatttctagtttgcttaataattttcaagaaaatatggacgttacactacaaagtaatgggattaaaaaaaatggtagatatcttgttggaaatagtgctaatacgagcaataacatagttttaggctttaatgtaaatagcaatgagggtaagtcaagttcagatataagtattatctgtttactgacgttacttgcttatactagcttaaataaattttattcaaaaaatggagaattacctgagaatttaactgttgaagtcgataaaatggttaccgcacttcctatcgatgaaataaagatacccggagaacgtgaaaaatatataaatcgttttctccaccaacatatagttactattaataactttagtactccaattcaatgtgtaattaactttaataaagttgatgttcagccagaaggtgttattggtcaatatggattaataggtgacccccataacataaataattaccgtaacgatgatatttttaatgatttaaagaaaaaatacggatttaaaaaatttactggtgagaatatcgagaaaataggaccagttatttctattgatattggtgatgggactattgacttttcagttttgaacggtgtttctccggtaccacgaattaattcaagtgttttacttggtgttggaaatatagtggaagaagcagttatgaatttacgacaaaagtaccctacctacgggcaacttaatcgacaaaatttcatgaaaattgcattacgtggtggcgataaagaaagtgctgcctttttatcatttattgataagcctatcatcctgttggaacagcagattgaggagaaagtaaaatcaatatttgctaaattaagtaatcaagtaggactaattgtgattagtggcggtggatccccattagtaaagaaatattatgaaaaagattttgacaatataattaatacattgatgccatttggagctgcagcaactttatgggttccagctagatactctcaattcctaaatttagatggattagagtttagattaaaccatatgtagaggtaacaaaatagaaattaatgaggctaactaactcatattctgaaagaatatctttctacatagtcctatattttattagtagcaactataagatgactattaaaattgctattatgctcatgttatttatgaaaatggtaagaatattgattatctataaggaagcccagaaaggacaagcatgcgaaaaagcataaagatagatttaaatccaaatgaccctgtagataagctaatcaataagtatttagacagtcaaagaaatattagtcatactactaaattgcttttattaaaagcttactatcaatttggagaaaaagatttacaaaccaagattaacgaaaaggctatgcgaggagaagtcttcgagtttagtaattcgaagaaagaaactaaaaatgaagaccaggatttaaaaatgaacgagagtgatcagaaaaatgggcctgattttggcacattcttcgataataaagaaaactttgatgatctctaaggcgttcttactattgctttaggaacgctttttttttgaaattgttttttctcatttgaaaaaagagtacaataatttgtgatatataatatattatatatcacaaaaaaatatatgtagtgtagaccactctgcgataaaagaaggtgattttaatgtccacccttatgttctataacaacaagggcggcgtgtgactgagttgggaaaacaaccatttcagttatggcagctgattatttttctaaaagaaagaaaaaggtattactagttgacttagatcaacaatcttcagcaactctttttctgaaactaaatcataagtttgaaccagaaatgcctttctttcaatctatattaaatggtgatttaagtacaagtttatgtcatgtagccgaaaatcttgatattattcctggcgacgttgggatgacccggtttgatgaattcgcatttaaattatcctcgagggatcgttttaatgttttagaaaagctacttaaaccttttaaagataaatatgattatattatccttgatgtacctccttcgcgagggccaattgtatcaaatgctgttttagctactgattatgttgtgcttgtagtgcaagcacagcgtggaagttatgatatgtttttgaagtcaatcggttatttgagtgaattacaacaggagtatagctctaaacatatcttaattggaattgctctctatctggtatcaaaaggctctgttacagagaaaaagatatccaaagagattaaagataaatttaatggtatattagaccaccaaatttattatagtgagcgtgtaaaaacctggtcagataagggaataacgcactcaaataatattaatgataaacacacacataaaatgtacgatgacttttttgaggaaattgtaaagagaatcgaggcgtaatacgtatggcaaaagattacctattcgatgctgcgaaaagtgctgaacaaatgatggggaaggacttaaaaaaagaaaatccttataaaaagtctagagaaaagtcgagagcagcacaaattcgagtagataaattaaagatgatcaaatttattagttcaatgactggccgtaatattatagatattacagatgatttacttcaaattggacttaatgatcctagatataagaagtatcaaaagatcatgagtcaaattgatgatttaaagaataattaacaaaaacatataatagataataaattatatattatatataatttattatctattttttgtttaaatatgttatcatttagttagcaaaaagtatatttaagtattaataagatttaatattaaatcttattaatactataagttattatttgctatacaaatgttataaaaagtattaaaatgatagatgtagtttacaattaaattggaggaattcttatggttgaatcaatttcaaaatttgctaatgacttaggctatggtgctgttaagtataaaataagcaaaactgacaacaagactgatggagcgttgaaagagccagataaaatttcgtctgtaattgctatcgagcgtgaacaggatattccaaatcctattgaatttgatgataatgatcaaaaagatcagtatatgaataattttcttgatcatatggatgttactatatctagctcttcgattaaaacgcagggacgttttctagttggaaaagctgcaatagaaagtagattgcctctagaacaatttgatattaatgatttagcagggaaagctaaaaatgatttatcattaattctctctctaagcatcattgcggccaatagggtgaaagaagcttataaaaatggtgaagatttaaacgaaacattaaaagctacagtagttatggccacggcattgcctgtaacggaggttaaacgtaatggcactcgtgatgaatatcgggatcgatatctgaatgcgacgcatactgttacttttcataatttcgttaatccaattaacgtatcaattaaatttaaaaaagtatatgtggctgttgaaggtgaaactgcacaaatgtttatctcgtttactaaagataagcttttcttaagtagtttaaaaaaagaatatcaaaaaaaatatccagatctgtcaaagaaaaaaccatttgaggtaattttaagcagtaaaaatactattagtattgatattggagcaggtacaactgatgtgaacgttattgttaatggaagagcaaatgcgaatatatctatttcagtaccgtatggttatggaagtgtactggaagatgcggtagatgttttgcaagagaaaggatacccaattttaaatcgtactcagttagaagactttttaaaggacaatgatccgcttggagaagagcgtcgtaaacgtgttgaaaaggtagttcaagaacaatatgagacgcttagcgataggatcgttgctgcagttagccgttcactcagaaagtctggagcttctgctcaggcggtttctgtaagcggaggtggatcaattcctatggttaatagtcaattggatcgtaagcttacagaaaagattaatagttatagtggaggcaatgaggatatacctgtactttggatacctaaagaatatgcccaaaacatgaattgcaatggtttggagattgttgcagatcacctttttgaataaaataattaattaaggggagattatatgagtgatttaaaacaacgaatggtccgcttcccaaaaggatccgtttctgatcaatgggctcaaaatcaggataattttagtctatctgtaaggaagctggttgaagcaatcgtcccaatttatggagatggagactatattgatgttttaaataaaatgagtattgagcatttaaaatctgagctaaacacttcagataataatagaataagtacttccaaggatgaggtaactagagatgtcagaaacgaaccgaaacatttagtagatactcaagaaaaattagaagaaaatacttctaataacaaacatgatgacgataatagagacccatttcattttctttcctaaccttaaaggcaatgagcaaagtagcttattgccttttaatttttttgaaatttgagtatattgccacatcaattaaattcaccttaacctgttaatgaacagtaaaaatactgaaataattataaggaggatttgacatggaaattgatccaacgactcaaattgcaaagaatacagaagtagccacggataggacttatccaaactttatggaaacggctgaaagggtggcgtatgcagaccagaatgcggtagccgaatataaacgtgctattactgctgacttggatgttaataatttagtaaatgctatgggtgaagaaagtactattttcaaacttggagaacgtcttgttccaatgctgaaaatgcgtcttcagaatggagctcctatctacatctccattaacgaagcaggaagtaattatcgacatttagatgcgctagtaggtaagtctgttaagattgctgtaacaactttcgataagacaggtacttttgacgaaaatggacgtccagaatatattgctctagggtccattcgacaggcagaatttgttattggtggaattctatatagtgaataccagaaagcactagaaggcatcgaggaaaacaggactgatgtcaaagaagagaataacagtaacccaattcaaagttcgtttacagatgagataagagaaggggttgtttctgaggttattgatacaccacgtcttcaaatgatctttattgactatcgaggtatggcaataccaatgtatgcaaatcagtttgcctatatgacctatacacaaccgctaagtaatttagtaaacattggggacaatattcgattcaaaattagctctattacaaagattaattatgaagatatggatagtgtcaaagaagatatcgcaaatcatcgacagacacctaaaggtttacgctatcttattagaactacctccttaccattccgagaaaatcctgaggggcgcgttaaacggctacaaaagtcacaaagttcttttattgctcacgtagtccgctatgatccaattcgaggaattctagttgaaatagctcctggttggtggattaaaggagtactacctgcttcttcaaattacaagccatcgattaatgatgagattgcacacacacccgtaacagttagaattaataatcttgactatacaacgcgaagagggcgttgtagcattttagcttttccgcgaggtgtagcaaaatctgctaatcaacgcttttagaggtgatataaatggctgacgaaaataaaatcggcccagtaaagctttctgatagtcgattcgtagatccagagactggacagctaatcttgccttcacttatggataaggatcaagaagagcactttaagatttatcctacttggtttgttggggatagtacatttagtgactcattgcgaaaaattcgtaactacgataatgcggaccaatacagatcagtctatattaatttaagtcaagctgatttatattatttgaaattcatagcaagttttaaaagtgctcaaaaaattcatttaatacgggaagcattactatatcctgagttatttgatgcgactaaagttgataagtcactaaaacatttatttataaataatttagtgtggcgatggtcatatgatcatcctgtttatgggaaaccgattgatgtctatacattatctgccaatggatattattttctaaagactttatttggtagggaacattacttttatccaatgcttcttctctcgccaagaattccagatattttccacatacgtttctgggaaacaattgatctctatcaattacttgcttctataccggcatataggggatcaacaaccttattcggtggtagtgaagaaaagaaattaatgaaatcacctttacaggttgctttacatttaaaggacgaagtacagaatttagtattctatcctatgttattgactgatagcgatcagtattattcatcagtcattgaaaaatgggacgatttcactaataagggggaaaatctaaacactgaagttaatgaattaccagggaagcaaaatgttttaactttctatagtccaacacttaaatatgcagttgaatttgctaaaaaattcaagctcgggcagtatcatttcccaatactatttgtgataggttcagttattaaaaaatatgggattcaagaagctttctttgctccgcttattggtggaaaagataatgaattaaaacaaattaaatttaaggagttactagatgagacagcaaatgaaagttagaaaaatattattactttgtttagttttatcattggtagtaatcctatctggatgtggaaagcaaaaggtaacgacagcaaatcagcataataaacaggaacaatcggattcaagttcttctagacccactttaagtcttgaatttgttcatggagaatatcagcaagcagccggccttatctcagttccaattgtttttgaaaatactggtagtaatcaaaccttaattgattctaataactttactttaattgttaatggtaagaagtatcatccttatcaagaagacaacgaggcttcagatttccatattgatttttttaataataatgtttatcagaacacagtaacatttaacataaaaaagcgattaacaaagtctgagctaaagaaagtaaagctaacctatctaactgataagggaaacgaagtgaccgcaaagaaaatcagtaaaaatgtattacttcaagatattagagaaaatgtatcaggatataatccaacagatgttggaacttattacaaacaaagcataagctatttagaaaatgctgctgaacaaaagaaaaaggatccaaatgctaaaataacttcaattgaagatcgttttaatgataaaaaatatgatcaatttcatatttgggtggcggtaccatccactggtaatgtaggcagtaacgttgttgtattcaaagtacttaatgattccaatacagattttaatgtttcctatggtgatcttgaacttgtcgataaaaatggtaacgagattcaggtggcaccatcatatcgaaactttaatattcaatttccgcatggtaaatatactacatttgtagttcctatggaggctacgttaaaatttagaaaacaaccatatcaagttgaggtaagagctgattcatcaggaaataatccaaccgggtcttttttcaatactaaaaaaagctttaatccagctgaagttaaattttcaaatgaaataactagtgatactctattctctctatctcctgtgcaatatccaaaagataaaatagtgtggtcagatcaaaaggttgatacggctagtaatacaattactgctgaggtccaattgatggattattttaatctaaagaatgacaattatcagttaattggatttaatgatgatggtcaacgagagattgaaggagttaaagcaaaaccagcttatgttgcaactacggataaaacaaagattacttggaaagctaagaacatgaattccgtaatggcctatcaacatgttcaactacaaagctatggtaaaacagtacttaacctaaaatagaatagtagacttgaaagaagccaagttcatgttaagaactcagcttcttttttgctaatattcgttgaaaatgtattcaaaatgacttatcatatgaatgacagatgaaatccaatttaactgttaaggtctacatatttaataacatattaaatatctattcgtattaagggggatactaaaaatgcgtacgcttagtcgccgtatggagatgttaatgaatgccaaaatactagacgggggtactatcacatatgaagaacatcgtagtcattgtgatggctgtgtatattgtgaacatttacgtctactagaagaggcaattaaacaagacgaaaatttagacaaagtatatcaagagactggtgtttcaaaggagcgtcagatttatttgcgtgaatcacttgagccacagcgaattgaagactttaactttgaaccaggagatatctatactaagactggaaacattaatcgtgagacttacttagtattgaagtttgttgaatttaaggatacagaaattcgagattattttggaattaataccaacaaatgggcgaaatttaagaagcaagaatttccaaaatggaaaacaaaagataataaggatagtgttcttgctaacgaggcatttagcgcttataagcgttggtgcaacagtccaaagaatcgacaaattcgtttatcaaataaataaaagattgaaacggctatagcggtaacgcatagtcgttttttaatttcttaagtgatctgcagctctatctaaaaactactcataatagtcttataaatagaataaggagtgactatccatgaacctaaaactaagtccgttgcttttatcaggggattttcagcacggtttaaataacattcccgatactgggggactagggggtagtggaggagccgactacacaggctctttctatggctttgtgatctcaaaagaaacgttcgcagaaattgggcgatgggttaatttattaaatatcctattagtgattatgattatctggggtgttattcatgttgttattagcatcattggtaatagtggtaaatggcggaaagcaggtagttcgattgcattaaccggatatgggttgctactattcgtacacatggcaataatcgcgggttgcgcatctgggcaattggctgatggtaaactgattatctttattctaattgcattaagtcaattggttttttatattggagcaccaatgctatttatgttaggaagtgagtggcaaatgatggcagaaatgacagaacgaccacaatatatcaggcaggcgacacgtgcctatggatccattacagctttgatggcgtttggcgcagttgtttacttaataggggagttgatgtagatgcatagaaaaaaagatgattatttagaaatagtatttagacagggagtaaaactaattattagcggagtaattattggcctattgatggggctcttttctctaattgctagtagcaaaaaaatggcttattgtccttttgaatctacagctgaagcatctgtcttaccaaatttttggcataaaaaagatcaaccgaaaccattgcacattactacaaaaccacaagcagttgaagtcaccactgttaatgcagataattctttaacggttcgtggggaaaatatgtaccctaaaagagtcaaattgttattactgtcttatccaccgaaagggtgctatggccaggatacagcgcataaagaattaataaggttaacgaaaggtaaaattatgtggatctttactgataagcaagctcaaaatagcaactatgtttacttgcagaaagattcaaaaataattcaagaaagaatattagagcaaggagatgcagtgatgtataactataatggctctgaaaaatatttctataacatgcagaatgcgcagcaaaaagctaaagagcaactaaaaggtgtttggctagtcccagggtacgttacagataacggctacaataagaaagtaggtcgtgtaaatggaaattgataacaaacataagtactcgctagatgacaagtacaaaaagccttatgacggacttctgcatcgaattcaaactgtttcccttttaacaatggctggttgtgctttaactatatttattgttcaaagattatgtcctattatttttgtgaaaatagaagctacaatacttttagtcgtaactgttattagtttttcgataggctttatctggcttaggagagatttcttggtttttaaggacctctatctacacaacttagatctgcaagaacaagtagcagaagagcaaaagaaacaaaaactactaaaaaaaggattgaaacatgcaaggaaaaatcattagaacgatttggattactgcctgcatgcttttgtttggaatagcggcaggctttctatttattaatacacagattggccgatcttacatagttcgtaataatgccactcgtatttctaagactttgacagcggctgaggcgcaaaagaatcaaaaagcttcaacttcatatgacgcaagtaaaactcgctctgtaagtgcagagcagcttctcagagcatcaaaatatgaggctttcccgatcggtagaatgtcaattccagtcgttaacacccataatccagtctttaacggctttgggactcaaaatcaaaatcttagtttcggggtatgcactgtaatccctgatagaaagttaggaggggataataactatgtattagctggtcactatatgggaaattacgggccggctgttcttgacaacattcatctattgcataatggagaccatatttacgttaccaatttacagaaaatatatgtttataaagttactaagttgtatttagcactgaaaccaacacaggtgagtgtagaaaataacataggaaagcagagtctgattactttgattacttgttctgattttaatcaaactaaatatggacttggtaaacatagaacggttgtacaaggcagattacaaagaacctatcctgcaacagagaataatttaattcgatatgaattaagtagtgaaattgtaaaaaagactgttcatcggcgttcaggaactacgaaactaaataatatcaatttctcagaaatatgcgctgcttttgcgattgtctgggtattgatatgggcgtggctattgattcgagtttggaaaagataaaaaacaataataaattttagttccacttatgaggtgatgtgaatgcctttatcatatttataaggccttaatttaatagaacactatattgtacgaaataagaatattggttaatttgcaaacaaaaaagcctgtcataaagacagacactgttatattctgctgaaatgattggcttaatcaaacaggcactaatacaaggataaagatgctggtatgcaaattggattatttggctacttatccgagccggcgaaaagatgccctttttatacctaaagtcaaccgccatcgactaaagtcacggtatttctggctgaatatcataaaaaattcaaaattagatttttatcgtcttggaataaggtaactcgattcggcagccttagcatatactaaaaacgttaaatactttacttacataataaagtatttgactaggcatattttacggtgaacttatagaattcttgacctatttattaacatttttgaaagcgagttctacgcattactccccctgagtaatagaataattaaatataatcgccctaaagaaagtcaaggataaagagacccattatgatgcacctcctagagttagcaataaactctaggggggatttttgaaattaggcaagaaaacaagttctttttaagtgttttcagaatactattagtgctaatcattcgtttctttgcaaaaaaagtgattgtgatgatgaactacacaccgactaaagtcggtggtttctgggaacgcaaagtagtatttaggctgttacattggtattccaaatacctaacttacagaacttcgttcttttaccacggctagtccctagccaacggcttttaaccctttatgcagaatattaactgccgcattaatatcccgatcgtgatgggccccacactttggacacgtccattcacgaattgcgagcggtttagccccactatggtagtcacaatgactacagatttgactggtatagtggggcttgacaataatgagctgtttaccataccagtcacacttgtatgcgagcatggtacggaattgatgccaactagcgttagcaatggccacggcaagatgatgattcttttgtagattcttgactttcaaatcttcaatcacaatcacatcgtattgcgtgaccaatgccatcgtcaacttatgcaggtaatcaagtcgctgatcagtaactcgtcgttgatagtgagctttctgaattcgggcccgttgccagttctggtagtcattcagttcctctttgacgtcctgatggttatggttccattgacggacactcaccgtggcttgatgacggcggcgactatacttggactgccaatgttgcgcctgttgagttaaccaggtagcgtcaaatttagcatacttatggccgtcactagtaatggctaaattagttacgccgacgtcaatgccgacctgttgactagtcttcggtagtggctgcactgtggtctcaacctgtagtgacaggtaataacgatccgacggatcataactaacagtatagcgtttaatcttacaatgagttaactggcgagttttgctggttttaatatagccaattttgggtaatttcaaatagcggttcgccactatttgaattttgcttttaccagtataggaccgcttagcagacatgccatattgatcaataaactggctactaggattgttttgataacgttgttttgccatatcaagcatctggttccaaacaaagcggtcattgccaaacatttgccatagttgagcttgttgttgcttgttggggtacaagcgaagcttaatccctttcaaaattgtggtcatgttttcacctcctttatgctttaattttactaaatttgcaggggtgaaaacgagattttatagactttttagtaagaaaaagcagtctcatggctgctgtagaaggtattcatcccatgactaaagtcacaggctttctacctataattttcagtaaataatggaatgccctacagttgttagacaaagaatctaataattgtagggcactttttctatggcaaaatatcaagttgtgcaggaatctctaactagacgcggttttccataaaattgagtacctcccccgtaattagctaaatggcagcaaaatgaaaaacgtaaagtttagtaatttaactgctactaattagcacaggaggaatcttatatggcgcaaaagcttatgtcggctaactctactgacaaaaattttaaaatgtataagagtaagaaaagttgggtattcgcatactctacaacattagcattagctgcagttgccggcattacactgtctacaactaatgttcatgctgatacaactaatgggggagacaaccaggtaaatgctacggcagttactcaaaacacaacgagtaatacggttgatcagattgctgctaatactgcgcaaacagataacactagcacaagtattaatattagaagcttaatggatgacttggcatcaggcgatgacacgtcctctagtcaaaacggacaagaacagtcacaaaattatgcttccagtaatcaaaactcccaaacccagcaggaaaacggaactacaggacaaagtactgcttctcaaaatggaactacctctgatcaaactaattctgatcagagtgataagaactactatgtaatttcaacccgggatttagataaaaacgggaatgttaattatttaactcaaaagaattacaccagcatcaagggacaagaagttgctgatgggacagttgtgacgtggccgctaagtgtttcggcactaccggcaaatcgtgctcaagatttgaagagccacgttatttctgaaaccctggatcctcatttggaatatcttcattatcgcgcttacttaactaatactgatggaacagtaacggatgttactaatcacgttaacttgaatcgcagtggacagacattaatatttactgatgataattatctactttcaatctataacaataatcgctatcgggtacagaacttaccagtaatcaagctagtcacaaaggcaaatggtaatggttatatcatccccaacgcttttaaatcatcatatgtctttaatgatggtagccatgatgtttcatttacaaccacgtcaaataatgttcaaattaagaccttcaacccaggtaatagtaaggatgttgaaattggtggcaatgttcaaggtgatccttccggaacaattaatggacaagtagttgcagacggttcagtggttacttggccaatgtctgttggtgatttaccggctaaccgagcacaagatgttttaagccatattgaaactgatacgttatataacggtctaaattatgaaggataccatgcttacttgccacaagctgatggatcattccaagacgtaagtagccacattaatgttcagcaaaacggtcaggatttaacttttattgccgacgactacttaatcggattatacaatcaagacaagagtactgcatttaagatgccaatcattgacttgattacttcagttcatggaacttcaattattgctcctaataagttcaattcacaacttgcttttaaagatggtaatggccaaaccgttattaataacacttctaatcaagtccagatttcaacatatcatcctacgaataccaaagatgttgaactcggtggcaatgtccaaggtgacacaccaaactcaattaacgataaggtagttgctaatggtgctattgtaacctggccaatggcgtcgtccgaacttccagcaaatcgagttcaagatctgcagagtcgagttatttcagaaactctagattcacatctgcaatatcaagggtataaggcctggttacaaaatgcagatggtaaatatacggatgtgacttcgcacgttaagttgactcaagatggtcaaaacttaacgtttgccgatgatgagtacttactaaacttatataactcaaataagggtactgcttacaagttaccgattattgatctagtaactaaagttaatggagcaggtattactgcgcctaattcttacacaactaagtatgtttatagtgatggggatgggaacacaactatcaatgtaacctcaaatactgttaagatcagtacattcaatccaacaactaataaagatgttgaacttggtgataacattcatggtgatactgagagttccattgctggtaaacttgtttctgaaggtaccattgtaacttggcccttatctacttctgacttgccggcaaaccgtgctcaagatgttgtaagccacactgcggttgatgctcttgaaccaacccttcaatacattagttatacagcctggttgccagactctaatggtcaattacaggatgtaaccagtcatgtaaagatgactcgtgatggtcagaaattaacattcaccgatgatgattacttaattggattgtataaccaaaacaaggatatagccctaaagatgccaatcattgacctggtaactaaggctactggtaatactaagttattaccaaattctttcgattcacagtttgtctacaatgatgtagatggtaatacaattattaatgtttcttcaaacaagccaactgttgaaacctttgatcctacggttcataaggatgtagaactcggtggaaacaacgtgcaaggggacactcctaactcaattgatggtaaaatcgttgctcaaggaacagttgtaacttggccaatgagtactagtgatctgccggctaatcgaactcaggatgttgtatcacactctacaagtgagactctaaaccaaaatctacagtacgttggctatcatgcttatatgccagatgcaaatggaaaattacaagatgtaactagtcatgttcagctacaacaaaatggtcaaaatcttgtcttcactgatgactcttacctaatcaatttgtacaaccaagacaagagtattgcatttaagatgccaattattgacctaatgacaaaggctatttctgatagtgcaacgattcccaacacctttgaatcacaatatgtctttaatgatggaaatggcaatactacttttaaatctacttcaaatactgtccaaattattacctataaaccaaagacgacaaaggacgttgaattaggtgataacattcatggtgatacaaacgcttcaattgcaggtcaaatgattactgatggaacagttgtaacttggccaatgagtactagtgatctgccggctaaccgaactcaagatttgcaacaacacgtagttaccgacaacttaaatgacaacttgatattccaaggctacacagcctggttaccaactgcaaatggtttagtcgatgttactaatcatattgaattaacacgtgatggtcagaacctaacatttactgacgatgcttatttgctcaatctatacaatcaaaataaggatactgcgtacaaattaccaattattgacttggttactaaggctaacggtaatactaagttaatccctaataattttgactcaatgtttgtctacaatgacggtgaccaacagactacagttaatgtaacctccaatacggttaacatcagcacatatgatccaactgcaacaaaggacgttgaacttggggatgatattgaaggcgatactgcggacactataaacaacttaatggttcaaattggaaccaagatgacatatccattgactgttagtgatttaccggcaaaccgtgccgatgaaattactgctcatcaaagtgttgatacattgagcgactacctcgagtatcaaggctacaaagcttacttaccagatgctgatggtaaactccaggacataactgagcatgttaacctaaaacgtgaaggtcaaaagttgtcatttaatgatgatgattatctcatcaatctgtacaacaattccaaggctactaagcaggctttgccggttatagatctggtagccaaagttaccggtagcaatgatggtaaaaaagtccacatcattcccaaccattttgattcaacaattactactaaggatgggaagattaacactacttctaatactgttgtgattaactcgaatgatccagaagctgttaaagacgttgaattgggtgataacgttgtcggtgatactcctaattctgtaacgggtaccacggttgctgacgggaccatcgtaacttggccaatgtctgttggcagcttgggagcaaaccgggcacagaatgtaattaagcacaccgaaaccgaaaatcttgatagtggcctaacatacttgagctttaaggcctacttaccagacgctgatggtaaaatgcaagatattactgaacatattaatattcaacaagacggtcaaaagttagtattcaccgatgatgactacttaattagtttgtacaacaaagataagtcacaacgttttgctttacctgttatcgacttagtaacacgagtaaacggtgataacaagataattccaaacacatttgtttctcaatttacgtttaacgatggtaagggcaatacgattacatcggtaacttcgaatcaagtcaatgtctcaacatttaaatcaaatcctgaaaagcatgttaccttaggaactgatattgaaggtgatgatgctgaaaatgctgatggcacagttgttgcacaaggttcagaagtaacctggccattatctgataagagtccattgccggctaaccggtcgcaagacgttaagagtcatacgctagtggacaagcttgacgataatctgcaatacaatagctataaggcatacttgaagggtactgatggtaaactgcaggatgttactgatcatattaaactgactcgtgatggtcaaaatctcactttcattgatgatgattatctacttgatctttacaataaagataagtcaacagctttcaacttaccgattattgatttagtaacgacagtagtaggtaatgataagctaattcctaacaagtttgactcaaactttgtcttttctgatggaaacaaagacacaagtatgaagacaacttcgaacgaagttagtatttcaacgtacacaccggttactaataaggatgctgaactaggtgataatgttgttggagacacttcggattcaatcgcaaatgaaacagttcctgatggaacaattgtcacttggccacttagtgtttcatcattaccagcaaatcgttctcaagatgtgttcaagcatgttattgaggacattcttgatggtaacctgacttataacagctttaaggcttatttgaaagatgctgctggtaatttacaagaagttacggatcatgttaagttggctcaagaaggacagcacttaacctttacagatgatgattacttgattaacttatacaatagttcaaagaacaaggaacaatcactaccgattattgatctagtaacgacagttcatggtgactcaaagctaattcctaatgaattcgataatgtatttgttttcaaagatggaaaaggtcaaacaactgttaaaactacttccaataaagtgactattaagacagcaagtctgcctacaccaactaaggaagaaacagatgatcagggtaacaatattaacggtaatgaagttaaggctggagaacatgttaactacacattgaactgggatctttcaaacgataaggatgttaaagcaacaccagaaatgatcaagaaaggcttcttcttcattgatccaattgattctcgtgctttgagtgtagatgatttgagtaaggctaaagttgttgatcaaaacggcaacaaagtagatggaattagtttccacttatataacagtctttcagaagtacctgaatttatccaagaacaagtcaaggctaataatcttcaagacaagatcactggtccgtttgtggttgctcaagcagatgatctacaagcattcttcgataaatatgttaagactggtgcaaagttgaaagtaacaattccaacaattgtaaaatccggcttcactggagagtttagcaatactgcttatcaattcggctttggtaaggcaacaccaaccaatacggtaacaaactatgtaaagccaatgcataagcctgcatcccctgaaactccggctgcaattgcgccacaggttattagtgctacagcacaaccaatgacatcggatgcaccagtaacgcctagtgaaaaaacggctaaattgccacaaactggtaatgctgacgaaggtgcgttgttaggtttggctgcggtaagtctagtaggtagtctaggattagctgccttaggacttaaacaaaatagaaatgatgattgagcaagaatttatcccatagtttgcgagaaatccttttagaagagcttgcctaataatagcggctcaatataatttaaatttaaaaccacctaattagcaatcgtaaaattgttaattaggtggttttagtatagaaataacccctaaattcagaatactagaaaatctagtactattattttttccttttcgggaataatagacatgaaagacaagaaaagataagaaatggtaaggaaactttgtacagtttaataaaagcagttgagtattgactattggcgtaagttttgatttttttaattgtaatattaatagaattatttaatctatgaaatactaatttcacatttgcttttgtatgtgaataaatctctttttcttggatcttagagggttcgtaaggtaaggaattaatttgtttagtatattctttatccgtagtttctttaattaatttcttcgaaaaatgctttgatggtgttcgagagtttgaattgttgtttaagcttttaatagagttatctcttattttatttttttgatatttaggaatatttaagttattgacctgctgattgatgtaactaatagaattatgctttgcggtatttaaattcccatatagtccagttagaaatattgctacagctaaggaaacccctacttgtcttaaaacacctgcaacactttgtgaagcggttaagagataaccttcaaagtttgatgctgctaaaactgttattggacctgcaataatcccatacccagttcctaaaataatacaagtaaaaataattaaggtaatattatccatatcaatatgtgtaaataaatagtaagagatacccattaatagaaaaccagataagataatggctcgagatcctaatttgtctaagagaattgcagaaagtggtgacatgataaaaatcattcctgtaataggcgtgataagaagtgcagcttctaattcggttctatgttgtatatgggtaaaatatgttggtaaaattactgtaacagccaccagaaataaattacttaaaattatagaaacggcagagccggtaaattctctattcttaaataaaacaagaggaatcattggtgctttagcataatgctcagtaattaagaatagtatgaaagttaaaatgaaaatgaaaaacagaaggttgattgcaggacttttccacccccagcttcttccttgagtcaatattagagttaaagctgaaagtaaaattatacctaaaagggaacctaaataatcatttccttcatttgactttggttcgtgaaagttgaaagtagataaacaaataactagtgaaagtatagtaaaaggtatattaacgctaaatatagaatgccagcccataaattgagttagaatacctccgattgaaggaccaagagcagcagctaaaccttgagtgattcctaatgcggcaataactttttttcttgtctttactgtaacgatatttattccaatagtcattgaaagtggaaaaagaattgcggctcctaatgattgaatgccacggccaagaattaaaatagctaggttaggacttataccagaaatacttgatccaataagaaacataattaacccaattatatataagaaattcatacctaatttttctgcaagtttagatagtgggatcgttaaactagcaaaaagtatagtatatatgtttaatgcccaagacaaattagttagagtgacgtgaagttcgttttgaatagctggcaatgcaatattcataacagttgtatctaacatacataagaaaatactaatacacattgcaattattattagaaatttgttttttcttttggtcatacttgtttcctcactttgtttatattaacaatgttaatataaacaaaagaaaaataaatgtcaacaatattatcattgtaaatatgaacaatatgtattaatataaataaaaattagtgaggtgattttatgacagctgtaatagttggaattggtattactagttcctgtggagagtcctttacagaaattgaacaaaatgtaggtaaaggaaaaacaggtatttctaatatcgattattttgatacatctgagttaacatgtggaattgctggtaacttatcaaagaaaatatggaaagaggttttgcaaattgctgataaaaatgaattagattggagtagtagtctttcaatttatactattcagcgattacttgaatcgtataatatttcaaaaaaacaaagaattggtttatctcttggaacatgtaatgggggaattcattctttagcagaatatcttgatacttcaaatgataaatttttaaaaaattatcctccgtacattcagagtaaagatatcgcacattatttcaactttaacgggccaaagtattcttttaattcagcttgtgcggctagtgctaatgcaatagcttatggagcagaaatgattaataatagcgatgcagatcttgttgtgacgggtggttgcgatccaatgtcagaatgggtttttgctgggtttaattcattaagaacctttaatagtaaaaattgtatgccatacggtgaggaatatggacttaacctaggagaagctgctacatacttcttattagaagataaagataaggcaattaaaaaagggcataggatatatgcggaaattttagggcacggcttatcaaatgatgcttatcatcctacagcgcctgataaggatggttcagggatatcctatgcaataaaaatggctttaaaaaactcgggtctgaagcctgaagatattttatatattaactctcacggaacaggaactaaagccaatgatagtgcagaatacagaggatttaaaactgtttttagaaatgagatgccttttattagctcaatgaaaggatacgtaggccataatctgggagcagctgctagtacagaattagctataagtttaatcggtatgaatagtcagaaagttttgtatcctaactttaatttaaccaagtatagagaagattgtaacgatgagcatatcttaaaaaagccttattcattagatggatatgaagatatcaactttataaacaataatgctgcgtttggtggacaaaatgttgctgtaattttccatgttaatttagaaggaaaatatggtcatagtgaaaagaaacttaaaacacagcaacctatatatattaataattttggcgttgcaagtgataaagcttatatgacaaagcatggtattggtattcttgacgatttacgccccttaaagaaaaaatatccaaaattatataagcgacggatgaatatgttaactcaagtaagtattatcgcggctaaacaaacattgcaggatcagtatagtaattgtgggcttgtgtatggtacgccttttggtagtctttcatcaacactaaaatatgttgattctattcaaaaatatgggtttaaaaatgctagtggggcatattttccagatttagttattaattcaacgacggggcatatttgtcaagcgctttcattgaagagttatagttcatctataagttcaggaggtgatgaagacttaagagccttaattattgcacataatgcgcttaataaagggtacgcttcaactatgttagttggagcaggccaagaagagacagaactgggcaataaagtgttgaagcgtgaagttaataatcatgcaacatttttaagccttagtaacaaaaaaatgcaagaaacaatagcagaggttctatcttccggtgcaatgggatttaaaaataaaaaagagcttttgaccattatacgatcgaaaatagatgagaagttggctaatgatgcagatctaaaagtgataattcaaaataatagtgaaattacgaacgacgaattaataagttatttcaagaatgataacaatatcagtataaattctgataattttgcggatagtaattttaaatcatttgttaatcatagaaatgaaaataggttgttgcttgttggaatttcacaagtcaatgatgtttcgtttgcagatattaaaaaaataaaatagagaaagaggtaatactgatgaagcatagtattgaagaaattaaggatattttaaaagaaaaagtattaattgaacgattagagttagatgatgtagaacccaatgatatttcagataatgaaaatttatttgatgaagaaggactagcgttagattccgtggaagcattagatatcatgacaggaattagtgaagaatttggcattgacacatcaatgttagggcaggaagatataaaccattttcaaagcgttaatgatatggctaaatatatctcagagaatgaatagaggatagttatgaaatcagtacttatcacgggaataactggaggaataggaagaaaattaactgaagcttattcttcaaagggatatcatatttatggtacgtgtagtagaaattcagactctttacaacaatttaaagagaaatggcctagtgttgaaataattcaaataaatcatgatgacttgatagatgtaagtacagaatattcctttttttttagaaaagtgcaaccagatattgttattaacaatgctggaatagtgaaagataattttttagttcaaatgtcagtgaatgattttcaagaagtgttgactactaatttgatttcggcttgggtaatagtcaaagaaatgcttttacatttaaatgataataaaattcataaaatcattaatgtagcttcaatatctggaattatagggcgtgaaggacagtgtaactatgcagcaactaagggaggattagtaggcttatgtcaattgatagaacatttagctccgaaaggcagtaatgttatttcattttcagttgcaccaggattaattgatacagatataaagggaaaaatgccaaagaaaaaaatcgataatttaaagaaggccacattggcaaataggctaggaacaccagaggaagtatcaaaatttatttttaaactatctgaagaggatatttcgtatagtgatggaactttatataggattgatggtggagttttaaaatgaagataataaataatacgattcaagtaaccgacttgcttcaatcatatggaaaagatgaaaaagacatagtaataattggtcccagcccatttaatgaattagattgccttaaagaaacaaaaataatcgataaagttcagcttaatttagaggaagttttttcatttgtaaaaaataatagcgttgctttaatgaaaaaaagaagaggaaccattgcctttttattaaatccacaaagttttgagggaggcaataatatctattctccaatctataattcagcaattaagagctttttgaaatccttatcgaaggaaatgaatccattcagagttaaagttatggggataatcttacctttaacacaagatacaaaatcgactcggaaatatgatttagttacattaaagtacaaaggaattaataatgaaaagcaggtacaagatattctaagcttacttaagctttcagaaatactaaacggacaaattgtctcgctaggcgctgaattgaatctttagtaaaggagagggaaatcattttatttctagatcaaaatgcagttataaaaatgttgccgcagaaggagccattcaggttcttagatacggttgaatgctttgatagagaaaaacgtatgattactgcattgcaacaatttggtaatgaggaattcttctttaagggtcattttccaaataatccaatagttccaggggtacttctaacagaatcgattgctcaagcaggtttgatattgatttctttattagaaggccaaaaagtgaaaattggatatctagcccaaattgaaaagacaaaatttttcaaagaggtctatcccgacgagcaagtaaaggttaaatgttcattaaagaaaaaaataggtaaatactattacattgcaggagaagtctactcgcagcaattaaataaaagatgtatgagagcaacagtaatagtatgtatttgatatggtgatggttcatgataaaaattactgaaaatatagttcaaataaaactaaagcaaggcaaaaattatccagacgttaatgtttatgtacttctaaaagaaaaagtgttaattgatataggccccaaatcaattaatacacttaaccttttaaaaaaagaattagctaggttaggattaagttttgaaacacttaatttaattattctaactcaccatcatgttgaccatgtaggacttttagagtaccttccctctgggttacgtatcgttggacctgatcatttagacttttatagttcagatatttataaaaaaagtattcaaaaattgttagttgacgataatctctctattgaatttaaaaatgatatagaaaaacaacttactactgaaataattccaagtattaatagagaaaactacgttccttttagtgagtcaaagaaaattttgcaacaatttggtcttacagctgtagagctatcaggtcattctagtgaagatattgtaattactgattcagaaaataactgttttactggtgatattattattcctaaaattttttttaactgtatatatgaggttgataaagtaaggcccaaacatcaacgttggtcatattatcatgagcttaattttttagacaggttagtaaacctagtattgccaggacatggagatattctaaagttagaagaattaaaaaaggcagttttggttaatagaaaaagaatgagacggacagagaaaaaaataataagagagttaaataaagaaacagttaatggagtggagaatgtttgtcgaagtgtattccaaagttttttgccttatagcaaattcttaccgttttcagaagtagttagtgttatcgagagtaatgatgagagaattaactattgatattatttatataaatacactaaataataacagctttgcaagtttagattctagaaaaagaatcaaaaagttacagcatcagctaggacaatatatgctttctcaaatatcttataaaaaaggttattcaatttcccatagtcatatgtgtgtagccttagcaagttatgttaatagggttggtattgatattgaacttataaataaaacaaagaaggcaaggatacagttcctttcgaaaagcgaaaaacaattagtaaatagatatggttttacaagaatatggacactaaaggaagctatagctaagtatcataccgttgggttacctcggcttaatacagttgagattaaagaaataaatgcttcgaacgttatctattttgttaataaagcaccaagaaaattgcagtataaatttttagatataatcccttcttataggttgagtgtagtggcaaaaaaggtatcaagtttttgcattagaatcacacaagaagaagatttgaaggggctaataaggagaatgtaattaatgcaaggaagagacataattctaggaatacttgaacgaaataatagaacaggatatgaaattaatgatattttgaaaaatcaattatcttatttctatgacggaacatatggaatgatatatccaacattacgaaagcttgaaaaggaaggaaaaataaaaaaggaaaaaattgtgcaaaatgataagccaaataagaatgtttattctattacagatacgggaatagaagaatttaaagaatacttggattcttctattcaagatgatatttataaatcggactttttaatgcgtctcttttttggaaactcattaccaaatcaagaaattattagagctattaaacaagagatacaacgtaaaaatgaaaagatagatcaattaactgtaaattataaaaaatggaaaaaaaatggaatgagtaaaacacaagaaataaccgtcaaatatggtattgcgcagtataccgcaattgttcagatgctgacaaaagagcttgatacgttacgaagaaatgagatggatgattaatgtcattaggaattatatttagtgggcaaggagcacaaaaatctaaaatgggtcttgatttttatgaagatccactatttgctgaattacttaaccacgcaagtaatatatctggtctaaacatgttaaaaatcttggaaaacaaaaataatgagcttacagagactgttaatttacaaccaacattaacaacattgaattatggcatatatcgaatgctgaaaagggatatttttgatatgaaagtaagctgtatggcagggctttctttaggagaatattctgcactgattgcttctaatgctttaacttttgaacagggaatacaattactagtagaccgcggaaaatatatgcaggaagcttcgaatagtaatgcaggaaaaatgttagcacttataaaacctaaactaaaagagataactcaaatttgtgctttgtgtaaggttgaaattgctaattataattctccaaagcagatagtaataggcggacaaaatttgcaaattgaatttgcaaagaaaatgattatggagcgtaaagctgcattaagaataattgagttagaagtaagtggcgcctttcatacttcgttattttcaaatgttcaaaaacaattggaaaagcgattaaaagatgttaaatttgagaatccacaaattccggtagttagtaatactacagttgaggaatttcaaaaggaaagtcttacagccgtattatcaaaacaagttgctaatcctacatattttgaaaaagatattaagttaatgaaaaatacttatggattgacacatatagttcaaattggtcctggtaaggcattaagtaattttgtgaagcaaatgtcattaggaattaagacatataatatttctaatataaaagactatagaaaatttctgaatagttatagagatattaatttgaaaggaaagaaaaatggattttgagaaaattcagcaactaattcaaatgtttgaaagctctaatacaagagaactaaaaatagatgataataactttcacatttatcttacaaaaaacgtaagtaaagaaccaattcacgatataaaatttgaatcgaataaaattcagcaagcctcagaggcaaaagcaaacaggaaaacgataacagccccattggttggaacagtttatttagcctcttctcctacgtctaaaccgtatgttcaagtagggagccatattgataaaggagatacagtgtgtgtaatagaggctatgaagctaatgacggaaataaaaagtgaggttaccggaacaattgaaaaagttaatgtagagaatggagaattagttgaagttgggcaaccgttattttcagtttctggagaaaaagaaagttaatgaaagagtgaggtgtagtgatgttttctaaagtactagttgctaatcgtggagaaatagctgttcgtattattagaactcttcatgaattgggcattaaagcggtagctatttattcgattgttgatcaagaaagtcttcatgttcaattggctgatgaagcagtttgtgtaggtggagcacgaccacaggattcgtatttaaatactactaatattttaacagcagcaattggaacaggagcacaagcgatacaccctggctttggattcctttcagaaaacgctgagtttgcaagaatgtgtgaaaaatgcggaatagtatttataggtccgcgtgctgctacgattgatttaatgggaaataaagaaaatgcgcgcgagactatgcaaaagagagggatacctgttattcctggaagtagttcctacataacaaacagttatgatgcaaaaagagttgcagataaaataggatatcctattttaataaaggcggcagctgggggtggaggtaaaggtattagaagagttgtaacgcctgagcaaatgaaacaagaatttaataatgcgcaaagagaagctcgtatatcatttggtgatgatcgtatgtaccttgaaaaaataatgtgcaatgttaaacatattgaagtacaggtagttcgtgatagattcggaaatagtgtctattttccagaacgcgattgttcactccaacgggataagcaaaaaattatagaagagagtccatgctcggttatcaattcagaacaaagaaaaattttaggaaggtatgctattaaagcaattgaagcagttgattatcttaatacaggaactattgaatttttgatggataaaaataataaattttattttatggaaatgaatactcgtattcaagttgaacatactgtaactgagatggtaacgggaatagatctagtaaaggtacaactgatgatcgcttcaggtgaggaacttcctttttcacaaaataatattaagttaaatggggtagctattgagtgtagaattaatgcagaagatcctaaaaataactttgttccttcaactggaaaaataaattatttatatttacctgtaggtaacttgggtatgagaattgatactgcactttactctggagaaaagataacaccattttatgattcaatgattgcaaaagtaatctcgcatggccatactcgcgtagaagcgatcaatagaatgaagaggttaatgcaagaactggttataaaaggtgttaaaacaaataaagatcttcacttatcaattttgggagattcaagttttttgaaagatacagtaacaactgagtatttagagaaaaactttttaccaatctggaaagagagggagaaaaatgcagctgtatgaaagtgcaacgttaactaagcaacatgtaaaggcgaatattaaagcaaatcaaaaagtacctgatgggatgttaaaaaaatgtcctaagtgtgggaaaatctttctgtctacagaatttgataagtatttttcgtgtcctggttgtaattatggatttaggattggttcatggcaaagggtagcctgggcggttgatgaattttatgaagaggatggttcacgagaactaataacctcagatcctttacattttcctaattatgtaaaaaagattcaaggacttcaaaagactactaaggtaaatgaagcagttttaacgggtaaagctaaaataaaagaccaaatttttgagtgtggcattatggatcctcactttataatgggatcattaggaacaattactggcgaaaagattacgagattatttgaacgtgctacaaaggagaggttgcctgttgtcctatggactgcttcagggggagctagaatgcaagaaggaattatgtcattaatgcagatggcaaaaataagtcaagctatagcacaacatgcatcgaaaggacttttatacattgttattttaactgatccaacaacaggtggagtaacagcaagttttgcaatgcaaggagacattattttagcagagccacatactttagtaggatttgcagggcggcgagttattgagcaaactattcatgagagaatcccagatacgttacaggatgcggagaatgtaataaaacatggattcatagatttaatagtatctcggagtgaagaaaaatctttactttataaattgttaaaatatggtaggtgataata

SEQ ID NO: 51 - DNA, 150023 bp, Artificial Sequence
  Based on Lactobacillus reuteri
ttgttgagaagcatgacttaaaccctgatccagctactttcaatttccgcaaaatcttcgggacagctgaccggtcagatgcgatttactctgaaccgcgggtatgggttggtcatcaaatgtttagtccccggcaagcaacggaagagaccccagaatcaaccgaactgccatttatcatgaagccggaccataagttatcgatttttgatgcccagaactatctcagcaaccactatgagagaaccgaattcgatccgcttggtcatggtgagcacgctcataagtaccggccaattagtttagcaaagacccaagagtcacatattttacagatgaaccgaccgggcgctaatattcactggttagcaatgggagtcgctgccgaaagtacctatgtgccattcttcaacggtattaccgatacgcccgccccgtataagcgggaagctaccggctcagctcaactctgcttactggattttcaagcatgccagtgtgctagttgacagccacctacacgattttcttccattattacgggatgtcagaaggaacgaaacgccgcggccattaagatgattgccaaactgattgtcgcctcccgagtctcaaaggagaagcacgagcaactttcttaacgcggcaaagcgacgactatgcgaccgatactttgaatgcttataagaagttagccttgaattgattaccaagatgactgattattgtgaattaaactttaatacagatgagaatctgtaaaataaaaaagaagcagctcctaagttggaatttccagcttaggggctgcttcttgtatgcacctaaataaacgaggatcaaagagttttacttcttcaaatcctcgtttatcttaattttgatgatgtttttcaactgccgtaactagttcttccaatgattgacttccaaaaataactgggtcatcatcaatcatcgtcgctggcaataatcttcttttttccgtaattctgggaaatgctgcaagtcaatcatcgtggcagtaattcccacattcagagaagccatccgttgacaagccgcaacaacatcaggagaaatgacaagttaaggaaacgccaatccgaatcttagtcggcgcaagtttcttaattcgttctaccatttctggtgcaattgtttgtccaggaccggcaacgttgtagacacctagaactaaggagtttaattcgtgaccagttggaatccccgcataatgtaagccagtatcattaccatccgcatcaagcaagcgcaattgtggtaagtactttacgtccgctggcgccggtttagtctccatctgcaggtgcttatcaagtgaagcaaattcttcaacaaagctaactaactgattgctaagctctgtcccattggttaacacttggagtttaatatccttagtcaaacgggcaaagattggttgtaactgttggtcaatctcagctggcagccagtttccttcatgcggcgtggtgttttcttgttgactaagttcgcttgtctgtcccacggtcttagcaggctttttattagtttctgcatgaatcgggataccttgcttttccttttgcaaaataatgtatcgttctgcagcagtagaagcaaccgccccatcggatgcagctgtcacgatctggcgaagatttttatggataacatccccagcagcgtaaacgccatcgatgtttgtcttaccattttcatccgtcatgatatagccccgatcatccaaatcaaggatattagctaatgctttcgttgctggttgcgtaccaatataaatgaacatcccaaatgtctggtcaccatcatcgacatggtaaaccgtctcttcgccagtcttattattaaccaaggtagcagtagtaaggtaatcatccccactaacttcctttacctcagtattgtattccacactaactttaggattatccaaggcacgcttagccgtcaatacaggacatgcaaaatgatcgccacgaactaaaacagtaacgtgcttggcaaagcggctcaaatagtcagcttcttcagcggccgcatatccgccaccaacgacaaagacttgaagaccggtaaaaagttcgccatcacaagttgagcaataagcaattccccgtccacgaaattcattttcaccgggaaaaccaacttttttagggttagcaccagtcgcaataattacgcttcgggcagtatatttttgaccactcttgccaatcaatgtcttaacttcaccagtaagatcaaacttttcaaccgcatcatgttgaatttcaaccccaaagctggcgacctggctttgcatctggttcatcaattgggtaccgtcgactttttcgacagctggataattataaaccaccgaggtcgttgttacctgaccgccgacagtatctccttctaaaattaacgtatccaaggttgcgcgtccagcatataaaccagcagataatcccgctggtccagcaccaacgatgattaaatcatataaatgttgttctgccatttagctcaccaaattaaagcttaccaactagatcaagacttggcttaattgaatcttggcctggcttccagttcgctgggcagacccggtcaccatgttcacgaacaaattgagcagcttggagtgtccgtaagatctcatcagcactccgaccaattcccatattattaattgtgtaggattggataataccatcaggatcaacaatgaagactccccggtatgcttgaccagcgtcttcgtcaagaacatcgaacatccgggctaacttaccagctgggtcagcaagcattggatatttgatcttgccaatcttgtcagaagcctgagcccatgccttgtggacaaattcggtatcctcagaaacagagtaaatctcagcgtttgctttcttgaagtcttcgtgcttatcttgcaaagcttccaattcagttggacaaacaaatgagaagtcagctgggtagaagaagaaaatactccacttacctaaaacatccttcttggatacttcggttgtttcaccgtcatgataagcatttaccttaaaatcttcaatttcatgtcctacaaagttcatgtatatcctctccttaaattagaatcattcttaactgcaactcttagtataatctttttatgctaatttgcaagtaattttagaataattccaaaaagatcaaatttccttgccgaagattttcgtcttaatcgcctgtccagttggggttccagccagtccaccgaggcctgtttcccgtaaatcaactgacattgaccggccaaccttatcaagagcagaaatacattcatcggccggaatcatactcgtacaaccagcgagtgccatatcagctgcaattaacgcgttcccagctccaatcgcatttcttttaacacaagggatttctaccaaaccggcaatcgggtcacataccaagcctaacaagttactaagagcaattgccaatgcttgactgctttgttctggactaccacccgctgcttcaacagccgccgcggcagccattgccgatgctgaaccaacttcttcttggcagccgcctgtcgcgccagcaattcccgcatgattggcaataattaagcccaacccaccagcagtaaataagaagcgaatcatctgatcttcactaaggcctaatcgttgttctaacataaaaagagcgccaggaagagtcccggatgaaccggcagtcggggttgcgcagatgactcccattgctgcgttaacctcgttagttgcgatcgcattttccacggcagccatcataacatcaccagagagggtctttccttttgcacgatattttttcagcttaatcgcttcgcctccagttaaaccagtttttgaccgaactcccagctcattttcaccttgtttaattgcggctcgcatcgtcagtaagtttgatcgcatccgttgccaaacttcttttcgattgctaccagattcatgacattctgcctcaatcactagttcggacaatgctttttgctgaatttctgcagttcgcactaaatctttaacactttgatacatcgctctttctcctaaagacaaattgcagccgggtacttcttttcaaaataagcaatcgtcgctggctgcatcggttttttaatatcgtaaacataaatatcacaatcatctgcccgtaatacttgtcgccgggtaaatggtgctttttcttccaaatcagtattgatcgccagtgcattggccatctgtttactataatcgcgaaagataacaattggtaagggacccgctggtaaaatatcaacaccatcaaggttaatagccctaatttcaattatcccgccaccgatcgaacaaccagcaaccgttaccctcgtcttatcaccagtcatttgaaggatggctgtgttaggatggtgaatcgggctttcaccctcttcttcaacaaagcgaaggtccattcctccttggcgagcaatcattggcgccgatggaactcgtgaatcgtctggcgcaaatcctagcaatcccgccgcaattgcatagtctgttccatgaccacgatgcgtccgagcaaaagatccataatagtgaacggttactttaggtggaaccgtgccaaaaagtttatttgcgactcgaccaatcttgaccgcccctgcagtatgcgaactagaaggaccaatcattactggtccaataatgtcaaaaacacttttatagttatttttcatgttgttgttcccttaaaaaatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactgtgtgcagttcgccagtagcccttgcgggtactagcgaagacatatgcatcacgctgggacagccccagcttctgtaagttagttaccttagttttaagcttcttccattgcttccagatatactgtcttattcggaccctcaaccacttgtcaaggcgttgaataaagtcagttagtttcccaattgagtagtactgaagccatccacgcatttttcgctgaatttcttcaaacattcttgtcagggatattccacgattacgtttagttaataacctcaatgctttctttactcgttgttgcgattgtttagctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttgtccaactcatttagatagatgttcgccagtagtggtgacaatggccctccttgtggggttccttttccactcttagcgaaaagcccatggtctaagactccgctagttagaaacttacgaatgagtcttagtgtccatgggtcatcaatatattgttggagatacttaatcatcaagtcatgattaacgttatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaactccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttgttgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcatcgttagctttactgagaccaacttcgagtagtattggacttcaacttgtctagcagccttatccagttaatttcagccttatagctacttcttgttcatcgatgcagtactttgccttagacttccttcagattccacctcacggtggacacccttgtccttagctcatggttccgactactacggcccatagcggactttcaccacctagctaatacccatgccgggcgcactaaaatagaggttgaaagaaaaatcatgtttttctcaacctcttcattataattactttttctttttatgaaagtcaagaaatgaccagaagccgcgatgaccaccagattttttcttcggtttcttttctgcttttcgatcttctttggcagccttttcagcaagtgctttttgcttggcgagaattcccgcttttgccgctctttttcagcctcttttcgggctgccattgcctttttagcccgtgctgcccgttgctgagcagcttctttcattaattgtggccgcgttccattgtatcaaacattgttgccaccttaatagctgccttattggctaaggcttgatcagtatttgaagccacttcaatattatgggctgccgtaatctcacgttcccagtattgttgtgtcttaataggtaaaccagcaaactcctggctccgtaagaactgacctgctcgtgataactgcatcttcaacgaatgcttatccgtttgctgaccatttaatgcttttcgcgaattataaatcgcttgatcaacaaggtcgaccattgcttgtggttcattatatccctctttatgctcttgaaggacatcctcccccattctaatggcttcatcataaagacccttagaacgatcagtcccattaaagtatttatatgtttgccttacacgtacttgatcagctacatctttacttagttgatcaaaaactactttttcgttcattagatttccaccgcccgactttattcgtctactattcttagtatagcagttattgatcgcgaacgaagctaaaatgtcaattttttagaagattatcgaaaaaggaggctgagaaaaaactttgttttttcaacagcctctttaatctatacgaacattatttaagatatcgtggaactagcttcgcgtcgtaaccacaaggctcaagtctaagtccgaacgataatcagcccgtgccgtgctaatcaccgttctatccttagcccaccgccttgtcgagaaggttaattcccactcactccttattaccaactagccttacgaacaccagggatttgacccttgtgtgctagttcacggaacttaatccgtgacattccaaacttacgcatgtaagcatgtggtcggccatcgtaacgatcacggttgtgaagacgaaccgcactagagttacgaggaagtttggataaaccgatgtagtcgcccttcgcctttaattctttgcgcttttcagcgtatttctttactaaagcttcttggtgatgtaatttagcaatctttgacttttttgccattaagtagttctccttttatattaaaaactttatctactatacaattactatttaaaattaaaacatctgcgaactcttttcattttaatattatcgctgatacttacaaaaaatacaaggattttgcattactttttgacttttcttaaccatttaattttttcgcgtatttacggtattcgtcagcataattgtattgattattatattcagttaaaagttcatcatcatgggtataagcccgtcccgtcaccatcatcttcttgtaaaggtcacggtatggcaaatcactcttatcggcaatttgtttttcctgatcgcgactatatccaatatgacggaagctagtttcagctaaaccaatatcgtctacttccaaaattagatagtgggctcgcaaatcacgctggagaggttgccagtggttgaatggctcgccgactgctccgggatttaaaaccatgcgttcatcactcccataccgtaaaaggtcatggtgaacatgggcataaatggcaatatcaactggttcgccagcgacattaaacagcttatcaaaattttcactaacttgcgtgggaaaaaggtcttgacccatattaagccacggcaaattatgagagatgccaaaattaaggagacccacgcgtttcgtaacgtgcatcggccaacttgcaatttcatcaatcattccgtcaggggcatgttccgcaacatactgggctaaccgtgcaaagtaaatgtgggaaggacgctccatatccatcatcccgcgagcgccacgaacaactaggtcatcccagtttcctcgtacaattactgttggcttcatttcttgcaaaatctcccaaattggttttacacttgggcctggcatcagtaaatcaccaataaaccaatattcatcaacatgttgcgctatgctatcgcgatacattgcctgcaacgctgttagatttccgtgcgtatctgaaaagactgcgatcctctttttcacagatgatttcccctttcttaccttcattaatatattagcaaattttcgaaaaggaatgctaaattaatttgtattttcagaatgatttcccacattacaaattattttgttacaatatacttttatgaacaaatcattttaggagatgataatcaaaatggattcggaagtcgcaagaggaaaatttcctcacggttggcaccgaactttttacaccctctggctcggcgcgttcatcaccgggatgggctactcgatgacgatgccgtttatctcactttttattgcagaattaggaaattttacgcgttttcagctcaacatttactccggactagcatttggggtgaccttcattagtcaagccattgtttcaccgttctggggcagtctggctgatcgcaaaggacgaaaactgatgtgtatgcgtgcatcgggagtaatggcttgtacaatctgtgcaattggatttgctcaaagtgtctggatgattattggcatgcggttccttcaaggagtcttttccggctacattaataacgctactgctttaatggctggcgaaacaccgcataataaatcaggctgggtaatgtcagcgatgactactgcgggggtggccggcaatttggttggtcctttgcttggtggtttcctatcagaattgtttgggtaccgaatcccatttttcatcaccggagcactaatgttttgtgtctttctcagtacgtggttattgacggtagaacattttaccccgattaaaaaagaagcgatgaagccaatgaaagagataattcataatctggataatccaccattgatcttcgttatgttcttaaccacaatgattgttacttcttctaccatgtcaattgacccaattatcagtttgtatgttcggcaattgatgggcggccacggcaatattgcctttgtcgctgggattgttgctgctactccaggactaggaacattgcttgccgcttcaaaggttggtcacacgatggaccggattggaccagaaaaagtattacagattgggattctcacggcctttatcctctttatccccatgaccattactaagtctccatgggccttggcattttggcgcttcttgcttgggttagcaaacgcggcgttaatgcctgctacccaaacggtcttaacccttgacgtcccaaccgaagcattcggccggatctttagttacaatcaatctttccaggctgcgggtgcggtgttagggtcaattcttgggtcattcatttcgggaatttctagttatgaaatggtctttgtcattactggtttgactctcctgcttaactttatcttggtgatgttggttagaccaaagaagcaacttacagaataacttaaagaaaagagaaaatcatggttcaaacaaataaattattaaatgaacacgaagtaaataacttattttcccgggttgccccccgctatgacttattaaacaatgtgattagtctaggaacgcagaaaatatggcgacacgaactttttaaccagcttcaaattaagcctaccgataacgccttagatgtttgctgtggaacgggagacctcacaattgccctggctaagcggatctctgctggacgagtaaccgggcttgattttaataaagaaatgttggaaatcgctaaagaaaagacaaagatgattggcaacctcttcttggtacaaggggatgccatggcgttgccgtttgatgacaatagctttgatatcgtcaccatcggctttggcttacgaaatgttccagatgcagataaggcgctcagcgagatttaccgggtcctcaagccaggtgggcaattcgttagcttggaaatgtcgcagccgaccaatccaattattaaagtcggctggaaagcttactttacggcctttccattgatggcttcattagctggtggatattaccgcgattatcaatatttaaagaaaaccagccaacaatttgtctccgcccaccaactggcgcggatgatgaaggcagttggatttaaggaagtccattaccaaccattgaactttggcgcagctgcattacattttggcgataaatagaaagggagcgaggtagaagtcactcatgactatctcgctccttttcaaattattaaagaataatattgacaacattaaaaactgattataatatactggcaagcaatttaataaccgcaatgaaaagatgagtaattgatggtcgccttctccagagaactgcggatgatgggaagcagcgttggctaagttagtgaagatggtcttggagcgataaaagttgtgagctatttgtaagcagcttacgggttggtgtacgatataacacctgagtattccctttgagtacttgtagagagtttggctgtgaggtcaagctaaaatagggtggtaacacgctatcaatgtctaatcattacgcgtccctagaactaacaagttagttctaggggctttttttatttcacgaaaggagtcactattatgactgaatttactaagagaaccacatcaccatttcgctttgatattgttggcagtttcttacgcccaaaagaattaaaggaagctcgcgctaaatatcaggtgggacaaattacgaaagcagaattaaccgcaattgaggataaaactatcattgacttaattaagaaagaagaagcagccggtttacacgccgttactgatggtgaattccgtcgtagctggtggcacctcgactttatttggggattggagggaattgaacagtcaacttctaatgcaggatatgagtttcatgatgaaacaacaagagctgaaacggcaaagttagtcggtaaagtaagcggaaataatcatccttttgttgagcactttaaatttacacgtgaccatgttagtactggcacgcaagttaaacaaacaatcccttcgcctgctcaagccttctttgaatttttgtgcccagaaaacattgctagcgtcattgaactactcccacttagctaaacctacggtttaatgcttgaagtgggagattctggaaacatcgcatacttaccctaccgattctgaacgaaccttcaagcagaggttacgactattaaccaaggctcgtcccgagcctaactttatctatcggatagctaatcctttttgcaagatgacttgtgcagcgttaatatcacgatctaaatgtttaccacagtttggacaatcccactcacgtaccgctaaccattccgatttattcaatcctaaccgatgattattcttcccacaattagcacaaatttggctagtatatgacggattgacctgaataagctttttaccgtaccagtcacacttatattgcaacatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgtcgatacttcgccaccataatacgagctttctgataattcttaaaatcatctaattgccgtggaactaacactttattatgatgatcccaggcgatttcctgctgggcctttaagaaccgacgactacgcaatttctcccaacgatacaactttttatggtatttgtcttcaaaatgattgattggttccttgcatccatctgaaagattaagtaatgacttaagtcctaaatcgccaccaatatatttacttgttttaggaagagtttggttttcgctttccactaaaacagtaatgtaatattgaccagcaacgttcagacgaacagtgacattcttaattttacccattggcaatcgaccagctctaaaatagacgataccaagttttggtaactttatatgatggcaatctaaaactttaatattgccattaacgtactttgaattgtagctctgagaatattttctggatttaaatcgagggaacttattttgacctttaaaaaagcgttgaaaagcatcggctaaattgcgattagcactttgcaaagcagttgattctgcttgtttcaaccaaggatactcaaccttaagttgtttcaacagattattcatcccaaaggcattcaaaaatttagcttccggattattcttgcgccgtttaatttgcatattaagcatttgattccatacaaaacgaacacaaccgaaggtttgccagagctgatttcgttgtgctgaatttggatagatgcgcattttaacggcttttaaaaccattattttctcccttgactttcaatatatcgttttaaaacttctaaaggcgctccaccagtgctaattaagcaatagctttgtgtccaaaaagctgatttccaaagatactgcttgatttctggaaattgttttttaaccattctggagctagacgatttgtaagcatttaaaaatttagccatttccgtatgaggcgttgctctaaacaaaacatgtacgtggtcctgatcatgattccattcttgcaaattaatgccgtatgcttgtcccacaactacaaaacgatgtttaagatattcagatatttcatcgttaattacttttcgacgatacttaaccaccattaccaaatggtaattaagtaagtatactgaatgctgatttctatctaattctattgttatcaccacattttatagatatatatactaaatatatcatagaacaaagaaaaagcactaacgtgctttaagagagcgattcatcccctacttatagaagtgggggtattctcgcaaatttatggataaatgagacctttgaacaaatctcctttaactctgctttcttttaaattagcccaatcgcaaacgttacgacttgaaccagtgagccaattaataatattttaactgcacatggaaatgtctctttcttaacttgcttagcaaataacattcttgtttgcttaaccacaaatgggataatcaataaggttaacaagactgtccatggtacgaaatgaagaaccgcggcgaaaataatagctaaaaatgctaaaacgttcttaatagcaaatgcatatagaccatttttctgcccaataaagtgaataactgtatgacggcgattgtcttcatcttcacccgcatcacaaatattatttgctaataataggttggaaatccacaattcatccggtaaagcaacgagaaagacgaccccgatatttgcccaggaccatgtaaattgctggccaacattaataaagacagaaataagggtaatcatgaaccccattgtaaatcccgaggcaaattcaccaactggcaaccctgacaaaggaaatggaccagaagagtaaagaatgccgatcgcaaaacaaaagattcccatccatagtaacggaaggccaacacgagtaactagatagattccgattaagccggctactatactaaaggcaagcaagagaccgagaactaaacgcggtgaaatattttcccgcccaataatatttgtatttttcttataatcaacggtatcaatggcatggttataatcattataattatccatcatatcaaccgccatattgaataatagcattgcaatgaaaaacagaactgaatttagtaggtttagggaatgataataatagacactaaggcaaaccccgaggagcatcggtaagatactagcagttttggccttaatttctactaattccaaaaaaacatttaacgacatttagtaaattttcctttcataattccttagttgttcggtacaatatagatggtacaccataacaaaggaattatcgattaatgaaacaacattttttccatacctatccggcgattaataacgctctaggtaaagtaaatcaaacaattaatgaccggattacaattaaaaatacccaactacacgatgccctacaacaaatggcctcaaatggtggtaaataccttcgcccagcattcttccttttatttgcaaatatcaatcatcaaactgccgatgagcaagaaagactaattaaaattgcctcttcactggaggttttacacatggccactttgatccatgacgatattattgatgattcacctaagcgtcgcggagccgtcagtgtccaagccgcttttggtaaagatacggctgtctatacgggagacttcctttttactatcttctttgacctcctcgtagaaacgatgaccggatccccctatctgacacgaaatgcccggacgatgcgcaaaattcttaccggagaactaggacagatggataatcgctttgatcttgaccaatcattactcgattattatcgcaatgtaaacggcaaaacggctgctatttttagtcttgccgctgaagaaggagcctattttggtcataatgatcgtcggactatcaacttagccaaacgaattgggcaaaatatcgggatcagcttccagatactggatgacatccttgattattcaggggatgaacgccttaacaaacctgttttggaggatttagcaactggtgtttactcccttccccttcttttaaccttgcaaaatcaccggcatgaattagaaccgttacttgcaaaaaaacgccaaatgacgattgaagatatggaaaaagtccaaaagattgttgtcactcatggcggtgttaaaaaggcgcaagaaattgctactaagtttacacaaaaagcgcaaaccgaaattgatcaattagcagataagcatacccgaaagatgttgaagttggtagcaaagaagttattgacgagagtaaattaaaaaagataagactaaggaaattccatttctcagtcttatcttttttattcttgaaccaagatctcaacatcccacgaatcaagcatcgtttcaggaaaatcgccagtcaaaaggtctcgatatcccttttgaaattctactggtaatggttgtttaccctttcccatattaaggacaaagtaaatatcctgacctgctgaattttggcgttttgttatctccaattctgtttgctctttgactaacgcggaaaggtgcacatcatcaacaatatgcataatgatcttacggagactagcatggtcaaggcgactaccaacataccatgctttcccttttgaataggtattctcggttaccgcgggagtccctgcataaaattcactagcgtatttagccaggacatgggctccattaaggcaaattaaatctgctattaaatgtccagttagttcattcccggtcgtcattgctaatttaacatctttatcaggaaggattgcatcgctttcttcaacccacagccccattacatcttttaatggtccaggataaccgcccggatagatattatcggattcatttaccattccggacataaaactagtaataaaattaccaccgtttgcaacataatctgtaatcttcttgcctaagccatccttaaccatgtaaaggaccggagcaactacgaggtcatattggctaaaatcatcatcaacggaaattacatcaatcggaatattcagctcataaaattgccggtaataattaagaataattggtacatattttagggcctgggtaataccatcgacatactcaaaagaccagaaattactccagtcaaagataagggccacccgcgctttagtctgagaatctttaataaccgggcccacttttcttaaatcatgacctaatttcgccacttctttaaatgcccgggtatcagtccggttggcgtgactaatcacagcaccatgaaacttttctgatccgcccagtgcctgcttcaactggaaaaattgaacagtatccgcaccatgcgcaactgcctgtaattcagtggccgccatctgtcccggacgttttaatgggctatatggttgccagttaacttgtgatggcgtggattccatcagcataaacggctggtgctttaaagaacgcatcaaatcatataagaatgctggctgataaaccggtgcatcataagacggataactatcatatgatataatgtcttgcgcactagcccactgctgataatcaatcattttattgggcagactatgaaagttagtagtgactaaggtcgttggatcatacttttcaatgatttgcttttccatcttaaataaatcaagcatttgggtcgattgaaaacgtaaataatcaattgaaagtccggcgacaattgtttccgatccttctgggccccatgcatcaccaagttcattaggcacaacaatctcattccagtcataaattgtatgactccacacattcatattccatgcatgattaagattatttaaggtttgatagcgcgccttcaaccattgctgaaattctgtttggcattcttcacaataacaattgccaccatattcattattaacatgccaagcaacaatatgcggattatcgccatatcttttagcgagctgttcaacaagatttttcgctaagcgccgataatttttactgcttgggcaaaagttatgccgggcaccaaatacatggcggcgtccttggtagtcgacccgcgcaacatctgggtatttcttgaacatccaagcgggcatcgcggcggttgaagtggcaagaacgatatcaaaatcagcagccgttaattctttgataattttatcaagcttggtaaaatcgtattttccttcctgcggttcaagcaaaccccatgaaaaaacattgatcgtggcggtatttatatctgcccgcttaaatactttaatatcttcagcccacgtttcttctggccactgttcgggattatagtcgccaccatataagaaacgaggcaattctttcttcatcattatctcaccttatttaaattctactgttactaccttatcaccatgcttaataagcttaccgggagtaaaaccagccgttgcttcaatattatgtggttgcgcaaagaaagtaattacccagtcttcgtaccctctttgtctaatcaattcacgatcaaagtcaaagagtagctgcccctttttaacgatttgaccgtcattataatgggcattgaagccttcaccacgcatgtttacggtcccgacaccaatatgaacaatcatttctaatcccctgtcagaagtaataccaaacgcatgacgggtgccaaacgtaaagttaatcttcccgtcaaatggggcgtacaatttatcgctagttggcctaatcacaaagccctttccggggaacggttgaccatcacgatcgacgacttctttcattgcaactaattcgccatctgttggggcataaatcgtttcttctttaagaccagtcgatgatgtcgacgcttcacttgtcagttctccttgtgctaatttatcctttaattcttcaactacttccgcatgaacttcttcactcaatttcaccttaaaaagaaagacaaaaattgacaaaatagctaataccagcgggatatagaatgccatactatcgaaagtccgaatatcatgacctgtcatgtcagcagcagtcgcgctccccgtcattccggctgcgattgcgatataaccgacaaggccatttgagatcgcccctgttaatttatcaatcattggtcgcacagcaagaacaaccgcttcatttcgttgaccagaatttaattggccatattcaattgcatccgttaatgttaaaactgttaccaattgggcaaaattaatgttaaacaagaccaatccaaagtccatcattaaaacattagagcgggcaaaaataaagattaaatatgctaaactcatgcagacttggccaccaatgaatagccattttcgtggaataaatttattcaaaataggataaagaggactagtacagaaaccaataatcgtagcgatgaccccaacaatccagaattcaccaggtttaccaataacaaacttgtaaaggtagaaaaggacaccattagttacaacataggcacatgaataaagtaaatatgccaaacttggccataagatttggtcattgtgaaaaattgctgaaaaaacttcccgaatagttgtcttatcctgggcagacttacggatcacattgtaattttctttcgtcccaacacaaacaaccaaggcacagataacagctaatgccgaaataatggcagcaaaggcaaaccaaccagcaggcccctgccgatgatgaccagtagctaaataagtaaaggtcgttacaatcggtaccacgataatcgttaatccattccaaccaagtgttcccgcaaaggcaccgagagcggtataaacgccccgctcttcagaatcttcacttaaagcgggcaccattccccaatacgaaacatcagaaaattagtagaaaatatcaaacgtaatgaaaataataacaaataaaatggcaaaaagaacccaattatattttgctaagccaaagattccggtaaagaggattaatagcagaatcgcactaacgatatttcccattaaaatccacggcttaaattttccccaccgacttttagtattatcaacaatatttcctaacagcggatcaattaataattccaaaatccggacagaaacaatcaaaccagtaatcaacccaattagtttattagcaaccgttttgtttagtcccgcgaacattccgcttgttacaaagataataaagtaagtactcattaccccataaaatgcagagtgtcctaagttaccaaagcaaaacgaagcacgagaaataagctgcttccccgtgagcttatggctatgtgtcatatttataacctccaaactacagctttctgtaatcgcttacaaatatattataattctttagctgatttgagtaaacatttatttaaaaagtaaattcattactagcgaagatataaaaaagtagctaatccgtgaatcgctgatacgaatactgattagctacttattttctttgggaaagcttttacgaaaaacaatattggtatttactgtcagatgaacgtgcggacgctgggatgggttattaaatcttggagaaggttaatcgccatccgactaagcgtttcttggttgatattgtatgacgttaacggcggtgaaacatacttagcaactttactgttattgatgctaatcacgacagtatcacgtggcacaattacccctgcttcattaaaagcctggagaacaccaacacttaacgtatcagaggcaataataaaggcttctggtaaattaccaccgctttgttcaagaacccgtttaccaagttgataaccgtttttaacattaaatggtccgtccacatataatggcgcttcttttatcccttgcatccctgtaaattcacgaaaggcgatttcacgggcatcagcttgttggacgttattgagattaagtccttttccaccaatgaaaccgattcgttcataacctgctttggcgaggcgatggagagcatcctgaatcgttaattcaaggttaggttgaacggaatcaaataattgtggcatcggatttatatcaacaaaaactccatgtggtaagtattgatgaagttcgataagctggtcctgcgttacccggtccgcacccacgccaataaatccttggaacgaatcagccgccgcaattaaatctttgatattactaaagatttcaacttgcgctcccgcctcatcgacttctttaataattgcattgcgcaaaaacgcaaaatattcatcttgcagttgttctttaccgcttacccgatacaataatgcgaggttaggacggattggttgctgctgagagtttttcttgtggttgttccaatagccaagctcgttagccaccgtcatgatcttattgcgggtgcttggactgatcgataaattttggtcattattcaaaaggcgcgataccgttgctggtgaatatcctgatttttccgcaatttctttaattgtcgccatcattttcacctcttttagtaatgggtttagtaaatattatacactagtttgaagatagagatgataattcaatctactaattttattcttaattattttcccttgtttatttcccttaaaatgatcataattaagaggacgagatttattgatgaggagatttacattatgaataaagtttctaagggcccttgtactcgctcttgccggtattactgttggaactagtactggacttagcactaccctttttcaatcaaccagtgttgcctatgctgctgagatgacaaaggaaaaaatgatttagctaatcgttatattgctgattatttaggcaactgtcaacagtatgagcagaatgataaaacattcaaaggcttttcttcaatcaaggatattacctattcgcgagacaataagattaaaattgacgttaatgatgacatttatcaattgcctaaagcacgtcgttcacttttgattcaagatttgcaaaacggtgtgtacggcacattagcagacaacgaccttaagaagttatctgaaaaagacattcaaaagggctgtccaactactgtttacttgaatggaaaagtaattggccacactgccaagaatgataaccaccacattatttgggataaataacaaaataagagatttgggacaaagctggtgttccaaatctcttattttcatttaaagatcaatttctagaataattggcgtatgatcgcggcgttctccactatcgatcattcccgcttctgtaatcttatcagcaagccggtcactgactaaccagtaatcaatccgccagccagagttattttgtttgctggtaattacccgttgtgcccaccaagaataaactcccttttcgtcggggtggaggtgacggaaactatcagtaaagccagcagctaatagttttgagaaatgcgtacgttcttcatcagtaaatccagctgaatgatggttggttgctggatgagctaaatcaatctcttcatgagccacattaaaatcaccactagcaattaccggtttttgctggtcaagttcatgcaggtagtctcggtaacaatcatcccacgtttgccgctcatctaaccgtttaagcccattgccggaatttggtgtatacacttccgtaacatagaagtccggaaattcaagggtaatgattcttccttcatcatccattggttctggcgcattaattttaggataagttactttcggctcatattgggctaaataaaggtacatggtcccagcataccctttccgtgctggctcaacggaacttcgccatgccacttcataattggggaataattcttgtaaaaccgttaaatgcttcttagttggcccattctttgacaacttggtctcttgaatggcgatgacatctggcttcatcgctgcaatcttttttaatacttcccgcgtttcccctgcccgtacggaagttccagttagtgctgcattaattgaatcaatgttccacgaaataaatttcacagctatttctcctttttatttcttgatttaaggtcgctttctttgatgaataccccatcggcagttgtcttacccgttcgctttgcaatttcttgataagctgcggtaagtgcttgttgatggtcaacacccactaatttacaaaagattagcaatgcaatctgtaagtccccgatgctatcgataagcttagtccgattttccttattatacgcactcgaaagttcgccgagctcttcagccatcttcataaattcgacacgtggatccgcgtggtcaatcccacgttcatgcgcccacttatcaatttttgaaatagctcctcgtaattcatcaaatgtcacctcatcaagtgataattctagtcttaactataaaataaaagaactagctacgcaataagaaaatttcacgtaagccttcttaacagtatttatcaatcaccgctgttataattattgctaagggaaggaagtgaaagaaatggacttaaccaattatcgaatcgatcctgctaagtttgctttagcttgcgtgcaaagttcacctgatcttaccactgaagacaaattaagggtttacaaggaagtatatgaagaagcgcttactttctatcaccaaattcaaacagccgttattaataaaggtcgttcaaaggaagatcgcagccttaaggaaatgggagactttttcgatttaaagaactaaaccaatcaccgaaatcactacctatcaaaatctcccgtactacattgatggtgaactactcggccataaatgaccgagcttctgggaacacgaagtagtatttaggatattacacaagtattcttgctacctaacttacagaactccgttcttttaccaaggctagttcctagccaacggcttttaatcctttttgcaagatgttaactgccgcattaacatctcggtcgtggtgaacgccacactttggacaagtccattcgcgaacttcaagtggcttcttgccactgttaaagccacaatgcgaacagatttgactggtatagtttggtttcaccaagactagttgtttgccataccaagcacacttgtattccagcatcgtccggaactgataccaactagcgttagcgatcgacttcgctaagtggtgattcttttggagattcttggctttcaaatcctcaataacaatcacgtcgtactgcttaactagagccgtcgttagcttgtggaggtaatccttgcgcttgttggcaattcgttgttgataatgggctttaacaagtcgggcgcgttgccagttctgataatcattgagtgctaacttggtatcttggtggttgtgattccattggcgaacggcaacggttgcccggtggcgccgcttgctgaatttactttgccacttcgttacttgatgttctaacaatttagcgttgaaggtaccgtacttgacaccatcagaactaatcgcaaggtcggccaggcctacgtcaagcccgaccatttgccccgttttcggtaaccgttcaacggttgtttcaacttgcagggagaggtagtaacgacccgtcgggtcataactgaccgtataacgcttaattttggcctcaccaataagagtcgttttactcgtgcgtatacttccgagttttggtaattgtaaccgccgcttggcaagtaccttgcacgttgatcggccagtgtaggcctgataggccacatggcggctcttaaagcggggatagccaccttggtgcttaaacaatcgtttaaaggcctcggtaagattatggttcaccactaggaaactggtggaatcactttccttgagaaagggatattcacgcttgagctgtttcaagaggtagttcataccatactcattgacgaagtggctactgggattgttttggtaacgctccttagccatactgagcatttggttccaaacgaagcggtcattaccaaacatttgccataactgatcccgttgggattggttagggtacaagcgaagtttgatccctttaatgaccttgttcattctagttccacctcctttttccgttgatcatcaatgtacttggcaacggcttgttcattaacggccccaatactttcaacatagtaactgggcgaccacaagtgacggccctcctttttccaatagcttcgctgtaattccggacattcccgaaatagctgataggcagtaccgcctttcagccaacgaacaatattcgtcaccgataatttgggtggtgcactcactaacaagtgcacatggtcgtccttcccaatttccatgtgggcaatttcaaagccatatttagcggcgatctcatggataatccgtttgaaggcgatctcgacccgaccggtaaggactttgtttcggtatttggttccccaaataatgtggtaattaaggttgtagaccgatgttcggccatatgtaagtctgtttgtatctttcataccaacgattataccataattcacgtttcccatatacgcccgtcgggcgtaaaaaaggggggcaattcatcacgtccttaaaagaacgtgtttccttgccccttttcaaaaatgtttttttaaaattaatttactttgactagggactgtgacataagttaagttactttcataaaaagcaaatacgcagtacaacgatggcctctaacgtccggcaaaaccgatcgttagaggcctattgttgcttgcgggggctccagaggctagcttcgcgtcgaaaaacgaagtcacaagtgacttttgtctcgctcccctttcctacgattagtcaagaaaaatatttagaaaagaagagtatactaaaccaaccctaaatttcaagaataagttagccactggactcaaataaataatactgaccaattgattattggttgatggagctgtgatatctcttggtagaaggccttacgatagatatccattgacgaatgtccattaaacatagctcgtggatagtgattcatccaatcattagtcgctatgatctgagcactactatagttatttatagcttcacctttggtaatctccttgcggagaaaccggttattgatctcattggatccacgttcccaaggggaatacggatcagcatagaaaacatgatcgtgaacttgtgttaactcactaaattctgaaccgttgtcagaggttattgtcttaaagatgcgatagtaagcatctgtgcccattttctggcgcaaatttatgaagaactgatttactgcatgcgcagttttaccagcaattttactcgtgatattaactcgtgaaaggcgatcagtcattactagtacaacactgtcattaccgtttttctgtccctgaactgtatctagttcccaatggccaatttcggaccgttggtccgcagtttgaggtcgttgagcaatattaggccctaagcaccttttagcttgcggatgagttcgatgatgcttacgtttaggcttttcaaagaggtctaaattggacgtacgaagcacaccctcattaatccattgatataaagttacaaccgactttgggatcagggtgccatcattcattaaatctcgagccttataaataaccgcttgtgggagtaatggtggtcgtcaaactcaccaagcattagctgatcagctaatcgtaaaaattgctttgaagaataatataagcgacgacgaccagaatggcggtgatgttcaagatatgtggcctgaccagcttcataactatagatgtagtaagaatattcgtaaatcttaccattagatttttgacgacgaagttggcggaccgtaccacggttgagctcgttattaattgtttgatgattaactcctaattggcgaccaattgcgcgattggaaagtccttgcgactttaaagtcgcaatcatcacacgttcttctttagtaagatgagcattctttttatgagtagtcaataaactagtagacatggtatcatttaagtgcgtcatttgacggacatcctttcatataggtttggttcacttaatatgatacctgatgtcacgccgaatggcgttttttatttaccaccaactgggtggctaacttcattctataatccaccatactaaaccaactcggttcttcttcaaaaatcgagaattagtggtatattaaaattgtgaggtgattatgccttcacagggaccattgagtccgtataccgatagtagtatttttcatggtgcttaatcatggataagagacatttcagagttttattcatacaagctaccatggcgaccttgttcagttttggatgaggtcgtttttcttttaaacgatagtaatagtcaacgatatgattagaattagcgtgttgttggcggatcatattacctacagtaaaatataagagcttacgggcaatcgggtttccacgcttattaatgtgatcttgacctaaataggttccagattggtaacgacgaatatcaattccgacaaaggcattaagctgattggcattgtcaaagcgactaatgtcgcccaattctcccattaactgagccgcagtttgtttcccaattcccggaaaagagcagtataggatatactctggtaagcgctgggcaatagattccatccgcttgataacctcttcccttttacgggttaaggcaattaattggcgagcatagtagcgaacttcatcaacctgaatggcatcaccagaaacgccggatatgatttttgggcgagatcgattaatcgatcggcatacttataagctttcatcttagatattcgtttatctgtagatgccattagaatattctttaatttaactctcgaataaggcctaactagtgctgaatgaggaaaaagctccacgatattcaacgctaatttagatgttctatttacaaataattgcttaagttctggaaaaacttgttcaagtgcagtatgaagatgatttagacgatagttccaatcagcattgagctgattatagaaccgactaagctcatgtaactgaagatagtcttttttccaaggaactgttaatcgaaaagcattttcctggacagtgagcgcaatccgatgagcgtctttctgatcggtcttaactcgtcgtagactctcggactttaaatgaagttctagtggattaagacggcaaaagcggagaccattggtctcacagaaatgttcaattactcgcgaataaattccagtcgcttcaaagtagataattggcttctgagctttcttaatcatatctcgtagagcattaaaccccgctttcgtgtgtactaaagaaaactcctttaaacagtgtttccctcgataccagacacagtagcttttccccattgaaacatccaaggcaaatatatcagccataaaaagacttcctttctataaatagagctagatataaccgctatcctagatttgtacttcatttcctaaatactcgaactcgtagtttcacaacctaaaagcaaaatatcaaatcaaagatagcggagatcattttataatacggactcgaagtccctgggagcatgatcgatcttagctctatcttcagaataacaaaagagtccaggacaataattatttttgtcctgaactaatcttaggttgtttaatttaaaacaaaaaaagaacccttgatacataagggttctgcactactagttgtcgcgacgacgttcagcgatacgagtagccttaccagtacgttcacggatttgctaagctgtttcatctgctattcatgaagtattcacagactattcaattagttaatttaaataggtagaaactcattaactagtcatgaagtattcataaactactcacaaaaaaactaccaactacctaccagataattaacggcatctcttaatgaggtgtcgttttatccataaatttgcgagaataccccaacttcgacaagtgggggatgaatcgccctctgatatgatataattcaactaattaaactggttctaatgcatcgaaaataaagctgttaacattgcttcaccatgaggacactgagtaatttcgtatagagtaacttcgagtttgtgctgagacaacgccacgagttgcaatcaggctaaaaatagctggcgaaaaccaagccagtatgtattttgaacacgtacttaggcggtagtccgatgaaactactaggcccgggacgggccttggtcaatagtcgtaacctctgctcgaaagttcacttagaaccggtagagtaagtatgcgatgttcccagaatctcccacttcaagcattaaaccgtaggtttagctaagtgggagtagttcaatttcattataactccgatataattttcgcgctaattctatattaaatttaaaacaaaaaaggatgccgattaaggcaccctgtttaccggtacggattaagtaacgaactgaatccattttgcatgccggtacttctcatctgatgtgtatattatagcataaataaattatggtacaatactattgcgtgtcgggagtaacgacccaaacttacgcgcaaaaggggtgaattcccctatgaagtttgtacttctcattctgatcgtgccgaacgggctcgttaagcaactactacattctgtaagggttgcaatcaaaaaggctctcaaacacctaattgaggaactacttggttaaactccatttaattccaaaaggaggtgggcgagatgctatttcagcggtggtaattcgtttactatcgctgtttttattatatatcaaaaaagccctagcagtaattgcatttaaaagcttgcaactactactaggatttttttctacttatttaaatgtgccaaatggttggttattatttgcatcacggcaaacaagataaccatattgattatttggacgtggttgacgtaaccacacgtaaccatcgtgacgagaccatgcatcatacttaatctcactattagctggcaatgtagcaattaaggcactatttgtcttagcgccccagcgtaagttaattgctgtaccagtaataaaagtacctttctcagcaaaccaacgatcacccatatcatcaacccagtgattggatggaagctcagttgtaatagctggcgtttcctgctcaattggtttatttggttctggcttcggtgcttcacttggattaaagagtttaatagcattgtcagttaatgtaatagaaccatcaacattgtatccaagcagattatctgtgtgttgccacatatcaacataatttgctgatgggaagtaattgaagtcaggattctttccggctgctttcccattagctaatggatatgccgctaaccagaacatatccatatttggatgaattgcttctaaattaaagttaggcagtaagtacttgtaagtatagaacccagtgtggaaaccagcgttccgaacagtattaaggaatgcaatcactgatgatgttggcatgttagagatttcagcatctaaaatcattaacgtaccaggttgtacattagcttgtgcctttgagttagcaataaagtagtttgcttcggccaccgcttgcgcatcattatggaaacgaccaaagtgatagaaagcaaaccctttaattccaccgccagcacttcgatcaatcaaagaacgaatgtatgggttaacataattaatactttcagttgtcttgataatcgcataatcagcgccaatagccttataatcatcaactgttaaatgactttgaaaacttgcaaggtcaattactgttttacgttctgtcatattatttttcctccttatttcctttataatcaccggttatcttatgaaaatcagctggattgtagtcatcttgagccttagcgacattaagtactttggctaacgagtcaatgattggtgacaaccacggaacttgtatgtccatctgatttaaattttcgacaattgataccaagtattgatagcagaatgtcaataccattacttgtgcaacataatcaaaaccgattgaaattagatatggataaaaagcaagcactccaatcataaggataaaattctttgccaatccatatgtccctttggtcgaatttgttcgagtagctgtgtgattgctacgtaagcctttggcaatccccgatccaatatcaaataacacaagcaaagtaaatccaactattaatggatcgtcaatttgcttggctgcttgatgtaatgctacttcatgataaggtagtgccattaataataagtgcattaaatttcgttcccattccctttctaaatgccgcccataagaaaagccctgaattcggtattctttaaacactaaattctagggcttatttatgtattgtttatttccgaaaggcgacaagtgcctttaactattcatttgttttatctgctgtcttatcagcagaattggcgatttcatcctgtgcattatataccaagttttgaaaatcttgagtatcttttcgtactaccttcttgttagcatcgtacaactctttattggtgatgaaggtattaaaagtatcattaccagcatcgtcatcaaatacatttgcagtaaagttagcgattacttgaccatttactgtggactttcctgttaaggtgattgattttgttgattctaacataattacttatctcctttttcatcgttttgcttcttaagttcttctaattgtgatttcaattgactattttcttgttccaattgagtagcttttgcttcccatgaggcagctgtgtaattagcaaccgccaatttttggttaagactttgagctactaagttcatatcaatattgttcattattaaaaactcctttaactattttcattcgatcattttcgtaccccttacgcttagctttgatttcccaagcaaaatgaatattagggttgctagatttaactgtaaaattatttgctgaacgtgaagaaacccacacgtttccattgccatatggcgttagaaacacttggtatggcaccaatgtattaactgtttctaagaaataaggatcaatcatgacagtaactacaccattactattagtttgtgtttctccaatatcgccaaaataatattcggcggtttcataggcgttaatggctgccatccctcgcgatgttggtacaacggcattttttgaaccagtaacagtaaaattcccactaacattaaaatcactattaaccccaggaaataatccatttaacgataagatacttttaccattagctgtaatattaattgctccatcactattaatagaaaaataatttttcccatttaagcttcctacattaacaaattcatcttgtaatgttattccccagaaaagccactcgatggtccttgaaagaaatattgtgagaaagtaccttttaaaactgtttgaccattttgatatgttccatccaacactaaattaggtattgtttttaagttattattttgaattggttcaccagcataaagaaaaagttgcttttttgcagcgatatttataaagccatcgcttttaccggcaataccagcaccaataatttcattcccatttaaataagataatgtttgatcgttccagccatgagttctaagtagaaatccatccttaccttctatatctaaacctgatgttccaaaaaatacaatgttatcactcttagtaatacttccataatctggatctaaaacagcatctgaaagagattggcttttgtgaagatacaagcctccatcaaaaaggtaagctccacttgaattaccataagcgctaatagaccctcttgaaatccaaacattattaccttgattgtcataatcatgaattccgtttttatctatccaggcattatgatcaccttgccaaacgtgaagtgctccgctatctaaataaaattcaccattgctacctcttaatgtcccggcagtaatgttatttgcattcaggttgatgacattgatccgaccggcatctagtgttccagcagtaatcttgtcagccgaaatgttagttatagccgcatcggggataaatgctttaccagaaaaaatagttgaactggcgtccatgtatatcttgtcattttgaattaaggtggtgccggctgacatgttgatttgagccataatatttccgccagttacggttcgttgccaactggtccaattatctccaattagtaatctcgtatagatttcattttcattgttgtctcgttgccaagtctgcttaatccgttttacatctggataagctaccacttgaagataagcccacgccgatgaatcaggagtattgctattaggtactgcttgaatccaatagttaccagtcgttttgtaattattagcatcaattgcagatgtaaccttttgccaggctgtttctttgcgtaaggaattcagcgacacattaaagttattagcctgctgatttatttgtgtctgcagaccacctgttttgtcagatacttcttgacgaatggccttagctgtctgactgatttgcgattgaaggtcactgtgattacttgaaactgtcgattgaaggccttgtaatgttcggttcaactcactatattctgaataactagctgatctttgccactgagtccatgaatcactaaatttagttcgtacataccttaatgttggatcactatcagcctgccaagtttgtacaattcgaccatcattaacccgctctacttttaggtagcaccaattagttccaggtacgttaatgttatctgttgactgaataaaataatttccagtattcgtgtaatcatttgcattaattgcattattgactacttgcacattggttagatgctcaagactaccaactcggccaattacactattaaggctattagctgttgatgtggttttattgtcaacgccatttattcgatcgttaagttcggtccggacagcagaagcgctttggctaatttgcgtttgaagttgcccgtagttgccactaacagttgagcgtagaccttcaagcgactgggatagttcagcaaaagctattgtgttgtcagatggagctggagaccaaggtgtggctactgagccacgttctagtttataagatccaacactaaaatttggtttaacatttggttgagtaacaaatatctttacgtcttcggtttgattcaatgtgaaaggatatgaatatctcttccagatagtcccatagttttctgtttcaatatttacgatagctgagttgtctttttgacgctgaacaattacttgcattggcccttcagcatcacccttagcattccagctaaacgtatacgttccaggctctagatgcttcttcgccatgtattgtgtccacgcataattagtgataaagaatttattgccactgctatctttttgcaaattatctgaaagagacaatctaccatcacgatcccaattatcaccactaaaatctgctgttccagttaataaattaactccaccaccactaaacattggaatggtagtttgctgaactttttgaagaaatccatcagccgtctgcagaaagcctgaattagtaagaatattacttaatccttgccagttaccatcattgcgaatggtattgattgcatcattcttagcagagttagtccggttatccgtttcggatttggtgtagtagctactaaactgttggctagttgcattaatccgtgatgatagctcagttagactgtgttcagtgtcttctggagctggcacccaatttgatggtgtactacttttttctaccattaaattacgatattcgaatgcccctggttgtggattagtccaaattgtcggtctaactattgttgtgccttcacgaaccttgtacgtaaagcttaaataaccatgtcctccagctggaatgcttttaccgccccatgccgtattatcagttccgttaaccctgtcataaaagccgacttgaatagttccagaaccattacgaacctctgcgctaattgttaaggcatcaccaactgaccacttgctaggatccagaggccagttaggtccccaagaattatctacttttgtccaattattactagtaccgggtactaagtttcttccaccaatcttcaaattattcagccgatcggtaacgctattcatatcaacacgtaagccgttagcagtagcttcaacatcaacagtttttgcataaccatttaagtcgctagccgttaactttgcagctaaagcttgattggttagattaacgaaatttgtataagtcgaattgtcaaccttacctgcaagcaagccctgcatgtgttgagcgtcaatcttgagttggttaatatcgccattggcagtgccaagagtggtttgcaatcctttgacatcaatcttagtggtattaacatcgcctgctaaattagcataattgatgtttaaccctttaaccgtgttagacacatcagcaatatctttaccttgttgttgtgcttgtttagttaaatcagcaattgaattttgagcagagatgtatttctgcaaagcatcagcaacatcattagtcactttagttaagtcaggaacaatgttgttatcgtactggccttgcagattagttaccgaatcgtttagcttttgcaagctttcatcggcaatttttttattgtcctcaatcgatttgttgagattctcaacatcggcatcagctttttgcttgttattgataatatctgctttggcttggttaagcccttgttgagcgtccgcaacctttttctttatctcgtcatcagataaatctttacgaatccatttaccggacccatcatcctgcttttcaaatatccaaagttcggttgaattaccatttttcttaaaccacacgtcattaaacttagcattagttggtggcgcagttacacttggtggaaatacaactgtcccgtctggtaatcttctaagttgtaattccttgattgtttgagtaacgctaccttgccaagagaccatttgatcagaagaagttgtctgatcagcttttgaagttgcagaaagcccaccattaaaatcaagtgtgtaactactgtttgggacaacaaaagaattcccctgtttatcttctagtcgtagccaatcccccgcttcaacagcaggattaccaaaccaattcagactgaacgggtaaaaagttatgtctttcaattgctcccaaatatcattgagccgttgtggagtcatgatattattttcgagtttaatctgagaaccagtagcatctccagcttgataattcttggtttcttctgtactctcaccatcacgagttttagtagtaatagtgacttggcattgaataccattaatcttataggcagcttcattcttcgttagtcctgcttgttcatattgactaggatctaattcatagtttggttcagaaattgtccgaatagtaaacaatccttgtcgatcaaacagagcataaccaacatacaattgagcaatccaaccaagtgctttgcggtaactttgaccagtgatcggagctgacaaatctgcttggtgcggaagacgtgctaaatcatcagtattagccttaacacctgattgagcacagatctccgcaatgacatctaatactttagctgggtacgttagtttagatacataagttccctctaagccacagaaacgatcactagcactaacagtcgtaagattattatttcggtccatcttgatttcactggagataataaaaacgcccaacggttcataaacataaccgctagatgtttttattccaatgctaggatgaacctccattcccagcttcaatccctcaataaggtgagagaattcaatctgaactgtatttgaatacgtagacccaattgcaaacgtatcaccattgtaagctcctgaatcgtacttcaaactattaatatcagttgcaccatatgttttaccatcaatcgtaactttaatatccaaagttcgctgtgaagctcgccaagcatctcgagtttcttttgattgtgttaacactaattaatcacctccttattgctcaatcagatcaaaagataaacctttccaaactggtaaagatcctacaaatgaataaacgggcgctgtccgatcaccaacataaaacgtccccgatcgaacttgcccgtctactggatctaaatactcaacattaaagaattcagccttaacagaatctaaaatctttgcgcactctgctactgttaaagcaccaaaagttaatgttatttttcttttagttgcaactcgatcacgatgtaaaagtccttgcgcatcacgggtcgcctttgcatcaatatcttgaatagcaacctgcattgtttgtggggcaggattaaccactgtcccagaaatttttagagaatacaagcatccatctcctccttaaatatttaacatatttcgaccattcttttgatttaccgcgttaattcctttgatagcatgttcgccaaatgactcatcaccaatcttaacggttaagtgtaagtcaactggttgattactgttgttagtagtattttgcatttgtaatgcttgaacgatggcatttactaggtcggtactcatttctttgaatccgccgttttgcattgttgcatcattatttgatgaagattcagcatacatagaatttgaagtaattgcattatttgagagaactgttggaagttgtaaccctccgccaaaattccgattcataaatgcaatcgcttcgttaatccgttgcatacctaattcacgattcattagtgggataaccatttcaggcttatcaccttcaccaatttcatagaagccgtgcttagaaattaagccaccatcttcataaccgtgtccgtgaccaataactgccaacattgaagaaccgtaacgatgcttagcgtaattaatagcggcaagcatgttatcgtaacccttcatgatgttgtgatgaccagggaaagcataagcattaaatgttcctggctttgtttgtaaaagaccagttgcgtttccgtcagctaaaccatcgttaccaccaatagcacgttcgttaccgcctgattcagtttgaatttggcgaacccaagcatttacataatcagcactggcaggtaagccgttcttgcgcaatgctttcttaacagcactacgccaaccttccgcacctggtccggtttgatgagttgcaccaccgaattggtcaatcaccttccgtgcccagttcatcatgccttttttctcttcgttaactgcacctttggcgagttttagtggtacctcgcctgctccccaatcataggtcacaaacttatcgacaatatagttaacgagtttttcgggatgggcaatgtcatctgtaacgttttcgagttcatccattgcagcatcaaagaatccaccaataccgctaaaaaggccgccaaagtttaaactgctaagtgctcgactaattccactaaagtcaaaattaaagctaccaatcccaccagcatatttaggaaccatgtttgctaattcgttagcggtatcagttgcagttttgaccttagtaccagccggcagataagttaagaaattacgtttagcagggaatagtccttgctcaccattagggagttcataactttctcggtaaatatcaccatcttggtcattaactaatgctaatccacctggatgattttgtgtccctgttttgtaggcgttccagttaaagtaaccccaaccaacagaaccaccgccaagcttccctaatacccagttaattccttcgcggattttatcggttgctttttgaacaggtctaaccattgcatcaacaacacgactaatagcattcctaatgctttgcaaaccactagtaataccattaccaatagtgctacctagtcctccagcccaagaacctaacgtccttgaagtgccgtctctaaaacttgaaacccaacttcctaaacgctcaccagcatttttagcagcgttataggcaccactaataccattgcctacgtgaccgcctaaattaccagcccaattatgaatgctactattggcatcattaaagaaacttctggtccattcagataatttattaccagcattaacagaacctgagcgtgaagattcagagccgttattaatatggtcacctaagcgttcagcccattggcgtacaagaccactagcagattctctaaagtctgttgtccaagatttgagtttctcaccagcatttttggccattgattgaccattttcaacactgtcgttgatgttagagccaatttgtgatgaccaactatggaccttttccttggcattaccaatgaaatctgttgtccagtccttgatcttactaccagcctgcttggcaaatttcttacccttttccacatccgtattgatatttgaaccaatcttttgcgcccaggatttaatatttttcttggcatcagcaacgaatccagtagtccaagatttaagcttattgctaccagcaattgcaagcttcttactcttttctacatctttattaaagttggttccgataccagaagcccactttttcaaggtcttcttagtgccatcaataaatccggttgtccacttaccaagatttgaactagctttttgaacatctttcttacctttagtgatattcgtattgatgtctttaccaacagacttagcccatgatgtaaagttatctaagatttcatgggacttaaagccaatcgcttcaacccagtctttaggttttttacctttgccatacttagaccaaccatcgctaaacttagcagcaccagtaccgccccatttaccgataaatgagcctatttgttgtccaatcgcagcacctaatggtccgccaaagaataagccgataccaccaccaatggcaccaccaattcctgaaccgaagctcttgaacttaatttctttgttctttgctttgatacctttgtaaatatcaattccagaagttacagcaatcatagcggttgatagaccgatacctaatttttgcccgagcttcatcggttcgccagctttaatagaagacttagccgatttaagaaagtcagttttagcgaggttagtattttgccacttcttgttaacttcgttccataaatctttaagcttaccgacaccggtcttaaaattatcaaacttaattttagctagttcttgaattttagtaattgggtgtttactaaaatcaatcaccgttcccagtaagtcatcagcatacttagcaccattcttaagcttatcaaaactaagcattgtaactattttaagggtatcggtaaagtccttaatacttgaaatagttttacctgcaactttaagactgaacagtgtcattaaagtagtagtcattactttaactgctgtttggtgatgatcgatccaatcagataagaggtttaatgcacctgttagtaatttcaatgcaccaacaatggcaaaacctgtaatctttgctaacggtttaaggaaaccattaaagaaccattcaaaaattggttcagcagctttaatcacactgtgaacaaccttcaatgcagctgctaatagattgaagaagtctggaagtagtttagtaatagtaaatccggctagaggtaacaggacattcttgtaggcccatgccaaaccgtcccaaacatctttagtaactggacgaatagcttttagcaaagtgtcaattgattgcaacagcggtgtaaagtcaagcttcttagcccaattggcagtgtaagttgccatatcaccaagagcacctaacatatcatcaaccatacctaagagcgtcttaaagattgatgttccaacatcaccatgtttccaagccttgtcgaattggtccgctaaattgccaattgtattaccaatgcctgtaacaatttcaataagatggctccagattgaaacacctaattttgagtgattccatgcttcatcaatggatccaaccatatccttaaaaattctaagtatattattaagcgcattaagccaagcttgccatagtcttgtaccgttattgccgtgttgccatgcttcatcaaaggctttagcaatatcaccaatgaatttaactaggttagtagccaaatctaagagattagcaaaaatccttttaccaagatcaccagtattccatgcttcacggaatgattcagctatgtgatggatagcaacaagaatattattcagtgaatcaaagatagtctgaataaaccttgttcctcgtccaccttcttcccatgcttcggcaaatgccctcgcaatgtcgccaataatattcagcatatctgctagcagttgaagcaagttctccattactttttgcccggtaccgttgtcccagacatgtaagaatgaattccctacatcacctaataagcgtttaatttctttccatgaatacttagcggcgtcaacaactgcttgacctttttcatcccaggcttttttcattggatcaaagatttcacctaaaacctttttaaccttattagctgcatcaatcgcattttgagaagcctctaacgggacattccagtcaaggcctggatcgccttcatcacctgctccaccatcatcaataccaggatcatcaaagactggtgtatcttgcttttgctgtggagtaaacttctctagtggttgagcttcaaaggtgccattatcttggttattcttgttattatcaagaacattaagttcatcaaagcccatcaaagaagcttggaggtcttcgtttgccttcttagtatcttcaaaagctttcttcgcttgctcattagaagctttaatccgttcgttttcagcagcaacagcagcagcaccttgacgattagcttctgcaatctgctgattagctcgttgcacagccttagcttgttcttgctgttgtttcttaactgcatcgttggctttgcttgccgccttagaagtatcgttcatcgcccgtacttgactatataagccctgagcaccacttctagcaccagacaggctcattccagttaaagcagaagtaaactgagcaagccaaccagttgcttttttaagagcattcatcaacgagttaatagctggcaaaacaaagctataaattggataaaaagcagttaacaagttgaccttaattgcgttaaagctgcttgcaaactgcttattagtcattaatgctgaacccataccttgagctaacatcatgattccttgatacaacaatgtaaatacgattaactgactagctaacatactcattgccatctttacgccttttaatcgctcacttagcattgaagcacttgtaccagccttgcgcattgaagaactaccactatcacccatgcgcctaaatgacgaggtgacgtttgaaatagtatttcgtaaccgattaagccttgaacttatatttgatgcggtgttaccttcttgagctagtgtagtgttcactcttgaagatgcgtttcgtaattcatctccacgagaactaacgtaactataagccttagctaattcattgcttcgatttataagacgtttatactctgtttcggcttctttgagtcctttattattaccagatgatctaccaagaacagcatcttgtgctttggtttccgcaatagtacgcctaatccgttcaatctttgcttccgtttgatccatctcacgttcaatacgcttgagtgaatttggaatagtattaagctcttgcgacatttcttgtgcaagggctttggcttgattctgataacgttccatcttgacttgtgcattagcaatctggtcatcaagtcgcattgctctaacctgactgccttgtttgttcatatcaaggttatctctgctagccatcaatgttgctattctacgttgcattgattgcgcctgttgcattttctcgttgatgtgggatacaagcccatcaatttcctttttagctcgggaaacttccgcttgaatttcatcatcaattcctaaatcaaccggccttttaggcatatagctctgaattcttttttcttggtagtcatcgaagcttgagttttttattcttggtctaggcttttctttaggacgtacttcttgttgagcttgtttaacaggaatatcacctacagtttcacgagctaccttagtttgttgagcaattcgttgttgcatgttagatgcttcttgtaaacgagcagtcaaactatccaggcttttttctgattcgttaacggcttctttggaactttcggcttgagccttgtttccttcgataatcctattagttgcatcattctgcacactagccgtacgctcaatagatttttgcttagagttttcagcctcttcacgttgacgaacttcttctttggctttctcatttgctttagaagcgttatcgttcatattttgctgaatacgatccaagttactttgaattttagcttgcatatcgttagtcttttgaccgatgagactagtcaactcatccattttctggagtacatctccataattagcccgaaaccttaactcaagttcttccaagtccattactattcacctcctcctttatctttattaaattgtctaatccgttgagcttgttgcataagaatagcttgatctcttttccaatcgggttctttttcagacatttgctctatctggttcatatcatccttaacaaacggataagcttcttctaacttaggcatcttagcaggatcattaaccgcaaatgctaccaattcacttaaacggtgatccatatatgctttggcacgtaaatcatttaattctcgcttcctgttagcggcaatttgcgtcatgatttccgcaaagtctaaatcccagaaatgatcagcgtctattcctgattcaacagcgattgggtaaagatctttgaataaatctgatactgtatcgtaatttttttcgtttacagcaactgatcttgggtcgcttccactggatctaatgtcacttcgcccgattccgaattggtcttcgatgacttcttctttttgccgaaaaaaccagacgcttcaaatagttccattaaggcattaaagagatccatcgtggtattaccatcatctaagtacttttcaaaggcgttcaatactcgtttatcagttacgccatgattttgattagcgccttgtaatacgatcaggatttcattaactggaggtagcttatttccaccttgagagtccataaataaggacaacatagacttgccaagtcgccgttcaatcttaaatacctcacgaccgccaagctttaagtcaagttccaaatcacctaattgcattgtctttgttgctttcttaacagtagttgtcatatgaataaattctcctttaatttttatttgtcactaaagataaacgtgggaatcgaacccacgtttattaataaactagccttttggtgtatcactacctggtgcagcagtgaagtgtggaccatcagatacagtaatagtaattgtgtaacctaatgccccgttaactgcaaccgctgcaaacttgatgttgtatgaaccacgcattgtagcagtcattccatctgggtaagtaactttccattggtattgtttccgatcaccggcttgttttagggctttagcaaaactagcacctttatatacagcttggaactgaacgttagaagcattttgaatcccttcaacttgcttccgccggtcatcagccaaagtagtgacatcaaccttttcagtgtcaccacctaattcgggaatagtcttgatatctgcaatttcttcccacgttgatccatcttctgaacgttcaagcttggtaccagtaccaaccagaccttctgaactatcgatagcaaaacgttgtaggtctaactttaatgcgtcactatataattttacattcttcataatttcatcctttctggtatacacgtttacttgtgttatctacaattcctgtaaagacaagtacaacacgtgttattccattcaaatcttgatcaccaatgttattagaaaagcccattgccgaaaacttagcaatgagcttattttttatttgcgttaaagaacctttatcattgtacaaatcaattgttatcttccattctgtatcagtctcttcttggtaggcattacgtatataagaagactgagttgttgaatagatagcaattggaaatgccgtgaatttatcaggataagacggcgagacaatctttaattctggaatagacttcaacgtcttatataccagtgctttaacattgtagatttccatttaaccacctaatttatcacgaagctcttggtcaactgatttctttataatcccaggtgcttccttagctattctgttagcagaaggtgtcataaattgtcttgctggttggccgttggttcgataaaaatacttgtccttaatcttaacctttggaattccatagatttttgtaaggtcaatatcaacttcctcagctggaatgtaccagggagtttggcgataaacaattgccacattaggtggaagctgcttactagattgttcaccaaccttaccagtaccaaactcacggaaaatagcgatcattgacgaattccaccaacgaccaactatttcatccccatcgacttttacttcatgcttaaagctacgggcaagttcaccagtagaatatttgatactagattgcaactcttggactgcataggcttcggcttgttcaattgctgtctcttggccgttaacagttgcatctgctacaacttgaggaagttttcgtagcttagtttttaactcattgagccccacaatctcacattcaatcattttgctcatccctcttgatacgttctaaagtaacgtttttatgagtagaaaactcttgaatagccgtaatcttataatcaggatcactagaactcggaacttttaggcaaataccaaagccttcgccgtgcccttctgaaagtaaattgccttgatacttacatgtcttaatatatttaatatcttttccataaatttgcgcattgaccgtaccaccagctgattgaacattcatcctgattggttgtggatcaccccagccagaaatgctatagccttcatcatcttgagtattcattggttctttaagataaacggttgtaagatcactttcttttaatctcatagcttcgtcaccttagcaattcgatagcggtttaatccttgtcgaatatcttttggaataccagtctcgagataattagttactccaccttccgagcgttgtgtttcgccttcaagtcccagtcggttgtagttaatgactgccaactttttaacatacacactcatgttaccaactaattctttttgacccgtataatctagcacctgagcatttgcttcttctactagctccttaattaattcatcatccgtaacttttaaacgagcacttacggatggaaccatttcggccacttgatccacattcagcacctccaattaattaaaggactttagcttggtatacattatcagcactagcaaatgatggaagcatggttgccgctgctaatacccaagttccaattggatcttcaccagattcataaatcttagccataacattaccaacttctgatacttgcgcattagttgagatcaaacggttttcttctggagttgggccatagatcttttcacctggcacttcatcattaaagagaacgatccgatcttccgggaagtatgtttgtgttttaactttacccttagcgtcttcctcacgatacttaccagcatatgcacgaataaccggaagtccttgagcaaccatgaattgatctaaatcagcttgaccaacaacccgaccggtatctttaccaaagattgcttccttgatttcagtactacgcattaatgtccgtaataccttcttagaggtcaatgcacgtgttggggtaatgtcgagcttatcagaccaatcttgtaagttttcaatgattgaagcactaccgctatcccaagtagtattacttgctaatgcagtttgatgctcttttggaacttgataatcaatggaaatcccgttgtccttatcagtaatcttaccagtagcaaacatttccattgtcatcttttcgccacgtgctttcaccgcttgaaccattgcatcaatatcattaaatacatattgctttaagtagttagcttcggcattattacgtggataacgtaacttgattaacatttcttcggtaatttgcatcttgcgctttacatatgctaattcagcagtcatcttacttgcttcacgactaccgatttcggcttcggcatcaaaggctgaatagctagcaattgttggaacacgactaccagcttttaagatatcgacttcgagtgttggaaccttagttgctggaaataaagtatcacctaacatatctggatattgacgattacgagtataatcaagcaccgtattctgatcgaacatatcaagaattggtgtggcaaaacgttgtaaatctagcttaagtgtttgcttattcatctattatctcctcctcactacgcttttggatctgctgtggtagtatctaaatccttaaagtgaattgctgtcattgctttaattgcatctgctgatggagttggagttaatcgttgacttaatacccaaccttcacgcataacagctaccatttgattagaaccatcttctgatacatatacatcattaacagtaataccaaccgcctttgcatcattcgttggatatactgtcccagcaggtacatacttgcgtcctaagtcatcagtttggacattgtaattgtccttgttaattgtttcagggaaagcagtgaacttctcagaagcaaggaagtttaattgcttaccgttttgaaatcgtgtgtacattaattttcattctcctttcttatttccaaaaatcactttcagatttattagcactattagccttttcggcataaagctcaccggccgatttatgagtcaaatcatcatccgtactcttaggtgttcgtgagccttgtgctaatcgagtttcaacggcatcatgaacggcgctacgaaatacttcgcttacccgttcatacgtttcattcatattgtcttcgttagctagaacatcatcaaaaacatcaactaacccagttggcaaaccatcatcaactaaacgagaagcaagcttacttcgattctcacgcttagtaacatcagcttcacgagcagataaagcttcttcccgttgcttgaagtcatcctcacgtcgttcttcttcggtcatgttcttgcgatccttagctttctttgccttatcgctttgttccttttcccagttagccttagcagtccctaatgccttgtctaacttcttatcaaaataagaatccaattctgactgggtctggaacgtcatgaaaggcttattttgcgtatcagaatcatcattagtatccgttgcttcgtttcctgtatcagcacctccttctccatcttgtccttcatctgcaaaccgctgtaagttcagctttagcaaattgctataaaactttactttttccatagatataatcctttctacccatgcacactcgaatttatgactgcacgaaaaaagccactccatatttctacacagtgacttctaaaagtgtgtcttcaagcccacacacgtattcaattattgaagtagtttcatgacgtgcttaggtcaagatttattgttacctagatagattacaggcacagttcgacaaaacggatgcaaaggtggcacattcttaccaataactgcatcagatacgttaaaaactttattattaattgctcgacatatcttactggttcgactatcaagaacagcaattaactgatattgcttaactccccgtttcttccagctatcaagctttaccttagagtaaaaataattagcttcggttctgattaatcgactagcattgaaacgacttgtattaaactcatcttcaatttgcttaatcatttctcgttcagacattccacttaactctttagctgtaaacaattcttgcaagcgttcagcaagcttatcagtgttatcccaaatacgtgatgaaaagtttttaccttcccatctggaatttaatgctgcctccacataacgattaggtagctcagtgattttcgacttcggtacgtcttgttccatcgataccgttgcaatctgcttgtcagtcttagggttcttgataacgattttattttctttagattctaaggctggttttgttttattagagagcttgtaatcttttgctttatcatatacggctccttgcttttcgacttcggaccaggttcttttcattacatcagtatgcaatttaatattctgatccaattcaacgtctccaacatttttagcaactatatacgctttgacttgtaactcttccagtcgggtaattctgctcttagcggctaattgatttaagtaattatcaacagccttcttactttctttatcgacaatattgcttgctaacgcttgtaaggttacaagctcagatggtgagatgtgcgaagacatgatcgttgcaacttcattagcagtaatatcagcataaaaatagcgacgataaatcttttggacctcgtcgcttaaatatgcttgcgctttctggtatgccgtattaataacttttaggcgtttggttgcttcatcctggttctcttgttcatcttgcaagtctcgcaattgccaatagttgaaattgtttttatcaactttcataggctttcacctacaaaacagtgatgtattgaccatattgcttcacaagctgattaactgtattctcaaacgcgtttagcaaagttttatcttcaatgcgttcactatttgtaaatacagccgtcagagttccattctcatcatttacagccacgttagtacaattattaaccgtatgagttagcaaggtagaaaacgaagcacagacgatatcagagccttttacactatactcagcgtgtccgcttgctatgattgtcgtcttgttctgttccttttggatcttcactcgaatcatcttgactatcctccaattctaaacggtctggatcttgtcgctgtaacgcttgctggttctttttgatgttatcagcatcttgttgagccatttcatcaataacttcttgaacatccccaacttgtggaagccaactataagtaatcttgcgcggaagaataccgtcagcattcttaatgttgttaactacatcagacaggttaaccggaatgtttggtgttaacgatatatcacaaccatcaacatccgaattgccacctttaatattaacgatggtttggatcagttttaatcgccggtgcaagccatcgaagaagtaacgcttcttaattgaaataagattttcaagcccaaacagcttaaatttcattgcttcacctgacacatttcccataaacttttcatcgttcatatttggaacgtatgagatcttatgaatatcattttcgatcgattggctgagtagattaacctgtgtttcgtcgaaagttttagttagccattcaacatcagctccatcgtcacgagaaggcgcattaataacaccattctttaatgcttcaatagcatccgtatcctcttctaacacgaagccaaacgtaacaaggattgcatcgacaaaggcttctttatcagaaattcgatcagtttgcaggagattataagcatcaatcaacgagattagttgttcaaagtcaccctgtcgctcttcattatttcgatactcaattaatggaactgcattgaataagttatcgtattcgtcaacgatttgatcatctatcgatacttccattcctacttcagtgcgatattctacaatcttttttggcatgtataccgtgacactataaccatcagtctgtccacttaaattcttctttgcttgaacaaacacgccaaataaaggttcatgttcaaccgtatcatcagtaacaacaattgcggcacgtggatcaacggcttctactcgtaattcagtgttaggagtaatcttttcattgccaagctcatcaatgctaatagttggagcaattgttttaagataaagcaactcatagccatacccaaacacagataagtctttttcaagctcaatatcgtgcttatgaatatcaatcttttctagtgcttctaacacatcatcaatattcttacctttcttggcggtatatttaaccggattcccagtcataaaaccaacattcatatcagtgatgtacttagcatgattaatcataacgttagaagctttaactttagcattctcaaagcgatggttattaacttcttgatttccgttgtaataatcagcaagtttatctagcctgctttgtcgttctttcagtttacggatagcataattaatcgcttcaagatttggcttattaacatcctcaagtaattctctatcaattgcaacagccacataaacaccttctttctataaaccacgaacacgtggacgtttggtaatctttgcagtgaatcctttatggataaccatgtaaacgaaataacgcatagcatcgcaagcgtgatcatgttctttcactggtttatcttcaccacgttcggctgctttttcatcccatacatagctggataattctttaaataaattaggacattgattgctaaatagtatcttgccttcattcattgccgtttgggtaacacgaataccatctaccacatcattttttgccttttgcactcggaaaccattattccgtaacacagcaataaaagaagccgcagacgggtcaatgataatctttgcgtgaatgttcccaagaaacttcttaagctcctgacaatactgctcatctgtcttttggtgagcagtcgcacgtcctgaataataatattctttaactaagtaccaaacaccatgattgcgtccccacaacagaaatactgttgggttctgcgtaccgtaatcacaagacacataatacttttcaaaatgattaggcaattcattaactaccatcgtatctcgatcgaagttgtcatagatgaccccttctgacattacccacaagcctaaaatatagcgttgataaaacacgccagaatacattcggttataacgatcaatggtttcttgtgccaatgatggattgtcctgcatcataaaatgaagtcgtaacgctcgcttatctttcatttggtcaatccattcaagtttgaaccagtggtaaggtccttcggggttacagttaaaccacatcttagaacccgttaccgaacaacgagccgttgcctgattaacaaaactttgcggcataagtgcaacttcatcaaaaaagaaccccgccaaagtaataccttgaactaggtcctgtgatgcttcatctttaccgccaaaaatgaagtaataatttgtatgaccattcttgctgatcgttagcatattatccgaacgtgaatcgtgaatggcatacccttcactttctagcatgcttcttaatggtcttagcacgttacgcctaaatgaaccaattgttttaccagccattccaaactgctgaccattgaattgggtcatggaccatagcacgtatgataatgacatgacaactgtcttaccagcacgaacagaaccatcacagataatagcttcataaccctttaattcatcattagcccaccagctaagcgcttgaagttgtttccgactaaacggggtaaacttgaatctaactgtctttatccccatctttatcactccatatcttcttcataccattgctaagggcagcaagtaatgagttggtgctttcatcattaacttctggttctggcaagcgatcaagtaagatctgcattgccttctgacgatcttccatttcaacaactggctcacctttatcaattcgaatactcttgatgttcgatgtatcaatcttgctactatcttttaactcaacaatattcgtatagtaataagcctgttcgcctgtttcaggatcaatcttcggcacatagcggaaattacctccgccgtcttcataaggtccatttttatcgcgtaccttataataagccaaatgcttttctgttctgaacgatagaacgtcagtaacattgctagtcgcttgatttaagtaacgtagcaagatgtcattggcggtcgcatatagttcttgcgattgctgtttctttaactcagtaaggtaagattttatccgagcatttccgagcaatctaggaccgttagtcgttgctacattgtaacttccaccataagctttttgataagcccaagtagcgttgtatcgttgcaagtaatacagacaaaaggctttttgcttatcattaagttcatcactatctggcaattctggaggcggtaacgacggtgcaaccttttcttgttttgtacgcgtactttttacttttgtatgcatacttttcttcttggttgcattgtttcgttgccatttattcctggtcttccatgacttaactgtactaagtgcaacgccatacttcttggcaatgtccttatatttcatcccagctaagtaatccgccttagcttcttccatcttactcatggcatatcaccacaccacctttctaaatttgtgtacaaaaaaagcacctgcaaattgcagatgctaataatgagggcgcccggagttgcaccaggatcttgccacattggcacgttttcctttataaactacttccctcgtctataaaactttatttaagtaatctcgtagctttattgcattttctttagataatttgaataccgtctgttgatcatcttgttcccgtgttccttgacgcatattagggtaataaagattagttaataaaacatcaatactatctggttgctttaagaagctgatctcagcctccattcccagatgatcgtcaatcttatctttatacattgcattaaaccaaccatcatcaatgatcaacgaatgatcttttacattcttaaatgattttctatgcattctttacctctcataattgattcagctactcttatcacctaactcacagagaagctagttgatagatatataccacatggcgccatcgcgctaatcgttattctgtttccgtggatccttagtaccagtgattgcttccattccctcggtagtaactatccattgctttccaaactttcttatagaaccatttggaaatttatctgggttctgctgataagttctccttacatagttttcagcatggccccagattatggacgcttctttagcatccataatatctggagtgttcaagtttatcctagccatacgcgtacagccccatagacaacccatgccactacaccagtaatcaaagcaagtttaatacttttacgatactttttttcttgtttactcatgataaaatagaatatagcaaagcgggcgaggctctcacctcaaccctttgttatcgtttatttaaggaaatgcttaacgactattttaattgtttctgcaatcggataagcaggcactgcccatgcagctattgccgcccactttgtagcttcaactttgtcgttctgcttttcctttttctttttatgttttgccatattcctatcctcctttcacttattataatagtactatatcgtacgtaagtcaagtgaattagagggaaaactcatttatttttatgtactttaaaagccggcaagcgttgacctgtcggctttttctttgctaatcgtttcctagtgcgttcagcatgagctaacatatgcaattcagcaccgctgttggtaaagccccaattcttagttgttctcatatgttaattcctttaaccattcaatagcgtcttgggatagtttcagatgatgaccgtattcaccatcatctgaaaacgtaacgagtttgccagtcatcatatgttttaaatcgccagcattcagttcagtgggttctccaccaccccaaagattatattcttctggcacatcttcccagcgcttgcaatttagcctagttacctctgtcacttccaactcctcctatcaatctatcaaaacaaaaaagcacccattgctgagtgcttgtatcaaggctatggaagaaacacgagtaagtaggtgcttcctcctttcgttgattgttgttaaaagtagatgagccttgaatgctgatggacggaatcgaaccgccttctccacgttgaaacggaaacaactgtggtgctttaccattaagctacgtcagcataatacagaaatgcttgcatccactaatcgtttttgaattttgttactcattgcatctctgcattaaatcacggcttagacaaaaaagactatgcaattacgaaagaggagcgttcatctcctatcatagttaaatttgccgtgataaagccgagaggtggattcaaaccacacttttgccacacgatcaagtgtgcccatcttggttctcagcaagcagtgcgacccgttaacactgcaattacgaatatcgggaactgcccccgcaagtattgggccactccaggatacttggcatctagtttgcatattcgcataatcaggaccacgtaatcaccgcacccggtcgtagttttccgcctactcctgtaacggtattgctgtccattcatacggtaatcctttagccgctgagttagattacatactcttctgctgattacagcacggttgctacgagactatcagagtagcatgtaaatttaatgataaaggagatcttccaatcttccaaaacgcacaaaccaaatttaatcgttaccgtaaatttcttttgaagttaatgatagtctcaatgtggattatggtcatctgccaccatcgcgtcggcttgtttaccggattccacacttcctacgcttaacaagagagatcccgttgcgagtatcgttaaacgttggaaacacgcatagcagtttcaggattgcttaggcacatatttaaacggagcgtgcaaagttttattagctaactttgcgacgataacataatataacgttatatctcccgttgtattcccgtttttgtcctcttttcatcccatttttgtcccgttttcttcctgttttttgctcgcaagtcaggaataatatcagaatcaacattaagccgttcacataccgcttctaaacaatccgcaaattctaagcaagcataatcatcagctcgatagtaagtagaattgccgaatttgttaattcgctctttaattactgaaagagataaaccttgaatatatctatacttgataatttgttggctagggtgtcggtaactactgctgcatcctgcaatcgcatagtcaaccgctcgttttgccaacgtgtattcagcatattcgatcatgcttttttctgaaccattgccacgtcttgatcctcgaatacctgtaatatcattctgtggcgatttaataccccaatcacccgatctacgtctaatagttgggtacttatcttcgtctaaaaagaaattctgtacgttcgcaattgttgctttcttattatccccttttaatagttccactatttgcacgctccccttgtgatataatagttatgctttaaatttatatctatggaggcgttctcatagtgagggcgtcttttttttacgctttttaacgcaatttaacgctttttaatgctatccaaagaaagaaaagacagcataccaaatactgaataccatgtatagcactccgcctagacctaacaatgcaatgccagcaactataagcccgataaatccaattactgtatatcccgcaaaattacgtattactcttcccatcttttccctccaaattcacttctattctttaatcttgttatttgcgtctttcaaaatgtcagatattttttcttgccttaaaactgcttctacatctgtaattctcaattgtccgtaatagcctgtattacgaaataacactcctacgtgacgataatattcaggttttgataaccctgtaatctttagaatagtagactgtttagtgccaatttttcgcaagatataagcttgtgcaaaagggttattaatattgtgcttataaaaatattgcttaattcgccattcggcttctttaattcttctaggttctcgcaacttcaaacccttacgaaacttcataatttcttgaagtcgccaatcatcaggagcaaggatctcttctggcatttcattaactccaccccattcatgattaacagttaatgaatccattgctttagatagtcttttaggtattgccatcttcatttacctcctctacctcgatttctaccctaggatggtcactgtaatacttttcagcaactatctttacaatctggttgtcatcttcccatagcaggccgtttaagccatccaaagtagatttgatgtaattatccgtgtccggttttacaatcggtctgtgtattcctgcgatccgcaattcgcgttcttttttcgatatgcttgattgaatgtgtcggtaaaatttaagactaacaattagcgggcctgttaaaggctcttttttgtattgaaattggcacatcatcgccaattgttttttgtataccgacactttctttggatcatacaagcgtattcccttacccattcgagttgctctaggccgtgcttgttctacaggttcaatttcaaaggtaagtttcactaatctaccctctcgtaagttcgttcaaatatatcttgatcgatagcccaatgctctccatctatgccagtagcgacgtaatcacctttgtgaactcgcatcggtccttctttagtatctaagtaaccagtcccaccgtcttcaggaaaccaaggctctccgcaatcaagcctcataggatcccagctcagtgctagttggtaatgttctgcttcggcacgagttaatacctgttcagcctcaattaaggctgtctttctgtatttgtgtagcattattcttcctccatcctgtgagtttcccagtcataactaaccattgtttcaactttgaattttttatcacatccaatgcaagagatttcatgctcaccatcttcatacaattcgggatattcaattaaatcatcatcactaattgcagcaccacaataaggacaaactacataatcactgctaaaagtatccggttccccttcttcaatgctttctctaattttcgctaagttgcgaagttttaagcaatcattgcaatatccgccatttacccaggctaatttgtcatactttccacacatcttgcagtgatgatcttgataatctagcgtcattattcttcctcctcatgttcactctcacgattaaatttagccaattctaattctgtaatgaatggtttcccgttatattgggcttccacagaacgcttaaaaaattcaacagctttgtgttctggatataagaatttaagcttatccatgattgccatcgctctaagtttttgctctaagctccccgctttgttaaacgacttcgacagtagatcagcaaaccgtagtaaatcatggagttgtttattgctaatccagtaaggttgatccgcttgtttacggccgaattgctcagtaagaattgtttctagctttttcagataagcatcattttctaagctttcataaagatattcacctaatgctttcttttcttcgttcatcatttcttccacctcttaggctttctagctttgctgtgccaccattgtgaccattcgtagctggtgtgatcgtgccaagccatcatgtgcttggccttagcaatctgtcgcttacgagtgcgtttgattggtttaattctcttgcacttatggaaagctgcatgaagatctttacggagtttgggtgtcattatcataactgctttaatcttcattagatactcaccatcccttcaaataatacataagcctgtcacgttcataatcagttgctattattcttccgttttcaatctgtgaaatttctacagtactaattcctgatacaactgataaatgtttagcagtccatccttttttcaggcgagttgatctcaacaagtcaccaacatttgtatggactctaggtttttttctcctaattgtattgtcgcaaacccgacaatgcatatttttctcaaaacgcgccaatctccctatccaaaactcatgaccacaatccaaacttttaatcttaagtggtttatttgcattttgatatgcggaaacaattatgaagtttggggaaagcttatttttagcgattttaaatccacgttctcgaagggagtttatattccgtttacgagcacaataggggcaaccatctcctctataaatgctgtaaggtcgttgcatatatatattgccgcaagcaagatgtttaacctgtgtttttaccgaagaccctttatactcaccaacctcgtattcaggaccaagtatttttaatgcacgtctttcaaattcttcttgagttatatgttttcctctgtaaagatcgctatattgcaaaaccatcaacccattcggaaatgttataaatttcttgtagttcagcagtgtggggcattttgataacttcactaaatgctaaaaagtcacttgtatcattacgaataaaataaacatcctttgccttcctgcttaaagaatcacactggattgctactccattcatccccctaattgccatattgaataacaagaaaggaattgctctatctgacatttcttctacttgataccaataagctctagggtcataagtaaagattgacaagaattttaagttaggatcagcgtgtaatggattaccaacccgatcatttatacagtcatcccaccagcgcttgattaaaattccacctgtccctgcagctacctcgaaatagtggccgttagatttatcgctatcaactaagctattaagcaaggtcgcaatgctatcaggggtaaaatcctgcttcttgcttttccgttcagcttgctcatcttcaaaatattcatggaaccagtcaaactttaggtccgttgaaacttctaggaacttcttaaagacttctggacgtttttgatcattaagcattagctgcagcattctttccggagctttatatgactcatcaactcctaacagtttattaactgtcttagtatcaaattgcattatttcacctcaaattccggccatcacagtcataatcttgttgtcatcctcttgggctagttcatcaagaagatggatatatactcgttgcgttgtttcagtatcaccatgtccaaggcgcttagctactgattgaatagacacacgattagcaattaatatcgatgcatgagtatgacgcaagccatgaactgtaacccgatgaacccctgcttcccaacacattctttctaacttagtattaaacgtactattaaaaattcgaggttcaccgtaaacaggagatggcttgctaatcgacgcataccaagtcggccatattggttcatccggttctagcccttccatatgtttttgtagatccatcaaagtcttgtaatcaattttgatcatcctaaccgaatacttatttttcgttggcataaattttccatactcatcactgccatattttttggacttgtagttgaaagtcttattgatataaatagtcatattatccatatcaacatctttaggtgtaatgccaagtgcttctgcaaaacgggtaccagttcgtaagctaaagtcaaagaagtcaccccaaccaatctgatcctttttgaagaccttttctagtttccttacttcgtccatttctaagtatttaggacctttattatcgggttgaaccatcgaagttattttaattttatgatttggatttttacccgtgatccatccttcgtaaacggcatcgtcaatcgccgcagcaatatggtggtaaaagtcaagaaccgttgctttttgatgagtctgaccataaacattaattaacatctgtagatcttcacgcgtcatatcacccaaaattaggtctggtgctaactttttcaaccacttcaaaactagcttatatttagctgtcgttactcctctaactgaattaactttgtaggtcatataccattgctcgtaatatttccaaaatttaattaagcgtttcttaccagtctttgccatagtttccctccgccttataaaaatcgaggatagcttgattaatttcaggcaccttcattgcatcaatcgatggtgcaagagatggttcacgttttttaatttgatttaattctttctcactaaaaattcttgcttctttttcatcttcagataaatcaaaaacaagttcatcaaatccagtgatgatatttgatacatactttggatgaaaagatgtctctcgtttagctactaatcgatacttcttttctggaaaacgttcattaactggtgtatcaagcagccgctggataacgtccatggcacgtgctaggtcttctggtgcaacttcagttaagccaccccaatgttttaaaaccgtatcccagttaatcgccttagtattcaattttaagaaccaattatcgcttatcatgtcttttgaaaaaacgttcaaatagtcgccatccacttttgctctaactgtcatagttgaattaataacgtttactgcttcatcaattttcattgtgctacctcctcaatttccttgctctcacgatctttaacaggcgttgcgatgtactgatcaatcaaatcagcaatcttatcccgcagctcatcgtttagatcaaaaatcacctttgacgcttcttcggtagtaatatcccaaaactcaggatcaagccattcttcgggccagccctcaaagttatcgccaaacggttgagcgatactctttgcctttggatcaattgtcataaaccaccggcaatctttgtcatcgtctcggtattcttcccgatccgcgtaaatgtcgataccataaatatcgctacggatagcgaacactttaggcaactgattaatccgctcaattaggtcatcggttgttaaatactcttctgcattcatgctgtctttgcctcctcgtaattccaattggtgcaggctttgtcacgtagcaaacggcactcgtgacaccaattagctgcatctttaacgttttgctttgtaatcggtgcttttaaggcctgtttcatttgatttcctgtaagcggcatggtgtagttgctatcatgttcgtctaactgtgacagataataaatcgctatctgtagcttggttttaacgaatttgattgcccgtgcctcaacattatggctatcccattcatcttgggttatctgcaccatacgcttagcaacagcccacttagcccgtacttcatccttagtcatgtgttactgcacctcgctctcatctggtagttgatccatccaattaccttgatcagacttgccctgtttctcctgctcttgttcacgtttaaaccactcaggcataggttcgttaattggcgcacgtttgccatacctttgtctttgattattagccgtgctagggttggcatttaagtacccatcaatctttgatgagcgaaagagcgtttctggtttcaagtaattgtcacctaattcgccgtttctaaacgttaccccgtgccacaatgagtacatgttatcgattacctttttcatctcatcgactgtgtagtcttctttgagtcgaggttcaataattcgcttattaccatcagcatcaggcttgaagtgcttgccagttttttgattgagatattcaacaacttctcgccgctgtgcagcaatggaaggttgggctggctgtgcctgccctttatctcttgtagtagtcttttgtgtagtctcttggtagtctattggtattggttgggtagattcttcctctccgattgggcagtttttaccgtctccattgggtagattcttcccattcgttgggtagtttctacccaatcgttgttccaaatgggaaaatgcgtcatagtcaattcgataccactttgttttgtcaaaagataatttattatagttgcctgtaataattagtcctcgtttttctaatttcttaaagtggttcgatagagcctttctagaaagccaagggaactgtttattccaatcagccatgctgttatagacccatttgtgattgtctcttactgtattagaacgttgaagccaatagtgaagctgctggagaataacagcttcgtctaagcttttcaacgctccagctaacgatgcctgaacttgtaacggtctttcatcaagtaatagtttgctcatagttaccgttaactcctatcttttttaagtcttttttgcttaatttaattcctacggttgtaaggtgatacttcttacagaactctgtaatacctatcttgtggaattctgtatggtgaactctgcataacgccattgcacggtgtttagtgtgatctgtcttattgcggttgttacccataccaacggtatctatatggtgaaaatctgcatgctgtccacaaatcaaacactgtttatgcattaagcattcatactgaaaatgttcttcatttcttggcaagagttcatatcctttcttaactggtacttgattgtcaaaaataaaatcaattacataatcaattaatcgtttagcgtcactcatgctattagatgagccatcttttaagctgatttcttcaccgtcattcttgatccagtaaagattgtggaaatattcatcaattatttctttgctctctccagaccagttaataatgtcacctagcaacgcatagtaaaaatggcgttgtaactcgcttatttcacgtttatcaacaaaagtgaccattgcaggtacgccttgaactttaccgtcattgatattggctacatgttcccagttgacttcttccaagtattcggaaattccgaaacgcttaccgttcttttcttgaacataaacctttgctggaatcttcattgatggcatttatatcagtccttagaagggcaattggtcattatcaatatcaattggagcgccgttaccgtcattaaatggctgtttattatttgcttggctagcagtgccaaagccgttgttagtttgattactgttattttgagggcgtttttgtccgtttggctggcttccgtccgcttgtaacatacggtaacgtgttactactaaataggtattaccgttgtaatcactcttttgccattcagtttcaacggctaacttttgattagccattttttgcacaaaatcaggaattgagtaaataggttcgttatcttggtatccagctgcaattaatggagtattaaatcgcttaactgataaatcatgattttcttgtgtattattagtccaaacaagtcgatcaaagatatgtttgcccttttgtgttccatctaaaacaatgtaatccattgaagccattgggttaccattctttgagttgccggcttttgattgtgcagaaacataaatgttatagattcccgcttcatcaggtacctgtgagccgaatgtgttgttgtggttagtgacaaataatggttgttggttattcataattaagcagctccttcttcttttgcttgttcttcttgtttagattcaattaattcttctgcatgaaatttcttacgatcatcaattctgttctttccgtgattaccgctttctgggtcgcaatcaatccaacgttggttgtcttggacgtatagccgtccgacaaaatcaaacacgctagtaaacgcgttaaacgtcttttcattcatatcagccccgtaacgtcctgctcctgttaatccaccagtaccgttatcaatttggtgtgcagtagcgtagatagttacattgctctctcgtagcatagtggctaattgtctgaaccaaatttgtaacttctgataattttgtcgattatcttttgaagcattgtcgatgttttctaacaccaagttttgtaatgaagtgacgttgtctaatgcgattgcttgatattcgccactcttaatggctcgttgtaagaagcccaccgttaactgctgaatgttagcgaagtcgtcttcttcaacgaccataaagtcagtatctttttgattacgcagtggattggttgacttatcaaaactgaaaagaagtttttttcctttgaattgtttgaataagcttgtcttgcctgttccgccatcgccatagataaaatacatattaggaacttctggaattgctccggctttatagaacttcataacttaccacctaccgatccaatcgaatgacacattgcttcttgccaccctttacaccagataatccctcaataatttctcccgtttcattaagtatgacttttccatcatctgtaatcgtggtagctcccttgatctttgctttgtcaagttcagtgactgttttgagtaaatcactaggtaactgcttcattgccttcctttgtgcaacagcacctccccacttccaactatcactggtcgttcttgcttgaacgttacccattgatgtagatacagacgtttgaccatgctcggtgtcaataaatccaagcaattctgtcatcaagattgcattatcgtcttccgccctttttattttgctttcgtaaaagtttttaacttcatcaatttctgccttttcagaagcctttgcttcttcaattaatttcttgtttttcttgtactgccgtaaacgctgattaattgcaacagctttatcagcttcaaattccacttgattattcatggattagcttcttcctttctgctaaatggtatgcttcggtttcaacttcttttgcgtcttgcttaaaatcgctctgattatctagatcgtctaacagatacatcattgctcgtgctatgtcataatcataagcaccatcgcttaaaatcagattcacgttatagaggttacgtgctaaaactttttgcattcttttaagtcgttgtttataaaattcgttcatatgctataatctccttagatataatttttcatatgctatctatttgccatcggtgttcccagcaccggtggctttttttgtgttcaaatcccatagcattagcagatagaagaacagtaagaacactgctccgccatagtcaccaacgcctgcgcaataggtgatccaagcacccattagcattgctaagagctttgaattaactatttttgttagtgtcatttgattacctcctctcgttgttgcttaatgaactcaaatattttccttgctgtcggcacctgatcagctgtaatctggcgaacatctttaaggccgagcacgtatttaattggacggtaaatagcatcttgaattgtcatatagccaatgccgtctttcttaactcgtaccttaatgaattcttggatttccttactaagtttccgccaatccgggctaatcttaggttcattatccttcttgcttaattcataaaccttcaatgcaattgcgttcatttcttcttctgtcattgccattagttcttgttctcctctgctgttaacttctgatatttacgatcaaattctcgactatatttaatacaagcgttagtcacaacagtattaacacttgatccgttgtattccgctattttgttaagcttattggctacccattcgggaagtcgtactgatcgtctaactctctccatgttatccctcccgacatattttatgtgtctataatagggtgacacttttaatgtgtcaatacttttttaagcctaattggtataattttggtgtcaggaggtggtaccgtgagttccacaacaattaccattcgtctccctttagagttatcagataagctcgattacgtatctgaaaatattggaatgactaaatcaaatttaataagagttgcaattttaaaatatctagatgtaaaacagcttgatgaatttgaagaaataaaagcatcgtcagaaagtaataagcgaatcaatttatcattaactgagttactttattcaatagttaagaagcgatctgataacttaggcgtaactgtaaacagccttatcatttatgcttcggaaaaaattcaaaaacattattcatacatgcttgaatcattagaccagtaacgctaataccggttaatttactgattcttaataagtcatcatcgacttgttttggcaaacgtactgttatatatttcatatttcctccatactctcctttgaagggaggtgagtttatgactgataaagaaattgctttggaattgaccaagatctacgttgaacacttaaataaacaaatggacaataagcatcaacatactgatcttgacttcaaagcctttgggaacgtatattcaaacctttatcaactagttcatttaattgataattctgatgaaggtaagtaattgatattaatatttacttcattagccgaaagagttgctacttcatctagcagctcttttatttcattcaagttagtgcaagtggttgaaatatctagtgttagttgttccatttttgtttacctcctctgaaaacatctaagctaacgtctaatgcgtcagcaatcttacacatgtttttgaacggtggttccttcccatcgtttttgtagttataaattgttgttagtggtatgcctgtcattttagataggcgataaactgttatcttctgtttgtctaactgaatttgtatgctattccacaacatcttgtataaatcaactctttctatatccatatgtagtgttataatcaaaattacgattatttacataacactccttttagtaaattaatcgtcaattcaatcaaagtgaggtgtaattaatgttctttagtcttcgcaaatcatctgatggacaatattatttcgttatcaaatcagataatcaggaagtagttgctactagcgagacctacattctcaaagaatcagctaaacataccatcaacgcaattaagaatggtattaattccgatactccagtatttgatattactgattgctaattattcgtttgatcttattggctagagttagattttttgcagcttgttcttcaagctggcaagtaatcttctctagctcttttttattttcttcatccataaatcgttacctcctaatgtttctttctgtacttttctttcagcacattcagtttctcaccctcaataacgttgacgattgctccgattaagaagcaagccataatcgccaacacacaccatgctagatacgccatttaatcacctctcaacgcttttacatatgggctttcatgatcttcgtagtatctttctgatcgaaatgtttcaaacttttgatattccttcaaatcaacgcgaccaccggcaagaaatacctttcgccagtctggatagttttcttgcgcccaaactttgcgtctatcaaaagtcgactttgacataggtacttctatttccttgtcgcctatctttttaattgacttccaaacattacagaattctagcctgttcatctggtataaatatgggctcatctaatcacctcctctcttttgctatacttagttcatcccctacgaaaggaggtaactactatcactactcattacagttatgaggaagctcttgaagacgttgcacgcattacgaattacatccctccagaagcacgtaaagcaatgcagctagcttcgcaagctaaccaacaaattacagaagcacttgcccctattcagggacagctttcccaacttcaagaactgctcgcttttacttcgaactttgatattaaaattgcctcgactctcaatagaatcaacaatgaaattattcactacccagttgaatcatttgttaaacttgcggataccgtcgatgatcttcccgaatctaacttcgatcattccaatcacgaaagcaggaagtttacccgaaatagttattccggttgcaatgatactgaagcagacagcacacgatataacgtcaagctttttataaaaaaacaaatcgatcagttcaaaaagaataattccatagaagagataaaagtcccagatgtcgattactgcttcaaatttttcaagcttctttttcatacaataaataccctctgtatcatttacggtgtctataacgacacttttacttatgtgctcatagaagcgatcataacgaatatcgacgacatccttgatttcagggataagtaatcgtctgtcactagatgtctaccgtcttctgcaaaagaccgtagacattctttttttgtcttgggtatctccttacatatccagcacacggtagatcttcttacgaatctcgatcgctttcggtgagttatcacccttaattgctcgattaacttgttgacgattaatgtttagcaaacgtgataactcagcttgtgtcatatcacgatcaagaagtttcattttgatgtttcgctccacgtcagctgttgctttttcaagctcattttctactggcatatcctattcctcctctcttgaaatgtttatcaacttgttgcttgtttctatcactcgtgataaaatcagcttaaaacaaaaaccgttattttacggcatttatggcttttgtttatgttacttaacttgttgacaatcttattatcaatcattcgtgataaattgtcaactgttttttaatcattcgtgataaaaatagtcaaaagaaggtttgattgatatgaaaactgtagacagaattaagaaattatcgaaaaagagaggatggtcactgcaaaaagtagcagaagaagccggtataggaatcaatagtatatatcgttggaactcaaaaactcccagtacacaatctttaaataaagttgctaaggtcctaggagtatctgcagactacttgcttggtgaaactgagaaaaagaaaacagccgatctcgcagataaagatactgtctttacgttcgaagggagggaaattccgcctgaggatttagaatatatgaagcgtttattgcgtggtgatgataaatgatatatcaacaagcagaagaagcatacgattatcttttagaaaaagctgcagaatatcatattgatgttaaatggaaacacttttctccttatactccacctgggagtagttacgaatatcgacgtgtagtaatgaaccttaattggcatcggccgaaagaaattatttttcagtttgcacatgaattagctcacgttattcatggcgatcatggagacgttgtatattatcacgcgtcttttactggtaaagagtcagttgaatataaggcaaatgttggtgctgttgaattactagtccctttttactgtcaagaagtagatagagaatgcgctaatagcgcaaactttatggaagtattcgatgttcccaattatttaacagacgtggttaataagcaaattcatgattactatgtagtttaatgccacgtccaaaaactgatcgacgttaaaagctgaattttatttatattaggaggaatatcacgttggcaaagaaaattagggatgcagaggggaatgtttataaagaagttattgccccagacaagaacaggaaaagaactctcgaaattgttgttggagtaattgcaatgattctttctgttctatttattggtggtagctttggagctgcggctgtagcggatgcttttggtggtgagggttattacaccgccagaatgatgctaggacttattcttgcaatcatttcttttgttttagtatttttcataaacaaaaatcaaaaagttattggttggtcaatcaccattatgggcgcaatcattctgtttatgtgcggtgactatggaattattccgggcattgtctacataattgatggcattttagcattagttagaaaataatttaggaagactcgttacatggctaaaaagattacagataaagatggaaaaacttatgtgcaagtaaaaccatggtacaagcgctggttgatttgggtaattgttgtaattgtcgctttatttttaatcggttcattaactggcaacagtgaaagtaaaagtagctctggatcaggaagtaatactcaaacaacatctccttctagaattactgttgattatgacgattataaagttcagtcttcaaaaacatataaactaaattacagcaatactgattgggataaagctgatgtaaaaatcaataaagttactgtatataaactttccaagccttatgaattcgattcagctagcgatggtaaatatgacattaacggttttattaaattagatatgactattaaagcaaatggtgatatttcaatttatccgcaacaaggtactgccgttattggaagtgaacaagaagatgctgttggtgaatcatgggatggtgatataaacgacggcgtagaaaaatctggagaagtttatattcctatcaaagaccttgatagcccttcaagcatttcagatattagatttaagtttagcgctaacgatcaagatatggatagcgatcatgattacgacttaacattgaatctagataacaattaatatatcttatcaccggcatttgccggatacataatgaccaaaatctgatgtcataaaaaatgaactataaaggagtaagatattatgagatctcgtttacgttacacttcaaaatggatgcaaatatatttggtggtttactttttcgcaatgattgctaacgtacttgttcaacattatttccgtcaatcattatttgctgatatttgtaattattttatcattcctgtttctagcacatttaccttttttgtattgtccttaatggtaaaagaaactgattctctaaataataaagcagataaaatgtccaagcacgactaagaaactagttataaaataaaaagccccctccgaagaaaggactacatcttaggatcagggctgttgagagcttgttcaaggagaaacttgaaatcatcatcatcatttgttaatgcttggtttctagcattctctagcgtaatattcctctgtccaagtattaatacagtttgtaagttcaacttctgccagtaagttaaagagctaagaaaggaatctattggtgaaatgttttgagatttaaaaagcatgactattttcctccaagtttaaaacatatttgtactttctggggaacaataataactataattatagcattatgggctatttcattcttctccaattggaataagttatttttatatttactgctagtagtagttgtattgttatcaattaatttaatttacaattttcatcttgagtatgaaaattttcaacagttaaatgacagttacattgagttaaaagatgaaaataaaaagttaaaagaacgtattgagaaccctaaaccgtcttcctcagattctagactaaattctttagaacatcaaatagctgaactaaataagaaagtttcatctatcgagcaaacaaatgatacctcatcgatgaaattaaaagacaacattacgagatctagtaaaaagaggacaaagtcaacaactatcagaagtaattataatttttctagtacttatatcgtcgataaggacggattagttcattttattaaaggagacaataagaatgacaactagcccaactataaacttcctagcagtaaatactaataaaaataaaaataaaatattaatgagtattactagtgattttctgcccatccaacaaataatccccttaaatgtaggtttgatatatttaaaacctaatacccaatataaaggtaatcttcaaatcaaatgtgatgataaaacaataattaatgatgatagtttactcttcccggaacaagaattgtcttcaagtaacgaaataattaatggccttgtaggagcaacatttaatataaatactcctgttataaatttagcggaaggcgcatacgctctaacactaacactaaaatcagccgatgataaagaacttagtaaaagatcaacatattttttcgctaaacatgagtaattaaatattttgtttagaaggatgtgaacatgaattgattgactccacaacaatcaatcaattcaaacattgatgtcattaaaagacgtgattattagggagtaatttatgaagaaaataggtcttatttgtactgctattattgcatgcatagttctttcaggctgcaataacttagcatcacaagaaatgcacaaaaaaagcgctgaatcatccagcgtgaaaaaacatcatactcatgacgaagatcaagatgatgacttttcattaaatcttgtaagttcagatgatcaagatactgattcgaatgatttagatattaatgttccatcagctaacacttcaactagttcagcatcaaatatccaagtaccccactttaattctaacggtactggttcccctacttctggtggtgatccaaaagttcaagctgaaaccgcaagcatacaacatgattggaacgttaagcaaggcatcgaaaaccctgatggaagcgaaacacaaaatttcaagaattgggtatctaagcgtgaccaagcagaagcaaatgggcaaagcatgccagaatatgatcaaaatcaacgatattaaacgggggaagattaatgaatactgaaagcaataagaaagaaccacaattttggaaaggtgatccttctggtggttttgcgaccggattagtcgccggattcatcatcgggctaatcaatatttgttcattcaatattccttggttgggaagaatctgtttcatagcaatttggctcgtcatgggtacacaaccccgatttaaggacacacgtacaccagaagaaattgctaaagataaagaagaacgagaacaaaagtttgaggaaataagagaacaagctaaagcaagagaagctgaacgtcaagcaaccaaagaacaaaaacgtgaagcaaaaatgcaaaagaatgagctgaaacttcaaaagaaccaacttaagattcagaaacatcaacttaaaaaccgcaataaaataaaatgccccaagtgtagaagtacaaacgtacaacctctcggagttcataagaaaggattttcagttggcaaggccgttggtggcaccattttggttggtggagttggatcacttgctggatttgctggcaaaagctcaaagaaaacagactttgtatgcatgaattgtggaaaacaatttaagaaataaaatcttgtccaaccaaattgatgacattaaaagctatttaatattcaagttttaaaccggtcgaaatcgaccggtttaaaaagcactataaaagaacatatgtacgggaaggactgtttattatgaataaaaatgaactgctggaatatatagatactaactccaccgccattactatcttcaaggataaggtacgtacagaacaagaagccaaaaataaaaagcgccaacctgctaaacgctggaatgacgctaaaatcgaacgcactgtagataaatttactgatgatttcatcagtaatgtttacgacaagttatataaaggggtgaaagccaatagaaatacaccaagaaataaatggattgagtttatcgaaactaacgaaatccttgatagtttagaagaatcagtaagtatgatggagattggagaagattaattatgtggatgcaagaacgcaatggaaaattccgcttctttgagcaatataaagatcctctaactaataagactaaaatcatcagtattacaatgaaagatcataaaaagagtactgctaagcaagctcaaattattctagataatcgcatatccaaagctttatcaaaagtcggtatcggaaaaataattcatggaattacactcaaacagttacttgatgaatatactgaatatgaaaagccacgaattaggagatcaacgtattatagccatcaaacaatggttaatactttactagatatttttggcaacgatgccttagttgaaaaatttaccccgcttatcattactgaaaaactagaaagtctaatgtatggggatagagagttgtccagtggctatgtatcacgatataagtactatctgcataagttatttgattatgcagtaaaacactcatatacaaaagataacccggttgataacgttaaaattgattataaggcccctgctaatggccaacaaattaaagacaagttcctcgaagctgatgaactgaaagccgtcctcaactatctatataacaatactcggatctacggagaactttgcgaatggttatatctcaccgggctacgttttggcgaagcagccgctttaagttttgatgatgtttaccaaaaggacaaccattggtttgtagatataaccggtacattagagtataaacgaattaaaatcaaagaacaaaaaaagagtgacgcacctaaaacatcatcctcagtccgtagtgttgtactaccaaagaaagccgttcaaatttatcttgatctgaagaaaaaatctaatggcaaaggttttatcttcgcaactgaaaatggcacaccgattcaaactgcctcagtaaatactgttttaagatcagcaaagaagaaacttaaacttaataaaccactaagtactcatgtatttagacatactcatatttcaaaaatggctgagttaggaattccgctatatgtaatccaacaacgagttggtcactccagtagtaagattacctcccagatatatcttcatgtgacacaaaaagcaattgaaaaggaagcgtcaaaacttgatgaactgtaaaaaacctaccaaaaacctaccatttactttaaaaaattatttttactctttcttttttcttaaaaaagaattttaaaacaaaaaagaacccttgatacacaagggttctgcactactagttgtcgcgacgacgttcagcgatacgagtagccttaccagtacgttcacgtaagtagtaaagcttagcacgacgtacacgaccgtaacgaagaacatcaatcttgtcaacacgtggtgagtgaactgggaaagtacgttcaacacctacaccgttactgatcttacgtacagtgtaagtagcactgataccagcaccgtggcgcttgataacaacaccttcgaacatctggatacgttcacgtgaaccttcaacaatccgagcgtgaacacgaatagtatcaccggcacggaattctggaatatcatcccgtaattgactagcagtaatcttttcgattaacttgttttgacgcataatatatttctttcctttcgccgacattcatgtcctgtatgacgggcagcggaataccgttattcacagctaaacagccaataactactatacattgttttcagctgtctttcaagggtaaattagtggttttctttattaatgattgaatgacgaattccatagataaagtaaattaacaaaccgatcacgaaccaaccaaccattaaaatttttgcatcagtatttaggccccagaagatcacggccgaaaagatcgccgaaattgctggaagtactggatataacggcatcttgaactgagcttcaggcaaatctaccccttcccgcggacgcaaggcataaattcccagagaaacaaagataaatgcgaccagggttcccgcagaaacaagggttgctaagaacgtaaatgggaaaacagaacccaagatcatagccaagaaagtaatcatccataatgcgtgattagggacgtgcttatcatcgatttggccgagtgattttggtagtaacccatcccgtccaaaagcataaattagtcgagaggaagctaaaaggattgcgattaacgcagagaaaataccaacaatcgctacaacggaaagcaagttcgccgtaatatagtgtccagactgtcttaaagcccaggctgctggttctgcattatttgcataacggctatatttaaacatccccactaatacgagcgaaaccgcaataaaaaagcctgttcctagtaatagtgtcccgatcaatcctcgtggcattgtcttttgcgggttaatcgtttcagctgtattagccgcaatcgcatcaaagccgacataggcaataaagatttgtgcagtcccagctaatattccctgccagccccaaaagtggtacctggttgatgagcagggagaaatgggacatagttttgcggatggattgcagttacgcccacaacaataaacattaaaattactaataactttacactaacaataatattttcaatccggctaacctgatggacaccgcgggaaattaaaactccaacaattagaattgcaaaggcggccagaatatcaatataagaccctgtatgtggatcaaaaccaccagttaaggcatgcggtaatttaatcccaaaactcccaagaaatccttgcatataggctgaccacccagacgcaacaaaagcgactgaaataaaatactcagctaaaagggcccagccagcaatccaaccaaagaattcaccaaacaaaacattgatccaggaaaaagcggaaccagcaaaaggcaggactgaggacgtttctgcataggctaatgccgataatcctgcgccaattgcagctacaatgaaggctaatggaactgcaggaccagtatgctcagctgccacaatccctggcaaagtaaagatagccgttcccactaccatcccagttcctaatccaattaagtctcttgttcgcaaactaggggttaattgtgcatccttttcttcataaacgcgggggttctgcttaagaaataatcgtttaattaattttttcattcgggtcaccttagtctggaacagttggatcttcatccagcttaatatcttctaacattaattgctgttcccgacttagcttagcagtttttaaaagatctggtcggcggtgaagagtccgtcgtagcgattcacgcatccgccattctttaattttctgatgattaccactcgtaagaacttccggtactttcatcccccgaaaatctgctggacgtgtatattgaggatattctagtaaaccgttactaaatgaatctcccattggtgaagacatgttgccgaggacaccaggaacaaagcggacagtcgcatcaatcatcaccatcgctgctaattccccgcctgttaacacatagtcgccaagagacgcttcatcggtaactaaattacggattcgttcatcatatccctcataatgaccgcagataaatgttaagtggtcttcctgggctaactctttggcataggcttgatcaaactttcgaccagcgggatccattaaaataacccgtccctttgaatactgatctttagtttgttcatgaattgcatccatagcgtcaaaaattggttgcgcttgaaggagcatccccgctcccccaccaaatggcgcatcgtcaacatggttatgcttatcggtagtatattgacgaaaatcggtcacattaatatcgataaatccattatcttgcgccttaccgataatggattcccccattgttgcttgaaacatattgggaataagcttaaaatatcaatcctcattattcaagtccttccattaattcgactgttacaagatttttatcaaggtcaacgtttttaacaacatcatcaatcactggtaataataactctcttttttctggacgttcaacaacccacacatcattcgcaccaggagataaaatttccttaattttccccagatgacgaccatctgttgtttcaacgtctaatccaataatctggtggtagtaatattgaccatcgtctaatggctgttgatcatcagcactgaccattaattcatgatcacggaattgttcaacaccattaatattatcgtagccgacaaacttaacaagaacaaatcccttatgttgccgcgtactttcaatcgtcaatggtaaaggctcacctgattgttgtaggtacaaggtatttcccttggcaaatcgttcatcaataaaatcagtagttgctaatacgcgcacttctccgcgaacaccatgagtatttacaattttaccaacattataatattccataaattcctcctgaaaagacaaaaactcccacagattagtgtgggagttttaaatttagtgacgatggtcattaattaataaccggactcgcttagagttagcccgtcgagattgagtaccctcgactattgttcgcaatgctgcggcaacgtgtccctgtcgaccaattagacggccaacatcattgggagcaacatcaattatataacgatggtaacgtccatcatctttttgggtaactgacaatgcctgtggctgcttcaatagcggaataactaaactacgaattaacgactcaatatctgtctcagccatgactgattatcactacttcttagcgtactttgcttcgtggtacttcttcataacgccagctgcttgaagcatgttacgaacagtatctgaaggttgagcacccttttgtaaccattccataacagcgtcttcatcaaacttgacttccttaggagtagtcaatgggttgtaagtacctactgaagtaataaaacgaccatcacgtggggcacgtgagtcagctacaacgatccggtagaatggacgcttctttgaacccatgcgctttaaacgaattttaacagacattctttgcacctccctgatttcttttaacagataataatataccagtgttcaaatagaatgtaaagtattttttcttgacaggcttaaattttttgaaattattttttctttcgtaatttacgaagctttttaatgcgtttttgcttgtcttttttcattttgcgcgccatgcggttcattgccatttgtcccatcttgccacctggcatttgtccaccaaacatattttgcattccattgaaattaccgtttgtaacctgcttcatcatcttacgcatttgattaaattgcttaatcatccggttaacttcaacaattggccgtcccgcaccagctgctaaacgacgacgacgactaggattcattagatcagggttttcacgttcttctggcgtcattgaaagaacaatggcccggatatgagcaaattgcttaggatccaaattaagattcttcaaggcaggattattagccatccctggcatcatcttaataatattttccaatggtcccatcttggtaacctgatccatttgtgccaagaaatcattgtagtcaaatgtgttttcacgcattttatccattgtttcttgagcttgctcttcatcaaaattcttctgggctttttcaattagggtcatcatgtcccccatacccagaatccgtgaagccatccggtcagggtgaaagacatcaagatcctccatcttttccccttcaccgacaaacttaatcggcttacctgtgactgcccggattgacatggcggccccaccacgggtatcaccatctaacttggttaaaacaaccccagtaatgttaagcttatcatcgaagccttgagctgtatttactgcgttttgaccagtcatcgaatcaataacaagcaaaatttcatttggatttactagttctttaatgtttgcaagctcatccattaattgttcatcaatctgaagccgaccagcagtatcaataatgacataatcattatgatttttcttggctacttccatcccttcgcgaacaatttccaccgggtcaacatctgtccccttttcaaaaacaggaacatcgatctggtcagcaacttgttgtaactgagtaatagcggcgggacggtaaacgtcggcagcaataaacattggccgcgcatgattttcattctttaatcgtaatgccaatttaccggcagtggtcgtcttacctgccccttgaagaccaaccatcatgataacagttggaatgtgcggtgctttgttaagaggaactgcttcttcccccatcagttttgtcaattcatcattaacaattttaacgatttgttgggctggatttaaccctttcagtacttccgctccggctgctttttcccgaacggtctttacaaagtcttttacaactttaaagttaacatcggcctctaaaagggcgagccgaatctcacgcatcgtttcccgaagatcagcttccgtaactttgggcttgcgtcgtaatttttccatcgccttttgcagacgatctgttaaaccttcaaatgccattttattcttcctccaagctttccagatgatttactaagtgattgagcgttgcatcgtctggatagttttctcggacgtatcgttgaattcgatccgcctgttgattacgaacttgaaattcagcatacaaatgcaatttggcctcgtaatcttctaatatgctttctgtgcgctttatattatcatatacggcttgacgactaacatggaaattctcggcaatttcgcccaatgagtagtcatccccgtaataaagctctaaataatcattttgttttttggttaataagggttggtaaaactcaaataatgaatttatccgataattcttttcaatttccatatcgtcatacctgcctagtcaacttcgactaatcccttgaacaggccataaacaaagtcgccagcatcaaacttctggaggtcatctaccttttcaccgagccccacatacttaaccggtaagtggagttcattacggatagcaaggacaattcccccacgagcagttccgtctagttttgttaaaacaatccctgttacatcggtactttccttaaatagtttagcctgattaagagcgttttgaccagttgttgcatccaagactaacaatacttcatgaggagcatctggaatttcacgagtaagaatgcgtttcatcttagctaactcattcatcaagttaaccttgttttggagccgaccagcagtatcaacgaacaagatatcatagttttcatcttttgcccgttttactgcatcaaagacgacagccgctggatcaccgttttctggtccggtaacgatgtcaacaccatcacgttttgcccatacatctaattgctcagtggcccccgcccggaacgtatcagcagccgctagaagaactttcttaccttgcttcttaaagagggcggccatcttaccaattgttgttgtctttccggctccattaacaccgacaaacataataacagttggtccttcttttgccatggttaagtcaggattttcgtcttgaccagctttatcgtaaagttcgaccattttttcaataatgacgttggaaacatcctgcttgctcttagcgttttgcagttttacttcttctcgcaattcatcactgagcttcattgccatatcatagccgacatcagattcaattaacatatcttcaagatcatcaaagaagtcttcatcaacatgccggaaattagccaagaacttatttaaccgtgccccgaagcctgtccgggacttctcaagcccgcgatcgtatttcttaactgtttcagattcttgatcctcttctggttcaggagaaggttgttgctcctgctcctcatcaccatcattttcttcagaattatcagtctcatttgattcttcagtagctgaggaatcttctgccacttcttctttagttggcattactggttcttcaactgttttttcttcttctgcaacgggttcggtcggttcaacggctgtttcagtttcagcagaattagaagatggttcttctgcagaaatagtttcttccggagtactagacgacggtacttctttttcagaaacacttgaggccgctatctcttctgagtgacttttctcgctagtatactcttctttttcttctttaaccctgttatgaagtatttcgtgagttccatccgggttaatcttttcctcatagctatcggcaggaggaatatttaccgtttccggatgaattggtgcagaagctggtgtcgcactcgtcgtatctgctgcttcatcttcatgtgcggtttcagattgaacaactgcgcttgaactatcaggcgttttttcctcttcttttttcttatgacggcgaaaaatatcaaataatcccatacttgaagcctcctaaattagttaattgtcactctcttgtaaagtatcaacaacgtccactgataccatctttgaaactcctgattcttgcattgtaaccccgtacagtacatcagcgtccatcattgttcccttgcggtgggtaatgacgataaattgtggaccttcagtaccaaatttgctgaggtagtgtgcaaaacgttgtacattgacctcatccaaggctgcctctggttcatcaagaattgcaaatggaactgggcggacttttaaaatagcgaatagtaaggtaatcgccgttaatgctcgctccccaccggataacaatgaaagatgttgatttttctttcccggtggctgggccataatatcgactccggttgttaataagtcatgaggatcggttaagacgagtttagcatgaccaccagagaaaatttgttggaacgtctcatcaaacttttgtgaaacctgattaaaggttgtaataaaccgtttcttgacttgggcatccatctcacccatcgtctgattaagctgagctcgagaggcgagcaagtcgtcttgttgtcccttcaagaaatcgtaccgttcacgaacacgctcatattcttcaatcgctccaacattaacttgaccaagatcatccaatccccgctttaatagcttcaaccgggtcgctaaggtctcttcgtccaagtcactcatctgttggcgagcttcatcaatggtcatggaatattgctcagataatcgattaagagcttgctcaaccattgattcatacttcacgcgctcttcatttaagttattacgatcatcaagggctgcccgctgaagttcttgcagacgattataatgtgcttcggcttgtgacagcttttgctcaagttcttcaagagcaactgaattatcttccagttgcaccttagcttttgcctgctcttctttagcatcttttaaggctgtctgtgtcgatttttcacttgttgattgactagctgattgagtcgttaactcagcgattgcaaccgtgaccttttctaaactctcctcagcttctcgccgttgacggttatactcttgactttggcgttgatattgttgaagtcgttcttcggccactgcaattttttgttgcatttgtgctaattgtcgtgcctgagtcgacgcatcattctgtaattcatcgatctgggtaagaatttgcttaatctttgccacaacttgcgtcaatttctggtttactttatcagcttgttcattattttgttgaacttgtgattcgtaatcctgatgttgagtgtcttgctgtttattttgggtttctaaaatctgtacccgattagtaagcgtctcatgcttacttgagatcaactggcaattactttcttgctcatgaaacttatcttgtaaagtctgaacttgttgctgataatcagctactacttgttcgttcgctttttgcgcttgttgtagtttagcaatttcttgctctaagtttgctgcaagctgttcctgtttttttagctcttcttctagttgcttagccatttgcttttgacttaaaagtcctgttcgttgactacgggtggctcccccagtcatcgctccactagcattgatcaactgaccgtcaagagttaccacccgtaccatatgacgacctgcacgagcaatctcagtggcatgatcaaggttgtcagcaataaccgttgttcctagtaagtggtcagcaataatctgaaacttttgatcaaacttaataagttctgttgctcgacccaaaaagccagggagaccagttagttgtggccaaatgtttaatggtcgccggtggctaagcgtatcaagcggcaaaatagttactcggccagcgcgagtcttaatcaagaagttaataattgctttggcagtagcttgccggtcaacaaccaattgctgaagctggcttcctaatactgtttcaaccgcttgcgtgtacttggcaggaacatcaaataattcactgactgctcccgccaatccaggaaattgctgccgttgccgaaggacttcttgaactccccggtaatagccgctatattcatcggccattgactgataagcgttaattcgcgacttaagcgaccgtacatctcctaatgctgcataccaatcacgttgttttgtttggtacccgtaattaagtttttcacggtgatcttgagctgcttttagtttttcactgacagtctgtaggcttcccttagtaatggctgcttcttgttggtagcggtcatattcttgattaatttctgcaagctggttcttagtagcgtcaagttcctcgacattctgacgttgaagactcatcgcctgttcatgattacgtgacaagaaagattgctgattatgaatcgttgttctttcctgcatcaagctaacttgttggttacgtaaatcctccacttgctgttttagggtcgcgatccgctcactgctactcatctttctggctgtttcaaactcagcttgctgaccattaatcaacgctttttgttcagccaattgctcgtcatttgcctgttggtttgccttaacctcttttaaacgtgcattgagttcagcctgttgggtagttaaccgccgttgctcattttcacgttgttcacgacgaacactagaaacagattgctgattctcatacttagcaattgcctctgtctgatttaagataatcgcttggagacgatctttagttgcgtttagttgttgacgcttttgcttcaaattatcaagctgttgctgatcgcggtctgcttgtccttgatagtcccttaccatcgcttctgcttgatcgagcttggcacctaatttggttaacttttcatagtactcgtcataatgacgaaccgtttgtgtccgatcaagcacatcaaattgtttcttttgttccaagtaatcttgggcaattgcactttgctcttctaaaggttcgatctgcttttctaactcactaataatgtcatttacccggttaaggttttccatcgtcgtagtaagtcgcttttcagctgtttctttattcttcttatacttggcaactcccgcaacggtttcaatgattccccgccgatcaattggtttaccgttaaaaatttcttcaatccgtccctgggaaataatggaaaaggattctcgacctaaaccagaatcaatgaataagtctgtaatgtcctttaagcggacgttttggtcattgattaagtactcactatcaccattgcggtatattttacgagtaatggtaagctcagtaaattcactagctaagtaatgatcgctattatctagcgtaatcgaaactagggctcggtttaaaggtttacgatctgatgacccattaaagataacatcagccatccgatctccccgtaaatgatgagccgactgttcgcccattacccattgaatagcttcaataatattactctttccactaccattcggaccaacaatccctgtcattccgggctcaaatttaattgttgttttttgggcaaaggatttaaagccgtccaaagttaaagacaataattgcatcagttattcctacttactatttatttttatttctcatattatcaagtgcctgttgtgctgcttgcatttcagcatgcttctttgatgagccctttccttcaccgataacgtcaccgttagcagtaacatttactttaaattcagggtcattttctgttccgctttcctccaccaaatgatattcaatggcaatgtcaccgtcacgttggagaaattcctgaagactagtcttggcatcaacagcatgatcaaaccagcccatatcaagtttaggaaagataacccgttggacaaatttttcgactgctggtcggccttgatctaaatagagggcaccaataaatgattcaaaaatatcacatagcaagcctggccgttctcttgcgccggccatttcctcaccatgacccaagcgaatatattgatcaaaatgacattccttggcaaatttagaaaaactatcttcacataccattgccgctcttaagcgagtaagttttccctgcggcaattcagggaaacgtttatatatatattctgaaacgatcagttccaacacagcatcgccaagaaattcaatccgttcgtaatattttaatccttggttaggatgttcatttacatacgaagcttgagtaaaagcttctgctaataaagcaggattatcaaaatgaatattaaattccttggccaggtagtcttgtaattctttgatcataaaaaattcctttcgtttttgacttaaaattattaaaaatgtctaaggcctattatactaaataacccgctattccgcaggtaattttaataatattcgaaaaaattaaaggctgtgaaaaaactttcgccttttctcagccccttacttttctaccttaataaaataattaaacggtttgattagttggcagtatgttctgcaatgtaatcaacaacttcaccgattgtacttaacttttcagcatcttcatcattaatttcttcgccaaacgtatcctctaattcgagaacaaattcaacaaagtcaattgaatcagcatccaaatctgtctttaagttcaaatcatcagtaatcttagcccgatcaacatcaaaatggtcagcaacaatctctgaaaccttattaaagatttctgttttcttattatcagccattattattaacctctctttactagttcgctacttattctattcgtttttcttagaattgtctagattttcggtgttatcaaaaaattcaactgttttttcaatcacacccgttttgatcatcgttctgatttgactaattgtatttttcactgctaaagcatcagcagatccatgagtcttaacaacgggggccttaagtcctaataagactgccccaccataagttgaagcactcattttttgcccgatttgatggaaaacgggctttagcataagataacctaacttagcacggagaccaccatgtaagattccatctttaattaacgtcatcatcatcttagcggttccttcagtcgctttcaaggccgcatttgccgtccacccatcacttacgacaacatctgccttgccaaacaggaggtcgccagactcaatattgccgacaaaattcaaatcgtctttgctattgaggatttgccatacttctttatgtaatttgtcacccttatcttcttctgccccattgtttaatagcgcaatccgaggattcgcaactcccaatacattttcggcatagaatttaccaaggtaagcatattgttccaaatttttctctttactttcagcatttgcaccagtatcgaggtagacaaaattatgtcgactagcacccggcttggcaattggcaaaatactagtgagtcccggacggtcaattcctttaatacggccaacaatgaagaggccggccgccaaaattgccccagtgtttcccgcagaaaagaaggcatcagcttttccttctttaactgctgttgccgcgcgaacaattgacgaatctttttttcgtcgaatcgcccggactggttcttcacccattgaaatctcttcactggtagcaacaatattaagccgctcattattttttattaagggtttaaccttgtctggatttccataaaggtcaaattctaggtcggggtaaaggtctcgggcctcttctaccccttcaatgattacttggggagcattatctccacccattgcatcaacagcaattttcataaaatttcctcctcatattagtcaaagtgcgtctccagttcatgacgctttaaatataaaacaagtggctgattttcattgacctgatcccaattgggcatccctaataggttcccagcatcagcacgggcaatttgcagcattttcaaatcagcaaccggatcacccactttaaattctggcatccccgattgcttttttcctaaaatatctccagatccccgtagtttcaagtcttgttcagctatcttaaatccatcatcggtagcaaccatcgttttcatccgggcttttccttcatcagttttcggatcggcaattaagagacaataactttgtcgactgcctcgaccaacccgaccacgtaattggtgaagctgtgcaagcccaaaacgatcagcatcatatataaccattaccgttgcattaggattatcaacaccaacttcaataaccgtggttgcaactaaaacttgaagctcaccagatttaaactggcgcatcgcttcatctttttcttccgtccccattcgtccatggagtaagcccactttataagctggctcaagatcggccgatagctgattataaagatcagtcgcgttttgtacatctagagccgctgattcctcaatcaaaggactcacaacatacgcctgtgctccttgctttaattgttcacgtaagaaatggattgctgcggcatgttggttagactgcagccactttgtttgaattggttttcgaccagccggtaattggtcaattatcgaaacatccatttcaccataattagtaatcgctagtgtccgtgggataggggtcgctgtcatggctaatacatcaggatgttcgcctttttcacgaagttgctgacgctggttgaccccaaagcgatgctgttcatcagtaattaccagaccaagattagcatactcaactccatcttgaattagcgcatgggttccgacaatgaggttgacatccccccgcttcatcgccgtcaatagttcccgatgttgcttagcagtcaatgaaccagtcagaagagcaacctggacatgggttccttcaaaaattttcgctaatttctcagcatgttgtcctgccagaatttctgtcggcgccattaaagctgcttgataaccggcagtaatagctgcataaatggcaatagcagcaacaattgtctttccagaaccaacatctccctgtaacaatcgattcatctggtatggttgacgcatatcacggcaaatttcattaacaacccgtttttgggcatcagttaattcaaatgggattccgccaataaattcttttaactcgtcattatggtataaaatccgctcgccatcttcttgacggtgggcacggcgaattgcttgcagtcgtaactgaaacaggaaaaactcttcgtaagctgctgttcggcgggcggcttttgcagttgcctgagtttgtggaaagtgaatttccctaatcatttgtcgccgatccattaaccggtatcgttgacgaatcgtttctggcaaatatgttggaatgatattggcatattcctcgtaagcttgacgaataaaactttggaggacattttgccggatatgcttattcaccgcatagaccgcaccaaactcatttcgatcatcagctttttccttaagaaacttgtttcctgttacttgacggcgagatgcatcccatttccccattacagttacttgctgatttagttcgatttgctttttaatatagggctgattaaaaaaagttgcgatcaccacttcattacctacctgcattcgaaaggtaagccggttgcgccgataaccatagcggaccaagagcggttctgacactactactccttgaagagtaattttctgtttatccttggcgctttcaatgtctgtaggcgtgaaatcgttatagcgagtgggataatacgtcaacaaatcttcaatagtatctattcccagagtagctagatctgctacccgcttaggaccaactccttttaaattggcgacggaatccgttaaactccgcaaatctttcacctcttttttaacacaaccagtaaccaaaataggagtgggaataaaagtagtcctttattaacccacccctataggaattaatttaatgtgccgctattcaaccgaaatcaggtatggataaactggctgaccaccatcgtaaatctgaatatctaattcatcatctacttcttcaactgctgctttaatctcttcagcagttttttgatcaccaccagctccatataagatcgttacaatttcactatcctcgtcaagcatggctttaaccatcttaatagcggcttctttcagctccaaatcagtagtgacgattttaccatcaacaattcccatgtagtcatctttcttaatttcacgaccatcaattgttgtatcacgaacagcattagtaaccgctccactggcaaccgtatttgtattagcttccatatttgcttgattttcgtccaaagatgcttctgggttgtactcaagcaacgcactcatcgcttgggcaatcgtcttactgtggacaatttttgttggaatatcagcaacttcagcagcttgatcagcagtcataaagatgttgccgttatttggcagaacaatagcttgcttggcaccactattattaatggcatcaagaatatcttgagtgcttgggttcattgtttgaccacctgtaatgatatgggtaacacccaagctctttaataatttcgctattccttctcctgatgcgacggcaataacagctgtctggaggtcctttttagcttctgcagctgcttttgccttctcaattggcgactcactgtcagcgtcttcttcatctttttccatgatctcttcttgttgccaaaccatgttatgaatttcaattgtctgtaaatcaccgaattgttgaccccaagataaaactttaccaggatgctcggtatgaacatggacccgcacaacttgatcatcgtttagaacaagtaaactatcgcctaagtcagctaagtagttatagaaagtatcatagtcaaacttttgagtcacttgtttacccttaccaagtcgtaccaacatttgagtacagtaagtatacttgatatcttcaggattaagctttccttgaacgctttggtgatccatggcgtgaaccatctcatcaatttcagcattgtcaggtttatagtcatcacttttatctacgcggccactcaaggcttcatcaaaggcttgaagtacaaagacgagtccttgcccaccagaatctaccacgccaacttctttcaggactggcaataaatccggcgtctttttaagcgcttcttcacctgcttcataaatagtatgcataatctcaacaagatcatcagtctctttaatcttattgaggcctgcttgagctgattcacgaacaacagttaaaatggtaccttctgttggcttcatcacagccttgtaagctgtctttgcaccattagcataagcattaacaaagtcagcagtagataaaacatccatgccttctgttgcctttgcaaagccacggaaaatctgcgataaaataaccccagaatttccgcgtgctcccatcaaaaggccctttgctaacgctgcactcaggtcgccaactctcttactggtttcgttgcgttcgtacttggcaccgcttgccattgaagaagtcatgtttgtcccggtgtctccatctggaactggaaaaacatttaatgaattaataaattcagcgttcttaccaagtttatcggcggccgcctggaccattttaccgaattcaaggtttgtaatttttgttacagccaattcgaaattcctccccaatgctcgcttaatcttctagtgtccgcacaccttggacacatacattaactgaatttgccgtaataccgagcattgtttcaagattatactttacctttgcttggacactttttgatacttctgagatctttgtgccatagcctacaataatatttacgtcaacagctacaccattatcttgctgccgaacaacaacgccgcgcgcaaaattttcacgacgaagaatttggttaaccccatcacggagggggtttcggcttgccattccaacaacaccgtagttatcagtagcagccccaccaacaactgatgaaatcacatcattatcaatgtcaattgtacctgacttagttttgatttttactgccatcgtcatggcctccttataaaattaccaattgattttagaatcctatgatactaaaattcacaattaaatcaataccatcataccatagcatatttcactaaaaaagtaactgatggatatttttgcagtcgatcaatggggttaatcaattaacgtaaaaaataagccgcccaaactggacggcatcattttaattaaacccgagtcactttacctgacttcagtgtacgtgctgaaacgtataccttcttaggcttaccattaactaaaatggttaccttttgcaagttaggcttccagctacgccgacttgagttaagggcgtgagaacgcttattaccaaattgcgtccgtttaccgttgataaaatctttagccattggtgataccctcctctttgcttcataattttttcgtttacgcaaaactgcgatgtaactcacctaattaatctaccataggcatcgtaacaatgcaatagttttctttcaagtaattttccttgacagggtattttcccctcaaaaacctattttaattggtcgctacactgaattacagaaataattccactttcaaatgaaaaatgattttcttcagctgtaaattcattgcttgtccacgaaaatagaatttgactactccagttttgcagtggatatttttcgtcttttaacgtaaggcctcgaacaggagtaagattgacaaaggccaggtacttcttatgcggcaggcgagaaatagtgtaatcccctggcaagtagtaagagacaacattttgacagtcaataatcttaatcttggttaagtatggtttaaattcactctgcaacggaagaaagaggttagctaataaatgatctaagcgtcctcccgttgcaccaaaaatttcaatttcatcagcctgttcttggattgcaaatttcacgcccaattgcgtatcagtataatctttttcaggaggataagtttttatacgagtaattttaccttctaaaccttgcaattcctccccggtaacggaatcaaagtcaccaattgctaaaaccggcttaattccccaccttaataatcttaaagccccccggtcaaccccaatccatttttcatctttacgttgcaaaatcaactcggttggaaccatttcaagcggaccgccaactagtatatttactctcattttttactcctaaaaaaatggatcttcaatattcagacaaatccgaactagaagatccatttttgttttttacttaatgtgactaattacttagtagcatcttcaagagccttgattcgttcagcaggatcttcagcgttaaagacatatgaacctgcaactgctactgtagcaccggctttgtagcaatcgacaactgtcttatcgttaactccaccgtctacttcaatatcgaaattatagcccttttcttctttaattgcgtttaattgggcaatcttgtcaacggtttccggtaagaacttttgaccaccaaatccagggttaacagtcattaccaagacttggtcaaccatgtgtaatactggttcaatcatcgctactggtgtacctggattaataacaacttcggcttttacgccaccgtttttgataatttgaagagcacggtgaatgtgttgagtagcttctacttgaacaccaataatatcagcgccagcatcaatgaacattggtaaaatatgttctggactttcaaccatcaagtgcacatccaataccatgtttgtaattggacgaatagccttaacaaaacctggtccgtaagaaatacttggaacaaaggtgccatccataacatcaatgtgtaagtatggtgcaccggccttttctaccttttcaatgtccttttgtaaatttacataatctgcacttaaaattgatggtgcaactttaatcatcctgattccctcatttcttataatttggtttttgattagcaatcaattcatggaactgaagataatcatcataccgactcttcatgattataccattgtttaccgcttccttcacagcacattgtggttcttttatgtgaaggcaaccccgaaacttacaatcagctgaaattttagccatttcagggaataaatgcggcaaatcatttaccgtcatatcaaatgtttcgtacgatgaaaaacctggggtatcggctatcagagcaccgttaacatctagtaaacttacttttcttgttgtatgccgtccccgttgaagcgcttgggaaatttcaccagtcgctaattttaattggggagccaaatgattaagcaaggttgacttccctgctcctgtctgccccatcattgttacaatatttccctttaattcttccatcaaacttactaattgatcagggttaaagggctcacgggccgcataaacatggtagccaattttacgatagccctcgatcgttggtaaaagttgttggtactcatcatctgtcagtaagtcagtctttgaaaaataaattaaaggagtaacatcttgggcttctaaagcaatcaattgacgatctaaaaggttagcggaaaatgctggttctttagctgaggttacgacaactgccatatcaacattagcaacaggtggccgcaccaactgattgcgacgaggcaagatttttaataaatacccttcctgttgattttcagcactgaattcaacatgatcgccaactactggcttgatctttcgttgacgaaagtttccacgcgcccttgtccgataaatcttttcatctgcaattacatcataaaagccacttaatgattgttggattattcctattttcaaactgcacctccattatccagtaatatttgttgcactcataatcgttcgtccattgcgaacaacacggtatgcacctgtttgtccttgtttaagggtaaatggcacattaattgttgtttcctgattaattgtaatatcttgatactccattgttaaattatggttggcatctctgatatatacctgtacacggttttcacgctggccaccatttccatcgaatggaatgttaatctgaatattcgtcgtctttgtttgattaccagaattagcaatggaaaccgttaacgtatcaccatgatttaatgtcgatccggctcgcggcgtctgattaatcacatggttagtcgcgattgtttttgattttttctcttgagttgtcaattgcaaattatttttatttgcaaactgttgcacagcactaatatcttgattcttaaagtttggaatcttaattggttctttccctgcgcttacccgaaaaataattgtgttagcagcaggcttaacaatcgtaccttttttgtggttttgtctgataatctgtcccttatcgatatcatccgaatacactggttcttgatgaacttgaaatcccttgcgacgaaggttagcggctactgaagaatagtcctcaccaacataatcagccatttgcaattgcttaactcctgtactaaccgttaaattaattggggtactaacacgggtcttatggctgacgtcaggattagttgaaacaattcggtttttatcaaccgcctgactatttactcgagtaatcttaccaatccgtaagttttgctggtgcaatcgttgttctgcctttagcactgtcattccttctacatcggggatgattacttgacggatcaagaaccaccagctacagactgcaatcagcacaatcatgccaagcgttccactaacaatcccatattttttccacttttgcggtttagttgatggatcaacggttggtgaatcagttgacttctttggttggtaatcatcagcttttaggtgtttaatatctaacaccttagtttctccattatcatcttgttggatctttaaccgcggctcattagctctttgtggatcaaggacggttttcaaatcagccgccatttcatcaactgaactataccgctcagctggttcctttgctgtcgctttaatgattacgttttcgagtgcttgaggaatttctttattctgttcacgaacagaaggtatttcttcgcggaaatgcttcaaggcaattgagacagccgtttctccttcaaacggaacctttcctgttagaagttcaaacaagataattcctagtgaataaatatctgattgtttagtagcaatgcttcctcgcgcttgttccggggataggtagtgaactgaccccatcaaggtattagtctgcgttaatgagtcttgcgatacagcaaccgcaattccaaaatcagtaattttaacgtttttattttcatcaattaagatattttgtggttttaagtcccggtgaataatcccatgagcatgggcggtcgcaactgctgaaagcacctgttccataatatcaataacttgtggaagtggaatcggatagtgcttttttatatatgctttaaggtctgtcccctttacatattgcattaccatgtattgcaagccatgatcctcatcaacgtcataaattccaacaatatgaggatcatttaattgcgttgcggccattgcctcccggtgaaatcgccgtttagtacttggatcgtcccgtaagtcaagacgcaatagtttaacagaaacgtctcgatcaagaaccatatcatgtgccaagtagacattagccattccaccttcacccagtgaccgaattatccgatatcggtgaccaatttcatatccaggattcatttcctatccctcctggttactattaatcccaattaaaacggtaatattatctggtccgccggcatcatttgccatttttataagttgagcacatttctcttcaagcggtctcggcaattcaatcaccttgataatccgctccttagaaacagtcttaaacaagccatcagaacacattaacagttgatcaccttcatttaattcaaagcggtttacatcaacttgtgcatcctgtgagattccaattgcccttgtaattatattgctctggggtagctttagtgcttcatcttctgatatatctcccgtttttaccaattcattaaccaatgaatggtctactgtaatctgcgttaataggttttgatgaaggatatatcctcgactatcaccaatgttagcaaccacaaccgcatccttaaatgcaatagcggcaaccattgttgttcccatcccctgcaagcgaagattacgtttggattgcgctaagattttattattgattaattgggtttcacgagcaaaccagcggatcccttccatcgaagtctgcggaggcctttttttaaactgactccccaaagtcgcaactgtttgctctgcagcgatatctccgctacgattgccaccaattccatcagcaataaccattaattgattgcctagcttgttagtaaacacagcaacccggtcctggttttgctttcgttggtggccgatatctgtttgataagcagctttcattaatttattatattcccttcttaaggctactgacgaagaagccatcagaatcaaaatcactcggtaatatagttaaggttggtgagtgacgattatccttaacttttcgtgcagttgttgtttttactaactcaaactccggatgttcagctagaaacgcttgaacagtatcatcattttcttgctgtaaaattgtgcacgtgctgtatgtgattataccgccttttttaacttttgcggcaaccgcatttaaaattgctaactgaatcttatgtaattgcttgctatcatttagcgtttttgtataacgaatttctggcttccggcgtaaaagtccaatcccactacaaggcgcgtcaactaagaccttgtcaaaactttcatcatcaaaaagttgatcaacttcccgtgcgtcaagggcatgagcagtaactcgcttttcaacccccagtcgacgagcattcttttcaatcaatctaaccttatgttggtgaatatcaagtgcatcaacgtggccgtcttcattagtgagggcttctgctatttgaacagtctttccacccggagctgcacaagcgtccaggactttatcccctggctcaatatgcatgctttccacggctaacatggcactttcgtcttgaatagtaatttcgccatttttgaagagatcggaactgataatttcacctttagtaattactaaagcattttgcgcaacttgactttcttgatattcaattccagcagcatctaaagtttgtttgacggtcggaaggtcagttttgacgatgttaactctaattacctgatgagccggctcattaattgattgaagtactttttcagtattttcttcgccatattccctagtcagctcgttgactagccaccgtgggacactattttcgatacttaaccgcaaatcacgttcatcaatttgccgcaggtcaggtaatcctttccgcaaaatggcatgtaaaacgccagtgacaaactttcgaatacctggatttcctcgacgtttagctatttcaatactttcgtcagttaccgcccaatccggaactcgttctaaataatgatactggtaaagtgcagacaagagaagcgtctttacccaaggatcaagccgttttccctgcacaaacccatttagccaatattcgagggtaagtttatgctgcaaaacaccataaataatattagttgccaaccggcgatctttatctgccaacgggtacctttttaataactggtcaacctgcaagtttgagtatgcaccattttcgacaactccttcaagcgccactaaagctaattcacgcgcattttgcggttgaaatttagtcttcacttacaacttggcctccctctgtaatatctttatgtccattaaggtaagaagtaatatccatcgcctttttccctgctggctttaacttattaatctggtatgtcgttccatctccagcggcaattactaattgatgcttcgtgacccgcactactttccctggttcaaggtctgttttttcttctaatggggtcacatcataaatttttgtgcgtaatccatcaataatcatattaccaagaggagccggccgtaatccccgcaccttcgcatcaattaaccgtgccggaagtcggaaatcaatctgttcttgttcactagtaatgttgggagaaaagactactttatctggatcttgagcgaccggattaacatccccgctaataagtttaggcagcgtttctaacagcaagtctcttcctagcaaactaagctttttaaacatagtgccactatcatcagtgtcttcaatcggaatagacctttgtgaaataatatcgcccgcatccatcttcttaaccatgtacataatggagaccccggtttctttatcatcattaataatggaatattgaattggggcccctccacgatattttggcagtaatgaaccgtgaacattgattgctgcaattttagcagccgccaataactttgttggaaggaattgcccataagcagcagtaatcattaagtcaggctgcaaattaataattttctccatttcaggacttttgctgagtttagctggctgtaagacttcgatattatattgttcagctaattctttaactggcgattgatgaagagtacgtttccggccgatatggtggtctggctgggtaagaactgcttgaatatcgtattctggattatcaattaaactttgtaaaatcggaacagcaaactcgggtgttcccataaaaacgactgatgttgacattaataacatcctttctttcacataaaatactgtggatctggatcgatacttacttggacatccttaaaaccgcgactttgcgtatcctgaagaatatcaaacaatagctgatgcaagtaaggatccttcttatatttgatgacaatttggtaatagtaacgacgcttcatccgggcaattgctcgcggagtggggccaagaataaccgtcgaagataataatccctgctttaggcgaccatagatatctgccattgcccgagctgctttggcttcttcgggatgactggccatcaaacgaacggtgtaatagtatggcggataacttgcttgtcttcgtagcatcatttcctggttaaaaaatttttcgtaatcgtgcattttggcatcttgaatagcgtaatgatcagggttatatgtctggataataacttccccctgcttatttgcccgaccagcccgaccgctaacttgacttagcaaatcaaaagtccgttcactagcacgaaaatctggtaagcctagaccagtatcagcatttaaaacccctactaaggtaacattagggaaatcaagcccttttgcaatcatctgggttcctaataaaatatccgcttggtattgaccgaactgtcgcaataattttgcatgcattcccttccgccgtgtggtatcaacatccatgcgaataatccgggcctggggtaataattgatgcaattcttgctcaaccttctctgttccagtcccataatagcgaatctgatgactatggcaattgggacattcacgggggattggttcttcatgaccacaataatgacatttcattgtccgcgtatccatatggagcgtcaaagaaatatcacaattaggacattttaaaacatttccacaatcacgacacatcataaaggatgaaaatccccgtcgatttagcattaaaatactttgctcgttcttttgcaggcggttatttaattcggttaatagtttttgagaaaagttactctccccgtactttttaatttcatctcgcatatcaaccacttcgattggtggcagttcctgtttatttacccggtgaggaagacgcaacaagtgataaacgttttttactgctcgcgcacgactctccagactaggagtagcagagccaagaactacaggcgcttgattatattttccccgccatttagctacttcacgcgcctgataacggggtgattcatcttgtttataactagattcatgttcttcatcaagaatgattagccctaaattagttaacggagcaaagactgctgaacgggcacccacaactacttgcgcttctccacgttcaatccgtcgccattcatcatatcgttcaccattcgataaactactatgtaaaacagcaaccttagagccaaatcgtcgccgcacacggttaacaatctggggcgttaatgaaatctcaggtacaagcattaatgctgtctttccctgttgaagagcattagcaatcgattgcaagtatacttctgtcttgccactccccgtaactccttgtaagaggaaaactttagggtcatgattgtcgattgcttgattaatctggttaacagcattttgttgatcggcgttgagctgcagggggctgctaaatgagcatcatcaggagtgccctgcatagccaagggttgtcgatatacttcaactggtgttttttctagccatcccttctgttgtccctgattgaaggtggctgcttttaaaccagttttatgttcagcatccttttgcttaacaacttgactaccaattgattgtaaatatgaaagaagacggttttgagcatgagcattagcatgaagggatgcgcgctcatcttccagttgttcaaaattaagcaaagagcgaataccagtcaccgttttagctttggctcgatcctccacttggtattcaatcgttatctttccttccttttgcagtttgaacaatttacttaagattgccggtttatcttgtaccgccgccatttctaattcatctcgcccatgaaaaatgtcaaaggcaacatactcgtctacttcatctacaattcgaataattctggtagtcttagccttcaataagttaggcaacatcgtatataagcaagaaatccaaaaagagtaagtagtatcagctaaccatttgctaagattcattaattcaggattaattaccggttgaagatccattatcgcctgaattggtttgagttctccctcatattgggatgcattgtcaagggcaacaacaaatccttgaacagtacgttttccctttccaaaaggcacaatcactcttactccaacttgaatttgtttttcaagttttggcggaatctgataagtatatggttgatttgtttgcattgttggaacatcaacaactacctgtgccaactctggcatttaatcacctgactttaattttgcactaattaattcaataatctcgtttgcaattttagctttagattggcgggctaatttaattggcgtttgatctttttgtaagatggtcacttgattctggtcactgccaaatgctcccatatctcccgccacactatttgcaataatcatatccgcatttttgctagcaagtttacgattagcattttctagaagatcatttgtttctgccgcaaacccaacgatgtattgaccgttttgcttcatcttcgcaatattctttaaaatatcaatagtttcagtaagcgcaatggtaagatgcgggttaccatcttttttcttaattttatgatcaactatctcaactggacgatagtcagcaactgcggccgccatgattaaaatgtctgcctgcgcaaaacgttcttttaaactggtatataaatcttcagttgtgattccgcgcacaacttcaatcgctggtgattgtggaagggggacggtaacttgaccggcaatcaatgttaccttagctcctgcttggaccgcggcgttagcaagtgcaatccccattttaccagaggaccgattaccaataaaacgaacaggatcaatattttcacgtgttccaccagcagtaacaatcacgtgtttgccctttaatgcttgactgctagctaaaaaatcttctatatattggcaaattgctgctggttctggcaaacgcccgtgaccagcatatccttcagctaatcttccactaactggcggcataatattgaccccatcttgtttaagttgagtaatgtttcgttgagttgcgggggccaaccacatatggctattcattgccggaactacaattttaggagcattagttgctaataaggtggtagaaacagcatcatcagccagtcccattgccattttagcgattatatctgctgatgctggtaccactattgctagttctgaccaatcagctaactcaatatgaggaataggcgttgaatgctcatcccataggtcagtaagaactggtgctttcgtcaaggcaaaaggagtagcaggagtgactaacttagtagcggcgtcagtcattcctacgcgaacctcatgtcccattttttgcagtccacgtactacttcgattcccttgtaagcagcgatactgcctgtaagatacactgcaattcgtgtcattatgtcacctcaacttattttttcttaattgattatagcatttttagaagcaaaaaaggggccagtgacaatcctgccctagtcccttacttttgtttatccagcttaatttaatcctgtaagtcttcagtatgatcaggatcgatcgtaacttttccagccaaaatctcttcaagggccttcccaactgacttgcttgaatcataatgttcaagtaatggggcagctcctgcatctaattcattggcacgcttactagcaagcataactaatgaataacgagaatcaatatgttttaataattcatcaactgatggaaaaaggatcatttttcggcatctcctaacatttcaagataacgtggcattacacgggtaacacgaagccgttcagtacgaataatgtctttaatcttttcaactgcatttggtacttcgtcattaactactgcataatcatagttttgcatcatttgaatttcactaaatgctttatgaattcgtttattaatgacttccatactatcagttccccggtgaatcaatcgttgttttaattcatccaaatcaggaggggttaagaaaataaacacgccatctgggcacttagaccgtacttgcattgctccgttaacttcaatctcaaggaaaacatcttttcctgaatctaaggtctcattaacatattttaatggggtaccgtaatagttgtcaacatacttagcatattccaacatcccaccagtttgaatttggtgttcaaactcttctttgcttacgaagaaataatcaacaccattaacttctccaggacgtggttttcgagttgtcatcgaaattgaatattgaaaatcattatcatttgaatcaaagatagcttttcgaacagttcccttcccaaccccggaaggacctgaaagaacaattaacattccacgatttgccattataacgctcctatttatttaatcgtattaatactataatgcactagattagtactgaaatcaagcacctgaataacaaaaaatcattgagctttttgcttgcatttctgaatgtatgttcgtatactataatcaaacgaatgttcggaggcgcgattatgcaaattgaacaaaagtctatttttaaatttacgccacaaattattagtgataagcttcggcatctttttgaagaagcacctgctgacgatcagcaagcagggttacttactccccaacctgctaaacaacgacaattatttttaaaacgagccattaaagataaaattaaagcaacgtttcagctaatgccaatcaacaacgatggctatcccgtaaacgttaccggtaacatcgcccaattagcgaatagcaatcgataccttattacgaatcaaaatgtaagttatgttgttaactttgatcaaattagatacatcgcgaatttataatattggatttaaagagagactgggaattagctcagtctctttattgttttaaagatatttatacagtagctgcctggattccgatcgttgataaggcaccccaataggctagcttcgcgtcgtagctatcctcgtggaggaagacgaagtcgcaagtgacttctttcccactccctcttttttattttgccatattaagcaattcttgcgcatgctcttttgtcaactgagtaatcttttcacccgatagcattcgcgcaagttcttcaacccggtcgttttctttcaatggtgtaactcgagtagttgtccggtcatcatggacagatttcttaataaggaaatgatgttgcgcaacggctgctacttgtggcaggtgcgtgatacataaaacctgtgaatgttgagcaattaagcgaatcttatcagcaattgcttgggcaacccgtccgctcaccccagtatcaacttcatcaaaaatgatactagtaacgccttccttttgcgcaaaaattgtctttagggccaacattacccgtgacaattcaccaccagaagcaattttagctaacggccccattgattctcccggattagtccgaatataaaattcagcctggtcaattcccgtcggtgtaaattgttcccgactttgattagcaaagtgaacttcaaattctgctttttccatgtaaagctctttaagctgctggtgaacttttttaccaagctcatgagcagctttttgtcttacctgactcaatttacgaccggtctctcgaatcttattttcggcttctcctaaccgttgctctaggtcactgctagaatcagccgcggcctccatcgaatcgagttcttttttgatcttatcataatacttcaaaacatctgccaatgtatcgccatacttatgttcaagatcaccgatagtagttaaccgttgttcaatctgagctaaccgttcatcatcaaattcaagcatgtctaattgttgactagcttcattcgctacatcttgaagagcgtaataagcatcattaagagccttactaagattatcataagcatcatcaaattcagcaattgcattgattgagtccatcaccgtggcaacttgatctaaaacaggcgcttgctcaccttcattaaaggtcgtcacagctagttgaagagcattattaatttgttgaaagtgttccaatcgatcacgttcactaattaattcatcttcttcattttcttttagattagcttctgcaatttcattgacttggtaccgaagcatatccaatcgctgcgcccattgttgttcatttgcttgttttttatttacagcagctttgagtttagaataagcttgatattcttcttgatattttttaagtaagggctgaacctctttagccgcaaattggtcgagcattcctaaatgagtctcaggttgcattaattgttgatgttcattttgcccttgaatatcaactaatcccgcaccaatttgacgaagagttgccgtattaattagttgaccattgacccggataatattgcgaccattgcgatgaatttcacgggagacaattaagatcccatcttcatgatcaattcctagtgattcaagtagtttatcaaattcaggatcatcaggaattgcaaattgtccttgaaggcttaatttttcttctccacggcgaatgaattcctgcgatccacgaccaccagccagcaaaccaactgcatcaataataattgactttccggcaccagtttccccagttagaacagtcatttggtcagcaaaagttaaggttaagtgcttaataattgctaaattatcaattgtcaattcttgtaacaaaaattttcacctcgcctagtcgagcattgcgttaagcttttcttctaatttaattgccgcttctggagacatacaaactacaagaacattcccatcatcaccaattgttgtgaagaccgttggaaaatccatcttgcgaattaaggtagctactaccggcccattccccggatgaactgttaacgctaagaaacagtcattgcgctttaattgttccaaactgtcttgaagggtctgagctaactgattttcatgtccttgatgatgatatgctggcaaaccataacgataacccccattatccgcaggaatctttatcagttgcatttctttaatgtcacgcgaaatagtcgcttgagtaactgtcaatcccatttcacgcaggcgttcaacaagatcttcctgccgctcaatgctctcattagtaatgatttcacgaattttttgttgtcgttctgcttttttcatggattaagtcacctttatttattccttatgatttaaatcatcatcagcggttgcaataaccttatcgatatttacttcttcggcaacaatccccggattttcacttaggcggaggtgaactaaaaattccatatttccttgtccccctttgattggtgaataatctaatccaaggatatcaaaatgatcttcacgggcaaaggtcagcacttcttccaaaactgctctgtgaactttatgatcatgaatgatcccatttttgccaacatgctcttttcctgcttcgaattgtggtttaattagggccactacttcaccacccattttcagtatctgagccaaaggtggcaagatcaaacgaagggaaataaacgaaacatcaatcgaagcaaattctggttgaccactagtaaaatctgctaacttactgtaacgaaaattggtctgctccataacaactacccggggatcttcccgcaattgccaaaccaactgattagtcccgacatcaagagcgtaacttaacttcgccccattttgtaacattacatcagtaaagccaccagttgatgatccaatgtctaaaaccgtcttgtccttaactgaaatatcaaaaacttttaatgctttcgctaatttcaagccgccccgactaacatatggcattttatggcctttcatgtgaagggtggtggtaatcggaattttttgtcccggtttatctaatcgttcattatttttgccaagaatttctcctgccattaccgcccgctttgcttgttcgcgagagtcaaacagcccttgttggaccaataatacatctacacgttcttttttcataatccctttccttatttaaaatatgctaaaaagtcatcataaccagcaaatgacttgccagtaagcttttcaagattcttttgattttgattagcagcagttaaagctatctgtagctgctcctttgcaccatctatgccaagtaatcctggataagtatttttttgctcatcagcatctttgtgaacagcttttcccatctcttcagtagtactgaggacatccattaaatcatcatagatttgaaatgctaaaccgtagttttcaccaaatgctgctagctcttgtttgatttcagcagattgatccatcataatcccacctgccaaaacagcatagcgaatcaattcccccgttttttgacggtgcaagtatttcaattggtttaaatttaaatgttggtgttcgccttcaatatcccgtgcttggcccgcaaccattccagatggtcccgcggcttttgcaagttcaagggtcaactgactccgaacattagctggaagatggttatcggcaacccactgaaaggccaatgtcaataatccatctcctgctaaagttgccattcctgctccaaatttacagtgattagttggttttccgcggcgtagatcatcattatccattgctggaaggtcatcgtgaattaatgaatatgtatgaagcaattccaacgcagaagctgcgcgtagcagatcatcattaagcgtgccacccaacatctcaatcgttgtaagcgtcaatgctggacgcagccgcttgcccccagccattagggaataagccattgagctttctaacgttgcttgatcaatatctgtggccaatgacttgcttagataatcttcaatctgttcttttaaaatcggcaatggtgtactcatctttttctgctccgttgcttattgttcatcagtgctaccaaatccacggttaccaccgccattattgcttgggtcatcggtttgtttttcgtagacttgctcatcaccattatcgtcaattaagtgcccaagcgttttttcagcatttgttagcttcgtttgtaattccttagaaagcttgattccttcttgaaactgttgaagggcctcttctagtggcacattcccctgttcaaggtgattaacgatctgttgtaattgtgctaattgttcttcaaatgttggttttgctgttgccatcttagtgctcctttaccttttttatttctgcttgaacttccccgtcatcaaaatgcaggtgaacattttgcccaaccgttaattgactggcatgattaacaactttttcatcactcgttacatatgtataccccgactcataattttaagggggctcagtgaatctaattgtttaataagagttgtcacttgttgtttcttttcattttggttggcaagtgaggctgtcaccaattgtttttgtaattgattaactaactgttcttgttgttgaacccgatgcagtggagaaatagccgttagacgcccacttaatctttctacgttcattcgcagctcttgcattttattttgtgctgcttgacctagctgttgagttaattggtcaaccttttgtgcatagttttcatataatcttgtcggttgctgaaaaatatagctttgcagctgtttattcaattgttggcggtcaaaattaattttagtccgcatcgtatttaataaacgattctgatcatctttaagtgtcattaatacatcgtttaattttaccggcgttgctaattcagcagcagcagttggggttgctgcgcgttgatcagctacgaggtcggcaattgttgtatctgtctcgtgaccaactgatgaaattaccggaattttactattggcaattgcacgggcaactacttcttcattaaaaggccataagtcttccattgatcccccaccacgaccgataataagggtatcaaagtcgccgcggtcattggcacggttaatttgtctagcaatatccgccgctgctttatccccttggacgacagtgggatatagaacaacttgagcaattggataacgtcgtcgaacagtcgtattaatatcccggataaccgccccatcaatactagtaacaactgcaattcgtttcggaaacattggaatctgttttttaggtaaattaaatagaccttcagcgctcaatttcttttttagttgttcaaacgctaagtataaagagcctagaccatctggctccatccgatcaatataaatctgatagcgaccacttttttcatataaacttacatgaccgactacacaaactttcatcccctgttcaggagtaaatttaattttccggaattgatgctcaaacattacagcatcgatcacagcattatcgtcttttaaactaaaatactgatgcttttgccgtaaacgaaaattagaaagctcaccggttaaataaaccgtatgtaggtatggatcccggtcaaacttcattttcaaatacttagttagttcactaactgttaaatactggcttctatccatgatgcctccaccgcgctaaatcaactgtttgttccattaaagttgcaattgtcattggtcctacgccacctggaacaggagtgattgcctgagcttttgtctttaccgcttcaaaatcaacatcccctgtcaatttaccattgcttaaacgattaattcccacatcaattaccactgctcctggttttacatctgtctccttgataaggttaggcacaccagtagcaacaattaaaatatccgctgttttcgttaaagcagaaaggtcgccagtacttcttccagccattgttacagttgcgttagcattatttaaaagagctaaaagaggtttaccaactaaaatactccgaccaacgataactgcatttttcccttgtaaatcaatattatattctgccaacatccgcataattccgcgaggtgtacaggccactggataattaccatgttgattggcaaacagttttcctaagtttaggggattaaggccatcaacatccttagttggcaatatagcattggtaattacttctgaatccaattgaggaggaaggggttgttgaacaagaatggcatcaattgtgtcatcatgattcagcttttcaatttcggcaagaagctcatcttgactaacatcagcaggaaatttttttaaaattgaattgattcctaacctagtagccttattatgcttatttcgggtatagattaagctcgctgcatcatcaccagcaatcacgactgcaattcccggagttatattttgtttttcttttaactgtgccaccagtttttgggtctgggcattgatttttttagcaagggtcttgccatcaataattgtcgtcacagtgattcctcctcgttaaatttccattttatattctaccataataatattgcgcttaagcaaaaaaggagtggaatcagaagtttatcacttcatttttccaccccataattattgttaacagtaatattagttattcgtgttgacttgtttttcaaatttgccaagggctccattgataaatttacgtgacttatcactgctgaatgttttcgtaagttctagtgcttcattaattgctactactgttggaacattttcagcatattgaatttcaaataaagcaagccgtaaaataactaaatccggctttgctaaacgattgatggtccatctgcttgcgagaaggtcattgatttgttcgtcgagctgatcttgatgttctcgcaccccatttactaaagtcagtaaataagggggaatttgcttttcatcatgatgaggaattgcctcatacacagtttgaatatcggcttcaggatctgattgcaaagcaaagagaacttgaaaagcctcctcacgaatcatgtgtcggtttaaactcattttattcaccagcctcgtcattaagatgttcgccaaacaagtcattagggtctacttgttggtcttctttagatgttacgattcccttaatatgaacattaacttcttttacttttaaatcagtcattaatgtgatttgttgtttgaccttatcttgaatcattgccgctactttaggaacagagacaccatattcaacataaacatccacatcaagtgataatttttcatcattgctggaaagctttaccccacgccggcgatcagagcgtcccaaaagttcacttacgctatttgcaaatgaaccatacatctttgaaacaccatcgatttcacttgcggcaatccccgcaataatttctaaaactcgtggcgaaatttgaattgtcccgagtgacttgtcttcactacttaaaacaatctttgattcttcagccatcgtcagccctccaatttatttcttctcttaattatagtaatcatttctattctgcactatgttcgaacaaattgcaacaacttggtcaattaggaacatagcgccagtttagaaattaaccgcaaattatgattataccaatcatgaacgactaaatcgagactagatgtggtaaattgtccgaaattaattgatttaaattcttctaacgttttcaagaattggtctgcctgctgaagcggactagtataccgtgcaaccgtcacatgtcctgagattgttggatatcgttcttttagcaataagtcatgtaacggcagttctttcctaagtacattccgtaaagttgataattctgctgaataatacccttttacaagaagtgctcctgaactagtgatcattcctgctaaacgccaatgaatcggtccaatttgtgaaataatctgccctactacgtttttatatttttcctcttcaaatgttgagagcgaaaagtatgaactagctgcaataaggtcaataatcgtaatatgcaggtcagcaggaggatagaagtattggttaggctcaattgcagccaacttttgcaagcaaaacataatgttccgactaacgtgcgcaggcagtgaagcagtaagcgtcagtcctcgacgcatatctttatcaggatttagcaagttacgatctagctgttcttgatgatttctaattgccgacattccctgttgattaatattattatacagagtagtaagttgcatactattttcctacgattattagatcagttggcgcctttgtcagcacttcaactccaccgtgagtaaccagaatatcatcttctatccggaccccgccgatttcaggaatatagataccaggttcaacagtgataacttcattgttccgcaatttaatattttgagcactgggtccatagctagcaggcaattcatgaaccgataagcctattccatgccccattccatggttgaattcatccccataacctgctatttcaattaattgccgtcccgcaaagtcaagttggtctcctcgttgcccaacatgagcagcttgaattacagcttcacgggcctcattgacgatttgataaacatcacgtaattctggatcaattgaaccaacggcaaatgttctggtcatgtctgccgtatagccattgaagtagtagccaaaatcaacagtaacaatatcgccgtcttcaatcaccttttttgaagccgtcgcatgcggtttggccgcatttttgccactagcgataattgtcggaaaagaggccccgcttgctccatgttctttcatccaaaaatcaagcaagttcgcaacatggcgctcggtcatcccagcgtggacattttctaaaagataccggtatcccgctgaatgcaagtctgcagaagcacgcagggtatttacttcatcactatccttaatcattcgcatccgttcaatttgttggtggaaaggaacaaggtctgtcgccatctgctcatcaagcatatcaaataaggcataagtaactgtatcttcatatcccagaacattcactttcatcccctgacatattttattaagcgaaccgtaatagtcacgggtaatcattcccacaacctcatcgttttcaaattcttctaatgcaagctggtaccggtcatcagtaataataattgcattatcttttgttattaaaaggcatccatcgccttcaataagattaaagccagtgaggtaataaatgtttttttcatccgttactaaaaatgcatcgatatataatttttcaaatttcttctgtagacgtttaattctagacatagtacatttcctttaatactgccggttagagtaatcacgagggccaaagatagccgtcccaacccgcacacaggttgacccttcttctaccgctatttcataatcatgggtcatccccatactaagaacatctaattttaattgatcattttggttgttcatttcatcgcgcaattcacgtaggcggcgaaaaatcggccgcgttttttccggatcatcataataaggagcgcttgtcattaatccccgtaactttacatgtggcaattgaagactggccttagctaattccatgcaatcttgcaaagttggcttaaccccaaatttactctcttcttctccaacattaacttcaattaaaatcgggattattcgattatgctttcttccttctttttcaatcgccttcattagcttaagggaatcaactgattgaatcattgtaacgtaatcagcaatgtatttaaccttattacgctgaaggtggccaatcatataccagttaatgtcggctggtaattcatcatgctttttatctaattcttgaacataattttcaccgaaactgttccatccagctttataaagctctgcaatatctgccgccggatgatttttgctaaccggtaacagttgaacatcttgaggatcgcgaccgctgcgcttacatgcagcaataattttttcttggacatctttagctttatcaacaatcgtcattaaacagtttgctcccttcaattgtgggttaactatattcttacattatagattaacatataattgaaaaatatttaaaaataaaaagactactatttcatgtagaaaagtagtctttttattactattcagcgattgggtaaaccgataccttacgcttactgcgacccatgcgttcaaatttaacaacaccggctaccttagcgtataatgtatcgtctccaccacgacccacgttttcacctgggttgatgtgagtaccacgttgacggtagatgattgatccagcagttacgattgaaccatcagcagccttagtaccaagacgacgaccagctgagttccgaccgttagcagtggaaccacccccttgtggtgggagaagaattgtaaattcataatcatagttgttcacctccagcaatgaactttaatcaaacatttttacttcaatgttttgtggatagctttcttggatatcacataatccatttaaaaaggttttaagaaggatctgactatcatgaccaaggtctaatcctgtaacttccagaaagccaccattatcattatcttgtttaaggtgaggctttgtatgaacaacttgttcaaggccgttcaccgttgaaatagataatgcagaaaccgcggcacaaacaatatcttgcccatatggaccagattcagcatgcccagtcattttaaaagaagtgatccgctgattcgaatctaaattaaactgtgctcgaatcatgatctcacctccgcattaagcgttgatcttgttgatagtaaccttagtgtaaggttgacggtgaccttgcttagtgtgagtgtgcttcttaggcttgtacttaaaggtaacaaccttcttttccttaccttgcttgtcaacagtaccttcaacagaagcaccgtcaactacaggagtaccgatcttagtgtcgtctccaccgacaaagataacttgatcaaaagttaccttgtcaccttccttagcatcaagcttttcaacatagatagaagcaccttcttctaccttgtattgcttaccaccagtaacgataattgcgtacatactttgtgcacctccttaatatctcagactcgccgtactaagcagctaaataagctttagacttaataacgcgcggttgtagttgttggttcacaaatacaacgtttgtataatatcaaatattattctcttcgtcaaccgtaatctctacttttataacgaaaaaaggactgtgacataagttaagttactttcataaaaaggaaatacgcagtacaacaatggaggctgggaaaaaactcctagtccaaaataaaaaccggatgatgaattttttgaacaattcatcatccggtttttatgtacacaggaaatcgttcctgatatgatgtaattacccctaaaaacaaccaaagggagcgatttccatgtatcaaaattataccataggacaaaccgaattcgtactaaactataactatgatttaccacaaaatcatattgcgcggctaattagtgattttgtcgactcgattccacaaaatgtgctattagaagattcaggagcggctaccggccgcccttcatcgcatccagcaattatgcttaagattctcttgtttgcctactcacgtcaaacttattctggaagaaagattgaaatgatgttggataagaacctgccaatgcgttggttagcccatgattatacttatagctaccataccatcaataactttcgacgcagtcagcacgctagtaagctaattaaacatgcctttgtctactttaccatggctttgaaagatcacggactaattcaaaatgatgcagtttttatcgatgggaccaaggtagaagccgatgccaataaatattcatttacttggcggcgggcggttgaaaagtatcacgctaagttaagagaaaagacgagtaagctttatggggaactagtagaaaaacaagtggtgcaagaaatggcacccgagctggttacttctgccgaaggcatggaagtaatgaaacaagagcttgcggagaaaatcattaagttagatgaagagattaagcaagaaccaaaaatcatcaaaggtggttcagttagaaaacggcgccgtcgttttctaaaaaacttcgccatcaattaagcaacgacctaattccgcgtgccaaaaagtatgaacgtaccgaagatatcttccaaggtcgtaatagctatttcaagactgatcatgatgcgacttttatgtgtatgaaggaagatccgatgatgaatcgggagttgaagcccggctataacctgcaaatcgctacacataagcaatttgtccttgattacgggctcttttcaaatccaactgacaccaggaccttagtgccatttcttacccagtttcatgctttagatttctttaagcatatcgttgccgatgccggttatggtagtgagtacaattacacaatgattcttgatcagtttgaaaagcagcctgttattccatacacaacttatcaaaaggaacagaaacataaatttaaaaacgatccaactaaatcacaaaattggcagtataatgccgaagatgattactacatcgatcatttaggagttcgctttagcttttatcgttatagtaggcgaaccgataaatatggtttcgaacgtgatttcaaactctatcgagcggataagcaccaactgtcagaacaattggatgagttggcaaaaacaccaagtggtcggcaacactatatgcaggttaacccaacgtggaattattacaaggctaaagtaaaagcaaccctctcaagtgacgaaggcaagacaatttatcgtcgacagaagttcgacgttgagccagtctttgatcacatgaagagggattttggcatatgccgaactcatctacgcggacaacgagctgtggaaaatgacattgggctagccctggtggcattaaatctaacgaaattgggacaatcaattagtcgattggcgactaatttcataaataatttaaaatccgaactacgatttttggatcgatcaaaaatcatagtccggattttactgttagagaaccaagaattaatagttaattcccagcctcctattgttgcttgcgggggctcaaaaacgaagtcacgagtgacttctgtctcgctccctcttcctacgattagtcaagaaaaatatttagaaaagaagagtatactaaaccaacccggttcttcttcaaaaatcgagaattagtggtatattaaaattgtgaggtggttatgccttcacagggactattgagtccgtataccgatagtggtattttttatggtgcttaatcatggataagagacatttcagagttttattcatacaagctaccatggcgaccttgttcagttttggacgaggtcgtttttcttttaaacgatagtaatagtcaacaatatgattagaattagcgtgttgttggcggatcatattacctacagtaaaatataagagcttacgggcaatcgggtttccacgcttattaatatgatcttgacctaaataggttccagattggtaacgacgaatatcaattccaacaaaggcattaagctgattagcattgtcaaagcgactaatgtcgcccaattctcccattaactgagccgcagtttgtttcccaattcccggaaaagagcagtataggatatactctggtaagcgctgggcaatagattccatccgcttgatgacctcttcctttttacgggttaaggcaattaattggcgagcgtagtagcgaacttcatcaacctgaatggtatcaccagaaacagccggatatgatttttgggcgagatcgattaatcgatcggcatacttataagctttcatcttagatattcgtttatctgtagaggccattagaatattctttaatttaactctcgaataaggcctaactagtgctggatgaggaaaaagctccacgatattcaacgctaatttagatgttctatttacaaataattgcttaagttctggaaaaacttgttcaagtgcagtatgaagatgatttagacgatagttccaatcagcattgagctgattataaaaccgactaagctcatgtaactgaagatagtcttttttccaaggaactgttaatcgaaaagcattttcctggacagtgagcgcaatccgatgagcgtctttctgatcggtcttaactcgtcgtagactctcggactttaaatgaagttctagtggattaagacggcaaaagcggagaccattagtctcacagaaatgtccaattactcgcgaataaattccagtcgcttcaaagtagataattggcttctgagcttttttaatcatatctcgtagagcattaaaccccgctttcgtgtgtactaaagaaaactcctttaaacagtgtttccctcgataccagacacagtagcttttcctcattgaaacatccaaggcaaatatatcagacataaaaagacttcctttttataaatagagctagatataaccgctatcctagatttgtacttcatttcctaaatactcgaactcgtagttccacaacctaaaagcaaaatatcaaatcaaagatagcggagatcattttataatacggactcgaagtccctgggagcatgatcgatcttagctctatcttcagaataacaaaaaagtccaggacaataattatttttgtcctgaactaatcttaggttgtttgtagtagctattaaatcttttctaaagttccttctagttcaccatcaaaaaaactaaccaaagaaatattctcgctactaaactgattcaacatttttgccacgctttgtgtcatataacgtggagtataaatcatgccatcttctagccaccgacttactaagcccagaaatgctgaatcaacaaaggaaatctgcaaattaagtgggaccttcaactgttggttcttattcacttgctcattaaagtgtgtcatttcatttgctaaccgattgtaaagttgttcataaaagaagttattcttttcattatttaatagaacatcaaaaatatcggcgttattttcgatatactgaaacgctttgcggagtgaaaacacctttaccgtccgttctttcgaaaaattactatcgatcattacttggttaaagaaatcgtcaataatctcttggattgctgactgaataaaatcttgtttatccttatagtgaagatagaaagttccccgagtgatgttggcagtttcagtaatcttttggacgctaatatcttcaagcttttcacgtctcatcagatatacaagagctttgcgcagactattacgtgttttaattacacgtgggtctgtcttattagcagccatttaatcatcatccttccatcatacagcttaagtcctttctactttcgtacttctactgttttaaagtatagttgtcatgaaagcggtttgtcaacgaaagtgcagattttatcttaacaaaataattatattagattattaccattgacaactttgtagtgaaaattatatacttaaatctgtttggagcggtagctcaactggatagagcatcggtcttctaaaccgagggttgcgagttcaagtctcgctcgctccatataaacgttatttacaaaaagaggatagagaaacgtttttgtttcctatcctctttttcagttactctcatctaaacttacagataattttctaatttttcactttcattttttaagtatttcttaaatgcactctcatatgttacaattttgttgcaaaaatgaacatttttcataataatgaatatagagattgctttttgaggtgattattatgctaccatttcttattattgttttaattttggttgcgtcggtaattggtgaatttatgtttggcagtcttagtaaccaagaaactggaaaacatagtgcaactaccaatcgcttacgagatcgaaaagcttaatcttatattccgttcaacacaagaggccgaggaaattcctcggcctcttgtgttttatcttaatgttggtcaatcattgcttggtaagcatcggaaatttgatcaggtgttaactgccaatcactaattcccatttttagcaaaagatgccaagcatgccgaaagctttcttgttgatgattaaaataggcatcacttaagaagtgtttaattgctagatacgatttattaaggtctgctaactttgtagatcttcttgcatctgtaattcgttgccaggcttgattatctagcacaaccagatgcgtccacttcatctttgcactatacaacaaaagtaaagctactgattcaacatacgattttagcaaatcttctttgtctactttactaggattaactaccttataccaccctgctgcttcagccatatttgataaagaaatgtcaaggtcaacaaaaatcgtttgctttcttgtttctggcccaatcattaattccttttcatcatcaatctttaattctaaatcgataatttggtgaagcattttagtaatatctaacattgctatgcctccacaataaaatctactgcttattcttcctcattagaagttggatcttctgatggttctgccgaagatacttcatctaaagattcgtcttctgctacttctgtcgttgctggtgattcttcatcaacaatctccatatgatctgttctcacggctagagcggaacggtttgccaaataccactcgcgaaccaggtcgtaatgaagcaatacatcaaagaacgaaacttgctcatccgaatctttaactaagaaggcccactcttgactataatcgtccgggtcaaaagcaatgtcaagtttggtaccttgatctaatagtaactcagccccattatttcgtggtaaattcatcaacatgtaatcttcatcagcagtcgcaacaaataaacgatcaattactgtcagtggaagttcaggcttattcaacataaagcggcgatcatttgcagttgctaaaatgcctagatcaatcgtgaaatcaagatctttttgcaagtatttagcaaaatcaatcagaggtttaaccgcatcccgtaactcaaggtcagtatgctgtttaagcgcataaacgataaaataatttactaatgcgcggttattaaattgcattaatttatcttctaagcttagatagaaaagtggttcatgctgactttgctctgtaaaagccgcttctccccgactatcgacctcaaatttaaaaatagcttcaccgccaatagccgcaacagtcgcttcaaattcatggtttaattcattttctgcaacattaactgctgtatctccatgcatttttaataggtgatccataaaaatcagataatagtcagccgccttatagtgtggcggaaaattaataaacgcgtttgccaaatccattttggttagtttattagcggctgataatagattcttagcatccttagtctgggctaactggtctaaaaggtcaacatatttttgtccaaggcttaaaacatctttaaaggaatcagaaagagcctggacccgttcactaggagaagtcacgattcgattattgctcatcgtcgtccacctgctttccttctgatccatttaaactggctaaataattagcatataaattgcgattagctaattcgaaatcttcaaagctgccaaaagtatcgataatgctcttttgctcataacttaaaatcgtattttcttttgataaggataggacaacgcgttcattatccttaatagtttgggctgcattacgagcttcttcttcttggtcctctaacttttgcagctgctcaaccagttcctggcgactctccttgttacgacttgattcccaaatgccagatcgtgaactaatttcttttaattgttcttgaagggcttctttacgttcctcacgttctcgttgatgatcaatcaaatcttggagacggtcattttcactagagattttactaatccggtcactattgtaacgtttattgtcacgcgctaattcaaaagccgtccgtaatttatcatattctgtttggtcaaaagaaaaacgaacattcaaaacgtctaattcaccaaattgacggcgattccaccagttaccaaaataaatccggtagtgaccagtttgatattcttcataataaaagaagggataggttttacccaaatatttaattaagttttcactaaggtaattacttaattgatcagccaaatcatcgactaggttcattacacctttatcatttggttgttgttcccgatgttcaatctctttagcatagcgttggttatctagtaattggtagatttcccgatcacgatggtttgaaattgcatcattaaagcgtcgcaaatactttatctttgtaataatttgttgattgatgacttgagtaacatcaagtgaatcactattagtttctacactcgccataagcatgctccttgtctaaataactacctattataataaataactttactaccttttttccactctttttaaatttttttcaaaaactttatatttttagcacagatctgttttttgaaggtaaaaataaaagactttccataatgaaaagcctttattcccttatccaattattcaaatatcaatgaacccctaacgataatttagcaaaacggctcatccgatcaatcgtccaagctggttcccagacaaattccacatcaacgttttttacctctggaacctcttttaccgctttagtcaccatatcagccaatacatttgttaatgggcatcccattgtcgttagcgtcatttcaatcaaacatattccatcattatcgagatcaattgtataaacgagtcccaaattaacaatatcgatatgaagttcaggatcaataactgttgctaatcgttgaacaatatcgtccttaattgattgtttgtctctcataattaattatttttccaatacttctcaataaattgttgtcggccaccagcttcttctaaggcaaaacgctgcggatctttcttataaaagccctgatgatagtcttctgcgggatagaatggctgcgcatcctcaattgttgttacaatctttgcatcaccaaaacggccgctttcctgtaaagccttttttgactcttctgcagttttacgttgttcatcatttttaacgaaaattacaggacgataattgtctccccgatcttggaattggccacttgcatcagtcggatcagtttggtgccaataaatctctactaagtctttgtatgaaattttatcggggtcaaaagtaatctttactgcttctgtatggcctgtcgttccagaacatacctgctcataggttgggttggcaacatggccacccgtataacctgattcaactttgtcaattcccggataagtatcaaacggctgaaccatgcaccaaaaacatccgccggcaaatatcgctgtatctaaactcatatatatcaatcctttccttgattcctcaacgtttatagacgttatgttttttgactaaataccgagatttaatgagaaatatcgagaaacctagaatattttttcccatgattttcccatgggaaaatcattcaattcacaaagtttctctaacttattacttaagtataacccaatatatcaatttagattagttatctatagtgtttactaaattggtattcattcatcgccgcatttctttatgatcatttcgaaaaagaggttttagttttacagttttcggatttaaagctttttgttcgttaatatgtttatgataaatttgctcattatcatttggaagaagttctagcatttttgaaaaagccttactttcggtactaggatctgttgctccataatatcgcattaagttaattgtaaattcagcacgatcaagttcattaaaaggtaggactaaataattttctttctcccaaacattataggctgcatttgcagcaattaacgctgtccgcttattaccatcttgaaaaggttgtaattttgctaactttgcaaatacgagccatgcatcctgtttagtttgcgcagaatgcttaaactcatcaataatcttttgtaaatcagctttataaactacttcgggaggaaaataatgatcttttccagctgtatcaattgtaattgcaatattatcatctggattatacattgaatttcttaaatgaccaggaatagccggatcctcttccttactatatacaaaagatttattgatattaataattccatcaactgtaaaaccatctttttttactgctttaattccagctaaagcatctttaaagattggtacatcctcattatcttgttccaaagcattagtatttcctgtatctaaagccttttttgtctgagcaactgtgcttccataaccattcaaactcccaaatgaggcaataaattgagctaaagctgtattatttgccataactatgctcccttctttcactattatctaataatacacgatcactttttagtttttcttactttcttcgctgagcagcaattttataaatgcgttcccaccattctttatcagactgatttttacattcattaatcttttttcttaattcatctagaggaactttaagaagccaatttttgattaatctagttgaatcagaatttaaattcattgtaccaatccctactttattttcctgaaaaaattctaacaatttatatcaacctataagtttcaacataagtaatatttaacacttatattgaaaagtaaaaatatattcagctaaaaattactattctaactatataaacttcataaactcaagtttatgaagtttatattttataattaaaatttaagtttcaaatcttcgactatttatcatctaaatctgtactgatcattgataaatcaatattagatgaatcagataaatcagcgttcatttgtgattcttgactttcctgcttgttagtttctttagtctgaaaactatcttgtttgcttaactctttcggattattaaagaaagactgctctaaagcgctaattatttcaccctgtgaaaaagataaggcgcaaggaaaatcagtaattccgaacataccaatgactaaaaagattaattgattcactgattcgctaggagccgtctgtgcttcaaaccaagcgctaacttcactatagtccggtattctaattgttttagtcttggtttcaaattttccattttggatattgtcgcttttttgtccattttttaaattactattattaaatttcatttgttgatttgctcgtattttagggagtgtagaaggtaaatctacttccccatacaatgcagtaataaatacaatggattggccaatagatgaaccaagcgagttttgaatatccatccattcttttactggtccttcaatgtacaattgtaaattacgtgctttagtaactgctcctctcggcatatgcttcgctcccattcattatatatacatatcattataacaggattttgtaatctatatcattctttaggacccattaatgctttcaaaattaaaactaagcccatcctatttaatacctgagcatatgatccatcgacccaaacaattggaattatttgatctccattgaaactcataaatttattgttaagtttctcataaagccgagtagttttcattggtactgcagccccaccgaacacaaacccaatcttaatacttgttccaatcttccgtagtgtttgagaagcattacttacaatctcatcagcaaaaggctctgctgctgaacttactactttaataactttttctttactgcctggcgcaaatggattttcatcctcattaagatatttttgtaattgacgaatattatcaaatccataattcttagtttgtaagtaatcaaccgaacgttgaaggacattatcgtatcctcgcataatagaattcgaagccatgatatttggctttccattagtaattactgtacagtcacttgttttaccaccaaggtcaaaacctatcgcatctttaatatttttaatgaattgattattaattttatctgctactttaggatacttttctttaagagaattaatgatgctattagccaattcaggataagcatttggcgaatttttaatcgccgcaaaagcaacttctccctccaatcctacaaaaacatttttgaactgcagcgatacactaattggatttttaaagttgtgaaatgtaacaatatgcgtattatccatatatcttttacgatagtttcttaaaacattaggttgttttgcctcactgattggtaatgcagttgtcatatacacgtccatttttaactgattatctaaatcttctccttttttataagcatcctggactcttttgccggctaaattgcttaatgtaagtaacaaagtaaggtcaacttcagattttcctgataagtcattgtaatcaaaatgcgttaacggcattgtactatctaaagctgcttgaccgactaaaaatcgtcctgcttcactaattgaactactagtaatagagacatccatatggtttaagaaatcgtccatataagcatctttttctgcttctgagctaaattcaacgggagcagttacatctaaggaatctttcatagcaattactgaaggacattctatatcttctccagcactaaaaatttgttttgcagtttctgtaccatcactagtaaagagagttcctttcaacgagtcatttcctgcatcatttgcaaaataaagtttataagtcatttgattacctccaaaatatattcgctacatagatgtcatattgaaacttatttgttacttatattcgctaactaaattataaatttcaatatatataacaattaacacttatatattaattctttttgttttaagtgtcaataactagacaaaataacatataagcaaaaagatttgatataactagagtaactttaatttcaattaagtgaagttctgccatcaagggactaatcttatttggagataataaaaaagacgatagttattctaccgccttaatttcacatttatatcatttatagcctataagataaccttgtccaaatttagacaatgttcatttactacattaagcttgccattatcatcaatcctaatgtactagtattaaaagtaatatgcgcaataatattcatttccagattactgaagtgtaaataaataaattgaaaatataagctcaataaaatgtagataatcccaattgaggctccgtgcatttgcgcaaacactgttgcaactataaatgcactaattccaactctcaattttgaattatcaacccaagatgctaaccaagcatcgacacgatggaaaaaactcttccgaaagacaatttcttccaaaataggtgcaattatcactacgtaagctacatagattatatttttttgaagtaattttacaatcaatgatgtatttgaattaccaattatatgattattaaactgtattacaattagtaaaaatataagttcaaccattaatggtaatagccctaagcctagtgcttccacaaaatttttccaggaaagccggcgaattttaggacgcagccataatagataggatattaataataaagtaaagctaccagctagcaaatatgaaccttcaattcccgtaactatgccagcatatagccaaattagcacataaccaaatatgattacccattcattaaattttaggctttgtcctttaagccataaagcatattttcttatttttgctgtcatattcatcaccactcactaattaacaactgttccaattgtcccaatccgttgaatttgaatcaattttctttgattaccatcaaatttcactaagtaaatatcggttgttttagaagaactatgagaacctttacgtgaagaatatgatacttcaacaatcccactaacaatttgcttttgatctataccactcacataagcattgcttccatcataagatgaagtaatttgttctgcatcaattatgctatgaccagttttatcaaggccattattgaacaacttcttatcatttagcactgaactagttgcaattccatgtactctattcttacgtttaatataagtattttgactatcataagtaaaatactcaataaagaactttttagtaattgcttgtaaatcttggctagcttcataagcttgggtattttcagatttagttttgttagaacttactaaattctcattaagaacactctgacgggctattttttgtctttcttttaagacctttttacgttgatttaacatttgcttgacattcgctgtttctttattgtattgaatctgctgtagcttaaatgttcctaaacaaattagactgacaatgattactatcaagcctataactgaggatattttcttacccatattaatcaccgccctcaacgttcataacttgcttagtcactggtttaattttttgataatttaataccttctcattttgtagatcataattcattttaattagataaacggcagattgattatccatagttttaaagctaaccaccgcagtcacaggcacctgattgttaactttaactttcccataaccaatttctacaccattattttctttgaaaagccattccttagtattaggatcgacattatatactttcaattgctcagctaacttagggcctaaatcttcttcaatttgggtcttattagcattccaatcatcatttgagtgtattcctccaacaaccttgcttaatccttcttgcagtttcttagaagctgttatttcagctgaatagtaattaaaagaatcgttaatagataatttgtttgcttcattttgttcaaccttattgatttggttgttagtaatccttaattgatctttgtaataatttaattgcttttgactcggtatgcttagaacagtagcaattacacacagaatcgcaattatccataataaaatattcggactcattttcctcatttctatcacctaattatttattccttctttaataatcttgattggatcaagccaagttccgtcatcagaatatccgctttgaactgatgaagtaattgctttcttggtaatacctaaatgtagatgcgagccacttaaagttccaattttatctccaactttaatttcatcaccttcattaactgtaatatcccctcgactgttaaacgcttcttgataaacttcattgtagccatctgaagatttaacccagacgtaccaccagccaacatcgttagcaaccttaaatactttaccgtcatgcactgctaaaattggttgaccagctcctacaatcgctgaaccaaaatcgtaaccatcatggaagtcatttccaccaccacgaatcattccggtatggccatattgttgaccattttcatatctagttgggccatctttaggaatagtcttaaatggccacccccatttaccactagccgtatcaccaccatcagtattgcacgcattattttgttgatcctgagcaaccccagtatctgcagtagcggcagcaccatttaagagactatcatttgagctaatgtttgaaccaccaaactcctgataagcccattgtgctcccggatcacgttgttggccgtattgattttcattaccagccataccctcataatcaataaaccaattccatgttgcttgatgaacatctgtcgctttccctaccgatgtttttactttggtataaccatggtttagctcgtattgcattagtttaatttcattgtcaagagtcagttcacttgggtctacgctcttaataattccaccagcaattaggcgttgattttgactccactgaaataagccattataaccaactccatttggcttccaaacatcaagtcccgattcacctattgcattaccgaccgctcctgctgcgccagcaccactaaagcccatctttttagttaaggtttcaaaaatagtctttgctgccttatactcagctgaatttttatccttccaatttccattactaataccgccagccgaaattgttgcggtatcaatactactatcacagccttcgtcgctacctactagcatcgcaataattaaggaaactgcaaataataataaagtaataactcctacaatcgaaataataatgctccaaagatgaattctagtcttccttttcaaatagaatcacctcttttataacaatggcagtaatttttcaattaaaatcagtccaacaataactgccaaaataactaataaaaattgtaattttggtacctgataattaggtacgtcgtcatcttcaattagtctttgcgcctgttgatgaacaactttattagtattttctttaaacgactttacttgatgaattgatcgtcttaataagtgttcttttgagggcttagtattctccttgtctttgttatgatgaattgccattagataccacccccataccgatccccttcttctttagtgatttgaactttaaattgaacattacgatccccgttgatattcataaggcattctgtttttttaagtttagttaatccttgtagttcatcgattgtgactgatccaccaagtgctgtctttagtcgtggcaaatcatcatctgaaatttggaaaaagaagcgaatttgaaataaagaaaacattttttgtacggcaatgatatatggatcatgcgaatttccatttataatcaaatctttaattgttggtgccgccatcgtaatagcacaaaagtttttgcgcatttgttccatcatcattgtgagaaattcaaccccataggcgaacttaggattaacaatattttcgacttcgtctagatttaagtaataccaaggaataaagtcaggatctaatcgaccttcttttaataatcgccgtagatgcataccgttttttacaatatctgcagataataacgttaaaattgagtaaatttgagcattaaatactgcttgtccttgcgctaataacccttgaatgttgaaggtcactacttgttctcgcgaaatatcagggaaacgtgtaataccgtcaaacatatcccctttctgttcctcaattgaactaaaagtattggtaatgcgactcattgattgtgacattaagctagttatatgaatctttgggtcccgttctgctttacgcttgcgttcagcagcatagattacaaaatcctgtaaagttgggtacatatcatgaggaaggccggtaattttgatattcggcatggtcttacgaggattagctacccataagttctgatcaatgtaaaagtctcctaaccactgagacaaaattgtcatatcatcaccagttgcgtcatcacaaagaaacttaaaaaagttagtaagttttgtaatgtgttgagccatcgagttaatctcatcaaccgtcccatcatcattaactactgtaggaaagacctcaaatggattaattaagttttctggtttatcaagacgaataataattcctccttgatctttagtttgatcagtatattcagacgaaacatcaaaattccgaataatcgctcctctcgagaaaacatcatcattcattttcttgagcaatgtagatttacccataccagcattaccagttacaaagaaaaatgaccgagttcggcgattatcccgttggaatggatcgaacataacttccccatttgttcgcgtatagccatagtaagagccattggggtcctccaatttcacgtgattaaatgggaagaaaccagataaattttcagcatcaataggagtcccaattggtttattccccatctcttcttcagacattgtaggaacaaagatggattcaaaatcatcaagctgctcatcagcatacctagccatatggaacattccgttctgacgaattacatcgtgaacacgcttatctaattctgctaaagttggcgcatagacaaaaattcgaaagtagattcgcttcataacttcgctttgctgagtaatcttttgcattaaccgcatttgatcattgtaattacctgcagattgaacattatctagagccttagctttcgatgaaattcgtgttgcttcttcagttgcagctttagaaatttgcttaacaatctgatcacgattttcagtccctaccgaaataacggctaaagtcgatggaccgtttgtgagattaacgccccagaacggggacattcctttagagggatatttataaattctcaagcacgttaggaagccgtctccaaattctaaataacgagcatgacgtttaagattcccctgtggttgtactcgtgctaagaagtctagatcataaccaacactttcataatgcaaaatatcttttttcttcatacctataaatacctctatcgttgcgtattaagattattaattcgtgtcaaaacttcttctttcctttttttgcttagcggttcaagaaataaagcacttcctccccaattcattgctgcattccgattattccttaaaatggtcttagtttttccaaataataataggaagaaatcttctgaaattagttgattttctaccaacatatttcttcgctgagtttgatgaatgtattttaattgcgtcatcaattgatgtttccttctaggatcggtttcttgactaatcgcaatattggtccgattgtatcgttttccccaataaatcttttgctccgtagtatcaactggaaaaggacaaatgataaatttcatatcacttaatgctgcttgtagaaaatgatagaagtcatctagcacgatattagcttctcgttgtgccatcgtacccacgcccagtcctcgaatatttagtaaatcagcatagccatcttccttttcttttaaggcaagaaagtgttcaggatcatcagtaatagctttatacgccaacaaattcatcatgggcgtataagctaatttttcactacggtaatgttctaacggatcttttccgttttctttctgtttacgactaaataaaccgctatgaattttcttttgctttgtaattgtattaattgccattactctgtcgctcctttcttatttcactaaagggcttaaattcgtagtaaccatatgatttgaaaagcttactttgccgatgagtaatcaacatccaaataacttcaaagtttcttttccctgggttagttcgaggatgtaaatccaaataaaaggctagaatcaccgaaagtactagaaagattactgactctaccccttgatctgccgggaataattggtcaagaaaaatacttggccctatcactaaggccaagcatgctatatcggtaagataaagccaccccaacttgactccttctcgtattccggctactacaccataagttttcatatgttccacctcgtttcttattgatagtaattaatcaggttttacgaacaagtttcgccaaaaaaagccttctcatttccgtattaagaaacaaaaagacttttcgttgattttatttaattgttactcatcatcaaagggatcactttcacgaccatggatatgaccactttgacttaaattaaactgccgatttttgagataactagcactacgttgttctaccccttttgaaagatgagtaacgtgttgtccaaatctttctacttttcctggtcgtgtgactgctggcggtggagtaggcgacgagtgtgtggttgtcggtgcgatattagtgtgagcagtattatcatagtaatcactatgtacgcttccttcatcatagttattctgtgggttaatatttgtacctggtgtattacggttaaaggtatcgttttgacttgagtttgtcccatagtgactgctaaattggtcattgcttacattaggattattaacttgcttgctaaaatcattattagcaatattagggtcattcggatccattgtaggtgattgattcatttggtccgcccattggctgttttgtgcatcattgatgccaacagtatttgagctaacttcatttgcattattcatttgatctgcctgctgttggaaattaccgtccgctggttcattccctaatagactatcccagttgcttaaatcctgaagaccgttattagcttcttgtgaaggtgttgatgggtcaatattagcagcagaatcagcattattaatctgatcagcttgatctgcaaaacttgcgttagcaccagttgtatctggatcatcaaagttaattccggctggttgttgatcttgatcgtcaactgcctgaccattatcaactaatccttcatttgctggattatctactgtatctggggctgcagttgagttggtattgtagctgctactgcttccttgactattgccctcataattatccgatgattgactgtttccatatgaactattgttagcttgtccatagctagatgattgaccctgactagtatttgaactattaccttggttatttgtttgaccattgctagttgaagtattagtaccgtaaccgttactttgagattgtccagtagcagtgttggtactatcaggctgtccggttgaattactgttactctgtgcagagttactactttgattttctgacaaaccagtagcggtattttgtgattgagcatcactagtactgagtcccgtattattagatgcactattattagtactattagcaaagcttcccatttgtgatgaatcagtgttgttagtatcagataaaccagtagctttatcagttccatgagattgagaactattgttggtaattccgtgagcattgctcttatttaacataccaccaagcatcgagacacttttacctgcgccacgcattgcaaatccaccaacagcaccggccattgcaccagttgccattaattgcccggcttcttcactaagtccctgagatactccggtaactcgttcaaaataagaaatcccagcaaaagaagcataaccaccagctgcatagataatcgcaatcgctagactacgctcgatccagctcaaattatctggcagcttacttggagctacattaataaagataaaataaactttaataatcaaaaccaatagtactaatgacaggaaccatccaaccactgaactaagaaaatctcgccatttttttgaactccgaacactctgtgctgcaataaacggtgctgccaaattcattaaagaaagttcaaaaatatctttagctaccctaaatgaagctacgatgagcacaattcctaaaataagagactgaccaattaagccaagccagttaacagaatatcgcgaatagtagctgttcatccatttagcaaatttatggtaatcattcttttcaatcgaatagccaccatcggtttgttcatgttcatcaactaaatggtaattcataacggtctcagcatctttatgctttttatccaatcctaatcctttcatagttggttcatccataaagtcaccaaggtccatgttctcaatatcatcatcattatctaaaacgttccagttggcaacgtttttaattttgctagaatctggcttgtactgataattcccccaatctttccgaattaacgtgcttaaatcaattacattatttttgattggttgcacagctaaatcttcactcatacctttattactagcacgattaatatctgaacgcgcgctaatagcaatatctccgaatccagggattgtactactgccaccagctacacgcatcatcattggtaagatagtcaacgtaattgaaaccatgacaatatttggcaaaattttgctccactttgaagcatgtcccattgtttgcatggctactaaaatgattgccaagactaataatgaccatccaattgccgaaacgacaacatacagaccatgcaacggagatctggggcttgataaggttccatcccagcctaataagccaaacatagcatcaaatatcttttcaaaactctcattgatatgaaaaatagtttgaactatcacattttgaaagaaaccagcaacagcatgcaaagtcccccaggataaatgaagataatttcgccaatcttcataaaagcgaattattttcccagtatcaccatctggaatactagaatacggtccaccactaaccgcttgatctaaactacttgaattgatcgctagtaatgataagcataaattcttaatcaatatccacatctattacgcccccttcttaaattgattaataaagtcaatagcattttcatataaagctgaatttccttgaaatagatcttctagttcagtgtaactattatgatttttccaataattataagtgtcctgaaataaccccattgcaacctcttttggttggacactatggactaggctataaatgttgctgctaagacttcttaagcgttcatgatcatttagttccgtatcagtaaaaattaggtcatttgaatctgcatgcgagattacatcatcattaacctcagtaggaatactatcgttaaactgagcttcaaagtctttcataaaactgccgctaactgattcctgtggattaccgcttaaatctaaaatttgtttataggcgagatcataattaattcgcttctcttttaaatctaatcgtcgatgcaaagaaacaattctgatatctgacaaggtagtttgatcgttgaattctttctgtaagaaggtatttcgatatggcatcttagtctttccatgatcaaaaatcggtttggctgaaattgaattaccacgttgatctattcgataaactgatcgtaacactaccatttcaccacccatgaattgcattaattcaggaaccgataaaatatcttgactaattaactgactattaacactagcactgtgccagtttccaacttggccattaatattttcaacagagactgtccgcttcccaattcgtttagaaatactttcagcagttgtcgttgaattggtcaaaatatataaaatattagaacagttgctttcaatggttttagcttcctgttcgttataatgaatttgtaactgttctagattttgtacgacaatatcaaacatcatattaaaacctaaacaaatcgaaattttcttagtcatatcccgaatggtcggcaattcagcaaactcatctaaaataaaatggacgcgacgaaatagctttcgcccattgctttcagccattccatataaaatattgaaggcttggtcaattgcaaacgccggtaattgattatatgttgagttattaggcggcgtgaccaagaataaagcaacaggtgcttctgaatatttaagccttgtctctgattctataagttccccagaaagttgattgcttgtcactttaagtgaaacatccttaagaatcggcttcttagtataagggtctaatttaaactttctccctaatccttgtttagcataatttttgtgaccttgaagtacaacttcttggtcaagcacatctgctgaattttttcgataattgaaactgattttaagtagaaaatcatctggcaaagtagtcttaattgcatattgaagattcccgaccttatcaattagctgtgtacgcttttccaacttatttccatgaagatcatcaaattcaacaactgcagtcttaaactgatatttcggatcagaaaattttactttaagcgttctagggaaaccaagcttagtaaaatcaagcgaattcaaagaagtcattttagcaatatcggattgctgatagattttgattccttccattgcactggagtaaatattcccagaagtttcatcaccggcaaatttactttgagcaaacgcatctaaagccatttgcctaaatttgctatagttcttttcgttgagcttttgcaatttagcaaaataaactaataatttattcttttgcgattttggctcattgtcttctggcatttctaaaagtccactatctacttcatcatcagtaggaataatatctccagatgaatttagtaaaacttctttagaacctaattctgtcatcatatgaaggacattatccatcgtgacttcagcccagttattattgcgtttagcatgatcaacaactgccaaaattaaagcatttagtaaattaatcgatgaattttgccaaaatttatctttggcattcggatctacataaatacttgaagaaaggctatttaccgcttgctgggtctcgtcatagtagccgtctttagcataatcaataatctgttgtaatgggttataactcattgaaaaatcaggattctgaatgttaagaacttcaacctcatagcctcgtttacgtaaggtctcataagacatttgataaagttcccctttggagtcattaaccaccattgaagactttttttgtgcgcgtgacaaaatatcgatcaatggcataacttccgtttcccctttaccagaacgagagataccaattaatagactattaatagttgtttgatcaattgagtaaaaacctttagctggttcaacaaatttcactttcccttttaagccaggaaaagcagataataattgtaaaagcttaggacacagataataacttgtgtaaagccctggatggtacttaataaattcagagtttggtgtaatatgtgcaactgggattccaccatagcctgggaaagaagcgccccgatctgcaatctgtggatattgccgaagtatttccttttctgtcgctaaacgatcgtttccatattgtgaatgtttagttggcttccagcgaattctcatcttaataatcatcggaaccaggatcaaactgaagaaaagttcaattccccagaaaaagccaggtgcttgatgcattactcgatagtttcctaaattactaaactcccagccggccaccactgaacgaaaagagtcttgagggataattccattgagaatctgtgctaaaaactgtccggaggctggcgaagttacccaataatacgaagcactaattccactggctaaccagcaaaccacatagctcactacaatagagtaaataagccatattccaattagaaatatcggtgatcctaaaactttctgatcctgtccgtctttacgatgacgttcacgatcataattttttgccatgacctaacttcctttcatttaaattccatcacagcataaaaaagttacagaaatgtttaagtttcgccaaaaaaagccaaccattttaccggttgactcacgttttacttctttcttgtttttaggccaacataagctccaattgcacctgctagaattaccaccccagtaacagtcaagtaaaatgctagtgaagcctctgtactaccatttggattcatatttggagcagtactaagattattagctttattttcggaactcacagcactgctactagcattagaactactatcagttttatcacttgtagttgcagtcgaattactgctagatgcagcagcaatcatattagatgtatcactagcattattcttggccatatcttgaagctcttctaatgtaattccttcaatagttgcaatcgtttctcctttagaattaagtaatgtaatttttagcggatctgtcatcaatgttttgttacttagcgcagttgagctaagattaactttaaaactgatattgtcattttttcgttgtattttcccagaatcaacagtttgatgttcctgggagccatcgctatcagcatcaatatcagttgctacaaaattaagcttttgatcatttccctttaccttatttgccggtaactcaatcttaattatctgtgaaccatcgtcattgttagttaccgtagcattaagattggtgtccttagtcttataagtatctggtgaagtaatttgaactgtattattaatatcttctgcgtgaacagcaattggagtagctgaaattcctaggcctaagatacttgtggcaagaagtgtattgagccataaacgtttaccaacagaattttgagtgatcttcttttccataccaaaaaccttcctgttattttattcaaaagtttactttgaaaaatgccggtataatcgcctcctttatccgacaccctaattaaaaaggactaatttatttctttaactttcgccaaaagaaaaagccagcacataggctgaccttagtgaaatagatttatttattggcttgagcaaccttatcagctagttgattattattagctttcattaataagctctgtgcctggctagcacggtagcgatcattcatattcaagttgttcattttttgaataacatcgtttgcctgtttcggatcattagcaatgatagccttgtccaagttatagtaagtctcagtcttgtacttatctaactcattggcattgttgctatgtaatgcagcaactgctttagaattaatttgatcttgtgatactgtacttaatctttttgccgctgcaacccgatcatgcatttgttgttgaagctgtgcaacttcttgttgatgttggtggttttgatataccgtatatccagcaacgccaactacaattaataatagggccactacaaatcctattaccatccgttttacgcccttaaccatactagcaacttgattatctactttttcttctgattcagctgttgtttgtgctgaaggactagtttgcggggtctgaatcgtcactgattgtggttggttcattttttgtaaactttgtgccaaaactaactgcataatatcattaacgtttttactattttctttgttactctgttctattcgtttattagtattttcctgttttaaaaggtcaatttcttttcgcaacgattcaatcttattatcacgagactgtaactcatgttttaagttaataacgtctttattattagcatttcttgcagcttccgaagtacttaaacgggcagtcaaatctgagattgtcttatctttttgttccagtttttcatgcggatattcgactcgactcaactcagcctgtgaacgattatgagcaataattgtttgccgtgcattcatatcttcattggtaacgttagttcgagtactatcaagttccttactgcatttctttagcaattcttgtaatacttctgtcgcgtgagcctgaacttgactagcatcttcttgagcttgaatctcataatggcgatttaattccgcttctaacttcttttcattttcgttaacttgtttttcgtgatctttccaagctcgatcatagcgatctagggccttgccattatattccttatctaattcttgttgggccatctttttctgtgttctagctgattcgtcaatttgttctaaagtcttttcataacttcttttagcctcagctttatcgacatttgcttgattatcaatttctttatttttctttgtaagggcttggttataatcattctgaatacttttttctacttcatcatgaatggttgctgcgtcattagcatgaagtttattgtattcagctaatttttcttgaatattttgtgcatagatatttctgcgacctagtagatatttttcatttgagctattgagtttattagctgcttgctctagcaccttgtttaaggtttttttcttttgatttacttgatattcaacatagcccttatgacctggttctaccggatctagaacttcaacagcaaactttggtgcttcaacgtaccctttattgcgaacgtcttcaatcgttttagtgactttttcttcaacgctatgtttctctttccgagaattatacgtatccatcttctttgcgcttggcttatcgttatgattttgaattacttgttcttttggattagacttctttatcataacggtctgtgaagtgttctccggataactattagattggtcaccttgattagagttagttgtttgtgaaaccttttgattattattcataggcactgcttcagaaaattttcctgagactggatcatatacaggcgctttacttgcactatcattttctgttttttcaatattctcaagcgctggaattgaaagagttactctacctttttgtgtatcttcttcagttggcaaaatagcaatgttatcgtcagtagttcctgtggaatcttgataagctgttttcaattcctcacaataatttatcttctcatcataatcgacatctgaattagagggatcattaaaaatttcttcaaagatactcttagtcaagttctggtagtcataatcaatactaaaattacttaaagtaataaattcatgaggattcccatccactgatccttttttccctatttttgctttttgtgttttatcaaattcccaaatggcaaaatatgaaaacgtaacaggcttagctgttgttgcagcaagagtccgtaattcatcaaataaatcttcagctgttttaaaggtagcgaatggtaaagtttgatttaatggagcgacattttcattttcttcactctcggatacctgctcaataatttttcgaatttcatcattattttctggtgcaaactcatcatcaaattctaagcgaacggtgtatggatcatccagcataaattgatttttcttttttaatttcccgaaatgtcaatttaagttagaaagaaagtagttgctcatcagtgacgtaggacatgaatacctcatatggagttcgatagcctagtgatttgcggggcaggttatttcgcttactcatcagttgggtcaccaattcatcaggaagattgcggaaatctagctgttttgttaagccgtcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgctgcgggaatttccgaagccactgacctaagtgttggttaatcgcatcagccgtcttttcgtgcacattgagtacaatttcgaccttcgattggcgttcggtcagggtcattaccgccccttggtgctttttgccttggacggtatcagcttcaaggtgtccaaattcagtggcatagtgcggaaagtccttggcacgctcgtgaatacttcgccccaattggccagccttcccgcggcgctcaatatagccattcgggtgccgcttacctcgcatgggcaaagcacggacatccaaaccgaactgcccccgttcaaacatccggtaaagagttcgccggttacaactaattgggcgctcagcgcgcccaataatggtgtcaggcgtccacccctgggcaattttgtcgttgatataagtaagttcagccagtgacaactgagtacgttttcggccacaacgttgcttattgcgcatatagtgatcttgataatcagcaattgaggcaccggtttccaggtaacgataaacgcgataaacggtttcggcgctacggttgatcatttgggccactcggtacgctttaagcttttgcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgtttcttaaaaaatcccattatttttactccttcatcgaattaatttacattcttaaatttatctgctatttttcattacacaactttcgccaaaataaaaaaagacgccatgaatttcttcatgacgcaaagcataatggcaagcgattaagcaccaaatgattgactagtataattcttcaaaaattcaacaataacaaaggcaatcaaccctacaactagtccaacagcagccttttgccacttctttttaccagaccgtgcactttcttccccacctgatgtgtagagaattgctccccaaacaacgataaatacagcatatgctgcaagaatgaccattaggccccgtgacaatttattaagtaaacttgaggtaccaccaattggatcagcaccaagagttaactcattcattgctttggcatatgcggttgggaaattagtcattaaaaacttatccatcaaaccgaataacctccttaaaattaagatgtcatcaatgattgttgatgatcagtcatcagtttaaggaggtttttaatttatttaactttcgccaaaacttactttttctggtcagattcaataattttatcttgattattttgatctaaaaaatttgtagttggaattctttctttagcaacttggaagaattcatctagttttttaacactatctaattgccaatatttcataagtttagttgcaaattcgtttagttgcttatccgtctcttctttttgtaaatcacgcagttcacttttttccttagctaatttctttgctagttctttgatgtaattttgctttttagctgttttttcagtttctaacgttaattctttctttcgagccattaaaaattcgtctccaatttctgttatttactatctggaatcaatccaaaattgattttgcgaccgtttttattatgatgttgcaatttactacgttcaaattggtcacgaggatcataaaccttagcactaattttgtggtaggtattatcagatttattttctaattgcaaaataatcattgaaagtggcgctgttacttcattttcaattgttctttcaagcggtcttgcaccatttttaacatccgttccaatatcagctaggtactcaattaggtcattgccataagcaaattgaaagccatgttctttcaagcggtcatttaatatttgtaagtcattttgagcaatttgcttaataactggccggggaagcatattaaatacaattttatgttcaatccgatttacaaattccggacgaaaaatattagttagttccatattgactaacttcttaaatgcagtatgcctccgaatccgttgacgttcactctggtcaatttcgttcccttcaatcgttttctcacttgattggcggtcattgattagttcagctgcaatattggttgtcataatgataatgacatttctaaaatcagttgatcttccaaaccgatcccgtaattcaccagcatccaggatttgtaataggcgatcatgaactgctgaacatgctttttcaatttcatctagcaataaaatacaataaggtctgtgttttatttgatccgttaatagaatttgaaaatgatttagggaatcgcgctcactaaattcagacatatcaaacctcactaaggcgttttcgctatcaaacataaccttagctaattgcttagaaagtgctgtctttccagttccagtcgttcccaagaataaaaaggacgctaatggccgattaggtgcttgcaaccctgctttggcaattgtaatcacattagctactgattgaattgcttcctcctgtcctttaactaccttactaagtttatctttgatattacgtaaacgacttgtatcattacgcaaaacattagtaatgggaattcctttcatttcctgcagtactaatgctacttgtttaatatccacatcaaccacatgattagtagcagcaattgcgccagcttgatcaatcaagtcaattgccttatctggtaaatagcgatctgcaatataacgaactgataaatcaaccgccccagcgatcgcagaatcatcataatgaacgtgatgataatcttcatagtttttcttaattccattaagaatcttgattgatgtattccgagaaggttcttctacttttacttgttgaaaccgcctttgtaatgctggatcacgctcaatgaactttttatattcatcaattgttgttgagccaattaattgaatatctccgcgagccattgctggttttaacacatctcctaagtccatggctcctcccgtttgatcagcacccataattgtatgaatttcatcaataaaaaggatattttccccattagtttgtttaaattcattaatgatattcaacattttcattactgtatcttgttgtcccagcgctgcaatctgaagaactcgaatatgttttccttccagttgtttaccagctttatgtaaagcaattaatcgagctaatccttcaataatagctgtcttccctacaccggcttcaccaatcaagattgggttattcttagtctttcgattaagattaataatgacttgcttaatttcctggtttcgagcaacagctttatactcatctggattcttagctgccgctacggttaaatcatccgtatatctatcaatattaggtgtcttttttaattcttcagtcaattactaacaccccttactatggctgacttaataacacagcttctaacaggctatcagtcttctttagaattttttcatggttctctattccatatagatacgctttaattttgccgtgattcttctcaaaagttacaatgatctgtttagtaataaatggattatcaattaaccattcttcttgattaatttgattactaacaaaccaaaatgaactatcaagacccgccttttttaattcgctatcaagttcgtaaaatcgcaagcggcttagattactctttggccatagctgcttgctccagcctattggcgttcttattttagtatctaaaacattcaataacgcttcttcactccagcgaaatgcattgactcgtgagtactgattaattcgctctgcagtttccgctaaatattctttttctaactccatcacaattccttttccttcttagtattacaaactaaggccttcatcatcatctcggccgccaaaataatcattaatatctatatcatctgctggttgatcagtatcatcatggcctttagcctgttcagcctgctgataagactcatcaatttgcgagctgtcgcctaaatcaaccgtctcctcttctggagccgttttggttgctgtaggtttttttaactggaaatcacctttatcaggagtagttatatcgtagttattgatattaattgttgaatcaagatcctcgtcactttctggctcatactgcgaaacaagatcattcatgctagtttccgtttcattatcatctttttttacgtttcttaatttaattggtggctctgactctgattcttgctggtcattattattgcttgacgaattttccgagctggtttgagccggttgcgttgtcttaccaacttctaatactcgtaatttttcttgtagtttatcctgtaattttttagctgactctattttctcatgcaattttcgattttctgatttgagcttttcaataggttcgaaatagtcaccttttgatagataaagcatactattaatttcttttgcatctttcagcttaaagattatacaattcagttctttgataatgacctcgtctaaagttaatgcccaagtcgaatttaattgcgctgaatgcgcaaagaacttttcatattgattgtcactaactaatatctttaattgagatccactattactttcacattcaaaatctaatagcacatcattacctcaatttcttgagactttagtattcctgtaattttcatcatttttatttacctcgctttttaaaatccggtataaagccaataaattcccgtcccttatattcacttggccaagttgaccactcaaattacctttct

SEQ ID NO: 52 - DNA, 42311 bp, Artificial Sequence
  Based on Lactobacillus reuteri
tgacggctttgtcggtgcctttcttagaaactctccagttcgaatatgcatttcctgtaataggctggtttgagccactcgaggaagaactgttaattgttctaggattgtatttaaactagcttgcagttcaccattcattcgggcttcaattaaaccaatcatggctttagccccctgcttagtccatgacttgccctgtttcttcatccggtaagtaaaagcccggtgagaactttcgactgaaccaattaaatgaatatccttaaatccgcgcatttgtggtgagaggatataccgccaatttcgctgtagatactttcttaaacgcattaggtcgtctgcttgtttttccgttaggttttgtgattcataagtatctaaaatattgttagctctgattgatcatgatgacgaacggctttaattgctcgcatggctaattcgttgtgccggcctaaagtatgttcaattttctgtaaacaatgatagcggtcgagaaagtattcaccatgtgcaccttgaggaactaggcttaatagcttagctggttcgtaacctgggccagcgtcactggccaaaaagatcgtttgaccggcaagcttataatggcggtctaaataatcacttagtcgtgcttcaagccgtccttggtgcccaacactgagaaagtcatgccgattaatgatttgattagctactcgctcataaacccgataatggtgcacaagagtcagctgacctgcttcttttttacctttaatcataaaggcatcaccctcaatagttaaatttttaggcatatggcgaggagtagcttggtgtttcttttgcttgagtttgtttagctacctgatttcctaactcatgcacggcgtgcattaccgaatcggcagtaattccgctgtcaaatacaaggttcaaaatgtcggcagtattgcgcattgtagttgtttgggcaatcttagacatcatcattaagtagtgtggcgataaacgacgacgtggtttaatttttaattgttggtctaagtaaaattcacgtttctttgtcccagcctgataataccgtcgttgaaaagtcaccgggccaaagataaaattaagcgtccgtggctgtttattgattacttgatagttcgctggagcttgggactttaagcttcgatctaagctttccaaaaagttttgcatgattacttgtcctaactccaataccccttttaaaataatctgttcagcttcaaataaactgcctgatttcaccaaattctgctcgatttctgttaaaatatccatgaggaaagacctgcctttgcttagtattcgacacactaaaggctactggtcttttctttttttgtaaataagtaaattggtctacaaaaaagatttccacgaccagatgaattattcatccaacctatgaaaatcttacactaacgaatattttaatttcaagttaagaagtatataatattgctgtataaaataggaagggagaaagaaaatatgcaacaattatcactgttaatcgttatgttagcggcgttaattattcctattattatggcgcggtttaaggtttcctcaattccgaccgccattgctgagattatcacggggattattctgggaaaaagtttcttaaatatcgttaaccccaactggaccctcaatatgatgtcgtcgatgggggttattatgttaatgtttttgtccgggatggagatcaattttgacctgttccgcaaaacgcccgggaaaaagcgtgatagtaagtcgccggtaattatggcttcacaggcatttggcctcattgttatttcttcatttgtgattgccttaattattagccgtttgcacttatttagcgatattttgttagcaacaattatttttttcaaccgtcgccctcggagttgttatcgcaacgttaaaagaaaaggatattttacaaaagccagtggggcagaccctcttattgacggcggtattaggggaagtggtcccgatgcttgcattgaccttctatgcatccattaatgggggcaatgccaaacgcttgggcttaattgtcttcctcttcttggcagcttttttcctcttgcgacggtttaagcaaccgtttatttggtttaataaaatttccaaatcaaccactcaacttgatattcggttagctttcttcttgatctttgccttagtaacaatcgccgaaacggtgggagcagaaaatatcctgggagccttcctagccgggatggtcatgaaactgcttgagcctagtgaagcaactgaagaccggttaaactcaattggttatggtttcctgattccgttcttctttatcatgacgggaccgccttgacttgaagaatttatttgctaaccaccaagcgctagccctgattccgattttggtcatcggctttttacttgctaaattgccaaccatgttcatttatcgacgcgttttaagccccgcaattcatttgcaggcagctttttagtagcgacaacgattaccttggtattaccaaccttgcaagttgcgcggaatttgcatgcaattactggtgcgcaatcggatgcctttacattggccgccgtgattatctgtatcattgcgccaatcgtcttcaattcaatgtataagcttgaaaagtctgatttgatcaagcaaaaggttaattttatcggaaccaacaccttaactgttccaatttccaacaattatataagaactgtatgacgtgcggatggtgacggacaatgaaaataacttcaagacctataatagtcaggtgaagcatttagagtatctcccgactcttgacgcggaggccctggagcagggaggctactttgattgtgatattgttgtcgttgggttcttaaatgatcataagtcagcgcgtctagctcagattgccaaagaacatggggtaaagcgggttattgccagccaaaataatccgcggttggacccgaaagatgtcagtgctcttcgggaaaaagggattgagatctttaatagtttcaatgttcaaagcagtgtcctgcgtgccttaattgaatcaccattgatcttgcggatgctgaccgatactgaagctggcctatacgaagcaaccgtccttaattcacgttatactggacgtgaactgcatacattgccatttgttaatgatattacgattagtcggattttccggaagcgcaagccaatcgatccgcatggtgatacgattatcgagtatggtgatcatatcctctttactggggaccggaaagcagccgaagaggttcgtgaagccttgcgcggcgttaattaaaatatttttcgttaatgtaattgccgtaaaagcgctattatggtaagattttaaatgaatttagaaggaggcacggattatgccattagttcatattgacttgattgaaggccggaccgatgagcagttaaaggctctcgtaaaggatgttacagcagcaatttcaaaggatgccaacgttcctgccgaacgggtgcatatcgtgttgaatgagatgcgcaaagaccgctatagtgtagctggtaagatggtcagcgacaagtaacaacaagagagtcatcgggggaggcagttcagtctttgcacggtggcttttttgtatgatctaaaatccatcaagtttcttcccattatataggtagaaactgctcgcaattagcagcgaaaggatgaatataattgagtgaacaacaatatatcatggcgattgaccagggaacgacgagctcacgggcgattatctttgaccatgacggaaataaggttgcgatcagccaacaagaatttcctcaatacttcccgcagccagggtgggttgaacatgatcccctggagatttgggatagcgttcagtcggtgatttcaaacgtaatgattaagtcccagatcaagccctataagattgcggcgattgggattactaaccaacgggaaacgacggttatttgggatcgccataccggtaagccgatttataacgcaattgtctggcaatcaaagcaaacgagcgatattgccgaacgattgattaaagatggttataaggatatgatccacaagaagactggcttagtgattgattcatattttgcggccaccaagatcaagtggatccttgaccatgtccctggtgcccgagaaaaagcggcgaagggtgacttaatgttcgggaccatcgatacttggctactatggaaattatcaggacggcgggtccacgcaacggatgtgactaacgctagccggacgatgctttttaatatccataccctcgagtgggatcaagatatccttgacttgcttgagattccgcagtcgcttctgccagaagtaaagccaagttcagcaatctacggttataccggtgattaccacttctatggtgtccagattccaattgccgggattgcgggtgaccagcaagcagctctctttggtcaagcagcctatgataaaggttcaatcaagaacacctatgggactggagccttcatcgtcatgaatacgggactaaaacccacgctttcggataacggcttgttgacgacgattgcgtacggtctggacggacaaactcattacgcgcttgaagggagtatctttgtggccggttctgccgttcaatggttgcgggatggccttaagatgtttaataaggcaagcgagtccgaacaaatggcagttgatgccaagaccactggtggcgtttatgtcgtccccgcctttacgggattgggcgcaccgtactgggatcaagaagtgcggggcgcaatgtttggccttacccggggaactgaacggggacatatcatccgtgcaaccttggaagccattgcctaccagaccaaagatgttgtcgatacgatggtcaaggacacccaattaccactaacagcactaacggttaacgggggcgcttcacggaacaacttcatgatgcagttccaggccgatatcttacaaacgccaatcaagcgggcagcaatggaagagacaaccgcgctgggagcagcctttctcgctggattggccgttgatttctgggaagaccaggatgagttacggaagctatcacggattggcgaccagtttgatccgcagatggatccgcaaaaggcagctgacttgtatcggggatggcaacgggccattgcagctgcgcagttttatgggaaagattaattaaaaacaccgctcaccattcaacaaactaatataaaaggaaaatgagagaaatgaaaatgaaaacaccggttcagatgactgatgatttggcacactttattaaggaaacccgggaagacgcggctttccctcatgaatcactctatgttgatttgttagaacagtggaaagttttaagtcgttaccagttagaatacgctgataaggaaagcaaacgcctctacaatgcctactggaactcgatgtcacactggtataagatttttgataaagagcgggagcatttattagaaccaactgccttgcccagtgaggatttaatggacttctgcgcggggctgattgaggatctcatggatcacgtccttagtttggtaccaccatcgccccattcgacgattattaaattaactgacttccgggttttgttgagtaacgagttacaaaaaattacccaacttgacctcgagattcaaggtccgattgactttgcgatgatcatggattattggaagatgttgggtgaaagttttgatcgggaaaagatcaagtaagtgaataaaaaacaggccctgtgtgacaattccagacctgttttttagtttacccacttttgcaagtagtcaatcaatactttcgcgtcctcttttgtcagtgcaaaagtattatcatggctgatattatcaaaatcaatatttgacaccagcatttgtagctcaggctcgtcagcgttctgataaatactaagctcattaacgcactcatcatcacgatcttcgccatcatatttaatatggagccacttagcttgatgatcgatttcatgtttttccacattctcacctcaaaactctcctttcattttagcacgaagctggtgggcccgggtaattactccgcgccgccattgcgaaacagctgcccggctgacactatactcatccgcaatctgccggtcactcaaatggtggttgagtttggcaatcaaatatcgttgttgaacgcgggacagtggtggtagaggtagttaagaaagtcgctattttccaggtgagcaaatggcgcggtcgctgaatggtcaaccattgtcttgccgtagtcatgatcatcttcttcgctgtcgagggtgtaattaaagaggaaactttcaagttgctgccgtcgtaaccggtccagtaagcgccagcgcattcgttgataagcaaagcacatcaagtcccgttcgttttcgacttcatctttctcttgtaagaaatcagcgtaggcctgggcaaagataatcgaagcatcttggacaaaatcatcatagtcgtcccggcgtggtgagatcccgagactcttcaatactccatggacaatcgtgatccgcttatcgctcatcagaaaagttaaaacttcagaaattttttgataattcattcttgagaacatcctttgaaaatattctcaagagctcttgagtaccgttaacttaccaaaaaatctgccgtcttagcgaacgataaaatagggcgaaagtgtcctaaaaagacgttgacagggcagatttatctcagtatcttaatattcatgttaaaagtgaaacgttttacagcgaatttgcacttttttaagatttgcttggaggagataattgtggtacgtaaaatcattgatatgagcatgctagataaattaaaaatcgatggggaggtggcaaactatctggttcagtgggataacaccttactgttaacggcttacgatcaaaatcggacgtttgtcttaactgcggacggggaacagctgcttattcgggaacggttgaaagatgtccttagtcgttttgcacagacgaacctaatttatccataaatttgcgagaatacccccacttctataagtaggggatgaatcgctctcttaaagcacgttagtgctttttcttttgttctatgatatatttagtatatatctataaaatgtggtgataacaatagaattagatagaaatcagcattcagtatacttacttaattaccatttggtaatggtggttaagtatcgtcgaaaagtaattaacgatgaaatatctgaatatcttaaacatcgttttgtagttgtgggacaagcatacggcattaatttgcaagaatggaatcatgatcaggaccacgtacatgttttgtttagagcaacgcctcatacggaaatggctaaatttttaaatgcttacaaatcgtctagctccagaatggtcaaaaaacaatttccagaaatcaagcaatatctttggaaatcagccttttggacacaaagctattgcttaattagcactggtggagcgcctttagaagttgtaaaacgatatattgaaagtcaagggagaaaataatggttctaaaagccgttaaaatgcgcatctatccaaattcagcacaacgaaatcagctctggcaaaccttcggttgtgttcgttttgtatggaatcaaatgcttaatatgcaaattgaacggcgcaagaataatccggaagctaaatttgtgaatgcctttgggatgaataatctgttgaaacaacttaaggttgagtatccttggttgaaacaagcagaatcaactgctttgcaaagtgctaatcgcaatttagccgatgcttttcaacgcttttttaaaggtcaaaataagttccctcgatttaaatccagaaaatattctcagagctacaattcaaagtacgttaatggcaatattaaagttttagattgccatcatataaagttaccaaaactcggtatcgtctattttagagctggtcgattgccaatgggtaaaattaagaatgtcactgttcgtctgaacgttgctggtcaatattacattactgttttagtggaaagcgaaaaccaaactcttcctaaaacaagtaaatatattggtggcgatttaggacttaagtcattacttaatctttcagatggatgcaaggaaccgatcaatcattttgaagacaaataccataaaaagttgtatcgttgggagaaattgcgtagtcgtcggttcttaaaggctcagcaggaaatcgcctgggatcatcataataaagtgttagttccacggcaattagatgattttaagaattatcagaaagctcgtattatggtggcgaagtatcggcaaaagattgccaaccaacggttggatcagctacaaaaattcactactaaattggttaaaaagtacgacatcattgtgttggaaaaacttaatactaagggaatgatgaagaatcaccatttagctagagcaatcgctaacgctagctggtcaaaattagtagatgtgttgcaatataagtgtgactggtacggtaaaaagcttattcaggtcaatccgtcatatactagccaaatttgtgctaattgtgggaagaataatcatcggttaggattgaataagtcggaatggttagcggtacgtgagtgggattgtccaaactgtggtaaacatttagatcgtgatattaacgctgcacaagtcatcttgcaaaaaggattagctatccgatagataaagttaggctcgggacgagccttggctaatagtcgtaacctctgcttgaaggttcgttcagaatcggtagggtaagtatgcgatgtttccagaatctcccacttcaagcattaaaccgtaggtttagctaagtgggagtagttcaatacatggttcatttgatggaagacgctagtgagctagaaagcgataagcggatagaaatgattatgaatggtcgcgagggagataaatatcatattcaaatcgccacctctgaacgtacttttcggcgaattgtaagtgctgcagatgaagttgctaaggagcaactttctctctttgaatattggatgtatcgcctcggaaaggtgaaaagggagatcttcgaacgaacctactttggtgattattgcgtttatacgaaacttcgaaagctagcactcgatctctttatccagacagttttacatatcctgaataaggcccataagaaagtatatggcgaagaaacgccagcagaacttgtaaaagaagtaaaacgggtgataaataagttttaatgtaaaaaatatcacaaaaatgcacaataaataaacattagtccattagcttattataataggtggtgaagaggagtagcttaagtaatagaatggagcatttttatgactgaaaagaaagatgagtgtggcgtaaaatacacactagatgttttagaagatcgctggcaaccacggattatcttttggttaggctttcggccatttaccattgagggattacatcaattgctacctgagttgacagatgttgcttttaaggaagaaataacatccttgcagaacttgcgaattgttaatccagttgttgatgaagaaaacaagtattcattgaccgatgatgggaatgacttacgtaacatggtcctaaccatgagtgtctggggtcggcaacaaatggatgactctgctaaccgagcttccacgcagattgttgagccggaaaaagataccagtatgtcagaattgataaagtataatgagaagcttaatgaatatatgtaatgaacggtgagcgcctaaggaaagttttctgggcgcttttattaggcaaaacaaccaaatttgaatttgtaactaaaatgaaataaacaggtgattaacgatcagatgattaacgatcagaattcgctatttacccgttaaaaggctgatataatcacaaggaaagtgagaaggaacttgatgatttgacgaaagtgtgaaaaagttatgaaattcgtccttgactattcatattacattcttaataatgtattaagtaattataaatttgattgactgacaactgatattaaaaaagttcgcaactcgttatttaccattgttagtgtaggtttctagtaatgtaacttgttgcactagtggatttttttaattacggcgttagtcaaaaatgggagaaattttttatgtcagacgaaaatagtcgacccttgaataataatgatgatggtatgcaacaaccggaacatcaccatcaccaccacagacatcatcggcgtcaccggggatggaagatcttctggtcagttgtaggggtattagtcctagtcgccctgttctttgcgggaatggcatggcacaacctaaaatcaacgaccgatgatatgtatagtagcgcgggtgctaccaagtcacgggatgcgcaaaaggtccttgaccaaaagaagccggtctcaatcctcctcttagggaccgataccggggcgcttggtcgggactataagggtcggacggatacgatcatggtaatgactttaaatccaaagacgaagacgaccacgattattagtcttcctcgggatatgaaggttaacttacctggttatccgcaatattcaccagcaaagatcaatgctgcctatacctatgggggagtcaaggaatcgattaatacaattcaagaccactttgatattccaattgactactatgtattggttaacatgggtggtttggaaaaggcaatcaaccaagtcggtggggttgatgtcaagtccccattgacgtttgattatgaaggctatcactttgaaaagggtgagacctaccatatgaacggaaagaaagcattggcatttagtcggatgcggtatgacgatcccgatggtgactatggtcggcaacaacggcaacggttagtaatcactgctctgcttaagaagtccgtttcatataaaacggttcttaaccggtcattcttacggtcagtatctgataactcgcaaactgatttaacctttaatgatatgatgcggttagcacaaagttatcgtgatacgaacgaacacatcgtccaagaccatgcgcaagggcgagggcaaaatgaagatggtcaagcctttgaagtggtgccaacgagtgagcaacaacggatcaccaacttgttacaaaatagtttaaaaaattaaatacatgaggagtagaagtcgtgaatagttcacaacaaacagcgaataatacaattgatttgcatcggttaatgatgctctgtcgtaaacatattaagatgttaattatttggacattattagccggagtattggggtatgtcgtggcccagttcgtcgtggtaccaaagtatacggcaacgacagaaatcttggttaatcaaaagcatgaaagtaatgataatgggcaagcatataataatcagcaagccgatttgctattttcttaaatgtatgtttcgcccaattttttgctggtcttatttagttatcttagtactttttttgttttttatacttcatgaatttcatattattattaaattctagactatttaataatgtaagtctaagtctcaatcagtatagtaaattggagactgccaaagctagacatattgatatagactgaactcttttagtatggctgaatcgtaaccgcttactttgattacctacacttgtgcacaaatataatcttggctgatctaatataagcgaggtgataagctatgatacaagtagttacaatcaaagactttagaaaatcatttgagaaatacgctgatgatgtggcaaactataatgaaacaattattgttgcacgtctagagcaaaagaatgttgttgtaatatcggaaaaagaatataactcttggcaagagactaattatctattacaaagtaaagcaaataataatactttggctcattctactaatcagttaagtgattctactaaatatcattttttaacacctaaagaatttgagaggatagcagctgatgaccaattatgttgagcaattaaaattgtttgactttcatcaacgtaaatggcaatttgtagaaacaatgccggctgatttgtttgaagaaatccagaaaaaggttcaattagtgattaaataagattgtaattcttgttatagcaaaggcatccccgtattcttttagtgaggatgccttttagcttatccaacaagcaaacaggacagaaaaacgtaaagatattctcttggcgcgttgtaattaatttcgtattcctgttctaacttatttaagcggtaatctaacgtcgagcgatgaatttgaaggtcaagagcggtttgtttcttattctcgtgatttagaaggaagagtttcaatgttttaaatagttctgaattttcttttgctagtttctgtatttggggacttagataactattcaaagactgatcttggcggatatgatcaagaagatcgagagcaatgtaatcatgatattgattaaacgtgtttgctttccccagtcttattgccttaactgcttgttgatagaattgattaaactggtgcagatgagtgaaagaattgctcagccctgcaccagttttatttctaattaaataaggggctaactcttgcataatcgttttggtgatgagcggactgctattttccaccatataaacattgtaatcatcatagtggaaactaataaacctcgttaggatcgttcctaatggttggatattagttgttggagcctttatacataacacacttaatggttggatattagttgttggagcctttatacataacacacttaatggtcgttttagttgatgagggtcaaattggagacgatttttaatttcacttactgaaatgtttggccgcactagaatatcacgaagcaaaccctcaagattgtttccttgtgattgataggggaagttatgcagcccgactgttgctgaaattttatcaatcactgattcgatcgttgatttgtccttttcaaagttagaacgatcaacaataacaatggcaagatagaagtgatctgaattccgtaaaccgatcttttgcaaatagaaaggttggttaaagtcggcaaatcgatactcttttccgttaccttctcttattgaatgcactgcttgcactaaatgttcatttgcgttatctgcaactctaatatatcctgccttaatggtctttaaccaatcaactaggactggcttaccttttccttcactatgcccgagaagctttaaactggaatcaaaaatcaaaagcgaatttgtaatctttgcttgaataacctgtaaaattcgttgaacaggatgcttatacgaaagagcatcagctaactgattttcccatcctaagtagtcaataacctctctttgtaacaaatttaaaagcgcctctggagtccgggtagtgcggatccacgattgttgcttattacttaacgatttaggactaattaggattttacttaccattttattaccctgatatatctgaaacgcagagccagctagcttaaaatttaacgggctaatgtctaattctcttaatgagttagttaaataataatcttttgcgactttactcacaatatgttctagtttcatctgttttctcctacataatgtagtaatttttaggaaataattactgctttattgacgatgatatatgaatttctttctattatactttaaaacataatgtgaaatgaactacaaagtaattattaagatggagaattagtaaaatgaagaaattaattgttacaggtatagatggtaacttagggagagtggcagctaaagaaattcaaaaattagttccagctgaaagattaatcttttgcagctataacgaggatgcgctcaaaccttatgacaaagttggcattgaaactcaccaaactgattttaatcatgcagaagggctaggggatgcatttaagaatggtgaaaaattgctattaatctctatgccgtttgttggtgctaaacgtcaggctgcgcataagaatgttgtcgatgcagctaaagaagcaggtgttgaccaaattatttatacttccttagtcaatgctgatgatccaacaaatccaagtgttgaaaagaaggatcatatttatacggaaaattatattaaggatagtggtctagattacattttcttacgcaactcgcaatatgccgaggcaatgatcactaactattttacctacgttaagggcgatggtattttgaagaacaatcaaggggatggcttaatggcctacatctcccgtcaagattgtggtaaagcggcggcttatgcattggcttctaatgattatcactctgcaatcttaaatattaatggggcagaagcaatgacaattagtaaattcattgaaattggtaatgaagctactgggaacaatgttagttaccaagagattactgatgaacagaactatgctatttttgatgcaatgggtgttcctcgtacaactgatggaaagttcaagaaagactctgaagcaccattctcaagtgacgggatggtaacgtttggtcaagcaatccgtgaaggaaagatgagtttgaaaaccgatgattttgagaagctcacaggtgaccaacccctaaccgttaaatacatgtttgaacactcggacgacttccaaattggtgcccggcactcacaggataagtaagttaaatccgatataatattgctaaggtcaatcagcgtaaatatgttggttgattttttagttcctaactcgtaagaataacagtaacaatagtaattattctaaaatatagattttatactcaataatatggtaaaattatatcgaatatacgctcgatgacggggtgctgtttgtggatacgattgaaatattgagtgaaactatctcgttaattaatcagctctatttgaattataatcaaatatattttagtggacatccaaagatctataaaatgaataaaacatcatgtacagatgcattaaacgaagagatattattcaccattccaaaatatctggatttactaaatcagtataaacttaatgaaattaatacctcttgtaaaaacttattaccatatttaagatatagaataaaaaggtataaaactgcgacagaaaagttaagagctaaaagcttcttagaaagaactggcgaaggtgcttataatattggaaaagtaattaatgatttaatgggttttaggcttattttaccagatgtaaatatgaataaagataaggttaagttaattcttgaatattatagagacaaaggaataatttggcgttattattacagaaaagataatggttataaagcatttcattgttacttcaaggaaaataataaaacatttccgtgggagttacagatttgggatattcaagatgaagaacaaaataaaaaactacattctgctcatgaaaaacaacgagataatattttagaaggaggaggcaataaatcatgattcaattagtcgaattagttacagttgataatgaagatttagcctaccactatggttcagataacttagatgaagtgtttgaacatgaaagattctttaatgaattgattaaagatattccattatcgtttagttcgcatattcttgctacagaagatgcttcatttgattctttatgtgaaaaagatccatattttaagcagtttcttgcatatcacgacttgaaatttttcataaaaaaagtaaaagaaaaaagtcaacttacagatgaggaagtggcgggttatttaaagactcagtttaacttacatgcatttcctcttcaaaaagttctatattatagttatgctgactacttagagagtaagggacatcgtcttttcttagcatcatttcaagctttcgaccatggccctgttgatcgaaaagtatggcgaaaggcccaggataatttaaaggaattgcaagaaaagaattatgattttatccaaaaagcagcattaaatccttcgattaaggaatttattgataattcggtcaaaaaatatgctaatttttttgattctggacagcgatttgagaattcagaccaaaatccaactcataataatggtacgccatgggatagagcatatagtaaaggacaaaatacgctactatctgatgatgatataaaaaagtatcattacctagaacagataccttaactctttatcaccattagtcaaaaatatggaggtacaacaatgttattcattcatcaaaccggttttgcataagtggcctaagtcaattgggccctgaaaggactattatgcaaaatgttcaattgttatgttattcatgactatatttacagtcatgatgacaaagtatatatgtattctgaattggtaaaggcgctgaataatgctaagccgctaatagattttactttctttagtacggtgactctttaccgaaatgttcacagtattaaacgtgtagtgtcaggtgcaggttcctcctttgagattgattgtgatgattgcaaaaaaattgaggaacaaaaattaaaagacttgtacaagaaagctaagcaatggtatgaggttgccaaagcgcatgaagcttgggatggtcagcttaactacctggctcagtcaaatcaacttggtcaggaaataccagttgaaacgattgctaagccttgcaaaccgtggaggccagttcattatttgacttctcattctagtagtggaatcaagcatggacaagtcaatcattcgatgggtgcaaatgcccgttgtactcaccgcaagcgcttatctgcaagagagttaaaagactatccacttactcaccataaccgtaaagatcgtcgccattattttagattcccagtttttgacgatgacgaatactttactgctaagcattcgactggctggaaatattcaactaagtgtcgccatcaatatcagatccatttataaattaaaatcatattaaaaacacccttgacgaattcgccctcgctcggtatactaatcgtaatttatatgagaatttgctgagatcgaatgagtaactaattatagatttaatagagagctgtgactggtgcaatgcagtatttctagcgttagtgaagatggtttgtgagcgattgatcggtgaataattagcagatcacggcgttgctaccgttacccaagctgcaaatttattactatgaataagtttgtttgagtgcaggattttaaatttcctgaatttgggtggtaccgcgtattgatcgtcccttgaaaagactagtttctttttgaggggcttttttatttacgaggaggggataaagatgacaaagattactgcagaattaactaaaccattactaattgatggcgcaatgtcaacggctttggaacaattaggtgctgataccaataactcattatggacggcgagtgttttagctaaccagccagcattagttaaaaaagttcaccaggaatattttaaggcgggtgcccggttagcgattactgatacttaccaggcaaatgttccggcattcatcaagaatggttattcaaaacaagaggcccattcattgatccagcgagcagtcgtcttggctaaagaagcgcgtgatgaatatcagcaggaaactgggatttataactatgttgcgggagcgcttggtccttatggcgcttatcttgccaacggaagtgaatatagtggtgattaccacctcagtaaaactgaatatcaacaatttcatcgaccacgattaactgatattttaacggttggtgtcgatgtgatcgcaattgaaactcagccgcgcttagatgaagtattggcagaattggaccttgtcaaagaactggctcccgataccctatgctatgtcagtttttccttaaaaaattccacacatttaccagatgggacaccgttagcagttgctgcccgtaccgttgcaaagtatccaaatgtttttgcggttggcgtaaattgtattccattagaagaggtaacagccgccattgagacaatccatcaggcaactgataaaccggttattgcttatcctaattcaagtgcgacttatgatccgacaacaaaaacgtggagctatccccatggacgtcgtggtttagttgattacttaccacaatggctcgcggctggattgacaattgttgggggatgctgtactactacgccgcatgatattgccgctttgcatgagtacttggaaggaggcacccatcatgactaagaaaacgcatttagcccgtgaaatgggtgctcgtcatatccagatgattgcgcttggtggagtgatcgggaccggcctatttctgagttctggttacacgattcatcaggctgggccgttgggaaccgttattgcttatttgcttggcgccttaatcgtttatgctatcatgttatgtttaggtgagctgagtgttgcgatgccgtatacgggggcttttcatgtttactccaaaaatctgattgggccggccactggatttaccgttgcaatcctttattggttgacttggacgattgcgatgggctccgaatttaccgcagctggcctaattatgaagcgctggtttcctcagattccggtttggtggtggagcttgttatttatcattattatcctcttatctaacatttttactgtcaaggcatttgcagaaagtgaattttggtttgcggtgattaaagtggttgcgatctgcgcgtttattttgttggggactttagcagtaattggtcttatcccgattcaaggttaccatcatgcacctttgctgaacaactttactaaggacggcctattcccgggtggatttagcggcttatttatgacgatgttaacggtaaactttgctttctctgggaccgaattaatcgccatcaccgcgggggaaactaagcatcctgaaaagactcttcctaaggcgatccatactactttatggcggttagtgatcttctttgttggaagcatgatcgttatggcttctttgattccttatcaaaaggcaggggtaacacaaagtccatttgtctacgtttttagccaactcggaattccatatgctgccgacttaatgaattttgtcgtcctcaccgcgattatctctgccgctaattctggcctatacgcatcaacccggatgttatggtcattagctaatgaaggaacaattccagctgtcatcgccaaaactaatagacgcgggattcctgttttcgccttgctcttaagtatgcttggtggggtgttagctttgctttccagcatctatgcggctggaacggtctatttagttttggtttctgtttctggattggcggttgtctttgtatggattgcgatttccttatgtgagctcatttttcgtcggcgctttttagcggctggtcatcagttaagtgagttaaagtatcgcacgccatggtatccgattgttccatggtttgcatttattgctagcagcctttcttgcatcttaatttggtttgatccccaacaacgaattgccttgtattgtacgattccgtttgtaattgcttgttatgctgcttattatttacagaccttgtggcgcaagtatactacgaagaaaaaggtttcaacagttgttaaatagatgtaaaaaagctgtaattaaaaaattcataacgcgtagtaaaatgtacgaggataatttttaattaggagatataaaatgcattcactatttttactacagttgattcagacagtcttagtagcaatccaattagtaatgatcttctcagctaataaagttaagcgagaatggttaaccgttagccagctgtgcatcgcggtcgtaatcttagccgacttattttcagaattgatcttctttagttatacaagtgtccttactggctgtgtattattcctccagttattcttgctcccaatgttttggaaacagctaaaggcatttgaagaataatataaataggtgagcggaaattaacttccttgacaagacggttaattctcactcacttttttaatcaaaaaagcaccatgagacttactccatagtgctttcctatattattcgttgacaaccatatcatttacatattgttgcagttgtttaatcattttctcggataaatgattaacaataactccattgcgagcatgatagtcaaaattctgtaattgccataaaacaacgtatcctttaaccccggtgctgacactaccatttattaaaatgggcatgtaacgaggattgttagaatagttagcggttgtgattggcatcccaataaacatatgggttgcctcattataggcggatgtactcatgacaacataatgtctgcggatatttccttttttaggattatgtccacccatttcatgtcctgcgtgaagttctgcatcggcaattataatatctccctttttaggaaattccattaatcaattacctcacgtcctacttgttttactggctgtaatgctgggtcgttttcgatatctttttgataatcgtattctttccaatctttggtggcaaaaatatttttcctttttgcaacaggggtaaatacaattgtcttaccaacattctttacggtatattcttctccagttactttaattcctgacggtacggttaacgttcttgaattaccagtttgtctcagtttaacagtcatattacccctccttatatgtatactcagtatatactaaaatggtaaaagaaaaagacctttaccaggacgttcacgaaagtagtataaagtatgctaaaatgataaagattattaagaccaatcaacgttatgtattgactggccttttgtaattttaaatataattaagtgggttttatttatgaagaaaagaaaattaaagaagagtttagcaacaactgcgacggtaatggctgttacaacgggggtgacggccattagtaattccgctaaagctgatacagtacaaaatagtaaaaatactattcaacaaacgctgcctgatacgaaccaacaagctcagcgaaatgtcagtacagcccaagacgcagtgaatagagccaatgctgatgtagcaaccgcaaataatgatcttaatattgctaatcaaaatttggcagacgcggattctcaagcaaaggtacaggaaaaaataagcaatagttcaaatcaggctgttaataatgctcagcaagaatatgataatgttcaaagtgacttaacaaagtatcaacaagagtatcagcgaatactgaaagttccagtattctatttaaatactatgatgaattcagacaaacctttagtatttgacttggcaaactatgatggttacaaagggcagaatgcacaagcggaaaagaattttaaactcaaagcatatcaggataatattgatctcttaaaagaggttattagaagaaaccagagctttgttgacaatgattataaaaatacaccggcttattataacttaggtaccattaattatgaaataaatgcagttaataaggaattaactgagcttaatcaaataatgattgaaaagaaaaagggtacttttaaccaatatcaacattatcatgattggattacaaaggatcgttcgcgttcatggctagatttagaatctgcggatatcagtgatattcaagagataattgattggcatcataaaataatagaagaagatcaaaagaaggctgctgaagtattgccaattgcgaaaaaagaattagaaacaggaaattactatttaagtgtttctaagaatcttttgccacaactggaagaagtgactaacaatcttattgagacacaagaaaagcttacatatgctaaaagtaatttagattcaacaagacggaaagcttggcaagatagtgtactcttatcacaaattgaaggagatcgtgctaatgctcaatcccaagcaatcaatgcgcaaacgaagctcttacaagcacttctcaataagacaaattcacaagaaaagttagcgtcagcaaaagagaaattaccgatgcaaactgatgccttaaagtacagttcgctaatcaaccttgaaccattaacaattgagccaggagaaactcctcttcctaaagttacgacagcgattgcagttgagaatgatcatcaaaataaagctgttattactttacccggcgatgagcaagaaaataagctgcctcagggaacaaaggtagtgtggaaagatgatgctaaagttgcgaccgaccttcaacgtcccggaaagcatactgaagatgtcttgattgtttttcctgatggatcggtagttttaactagcgagcaagttactgtttccgcaacagaaaaacaggcagacgctaataaagaaacttcgcctgcacagaaaacaattgatagtacacaagaaaataatatgcgtgcgaatgatctttctgcccaggtagtggaagttaatgatgataatcaaacctcagcaccagaaatattggtgacttcgcaaaccaagcaacataccgtccgaccaaacgaggtaataaaaggtcaggcagatcagaataagattacccagccttcattagctaagtcttttaagaataaaacaacaaataatattttgccacgaaccggggatgaatcttcacttccgattattgcccttggcgctattattgggctagtaggaattggggcaacacttaaacggtacgaataaatttgtttttcgtcatgctagtctatataatcaatgaaaatacaatatttgaaaggatcgacacatgagtaactggcgtaatctatttgcacaacgaatttatgaacggggtagggattactactatcgcgataaagttaaaaacttaataatcgatgaagacgataatttttctgcaatcgttaagggaaatcgggcttataaagtaactggtagataccataatggaaagttttctcaacttcattgtgattgtccctatgcgcaggataaccatcgttgtaaacatatggccgcggttttagaggcgattgatgatgattcggcaaatattgaaccgcaaaaatcattaggggaggtttttcaatcagcttttccgccaaaccgtttaccagttgatccgcaaagttttctaagtaaagaagtctttccgctacggctgattgaacatgtctttactaatcttgacgatgttcaaattatttctgaaatcctaattaaagctgcagatgcttatttcacaattcctggagctaagtggaattattcagtggctgggcgttttaaacaatattacttttcagtgctagttgcttttaatcgagaaatgattgtggacgtccaggtagactttataaagacaagagaaggacaacagattgctgaaatggttgccctttattacttgttaaggtaccttgatcaacataatattgaagagaatactaatgaagcagcccggcaaatgctagctaattttcttgatcgcgatcctgatagtcagacgatcattactgctaatatcggtgaatactacgatggtggtcaatacctttacttccgggcaggtgtaccagatcatatgtataagtttccaaacttgacaaccttaacaaatgggattgcccgtggtgagcggcttcatttaggaaagttctttgatcagcaaattacccccgaaaaccttgataaagatagtaaacaatggttagacttgatcatcaagctatcctcgaccgctgatttaacgcgcgatgggtattacgaagcatccgtaaaaaatgagctgcccctggctggcgtgattatggatgaagttgaccaaatattaaagaccggtaatatgctttataatcggtggaaagtgcctattaagcgggaagaacgtgcattaaaagcagcagtttcaattaaagcaaatggtgctgatgacgatccaagtcgttaccttgatgttagtgttgaccttccggctgaccttattcgtggacaggcagcctattaccaccttgatgaccatacctggactgcttttacaggaatagcccctgataagttagaccctgtttttccagtaaccagtgatcttgtttttggtgttgatactatgtctgagttttaccgctatgtgttacccaagattcagtcgatgttttcagtcgagatgccccaagatcgcgatttatcaaagtttttacctccattaccaacagtagttttcttattggattatcatgacgaacaaatttattgtgacttggcaactgaaattgatggaaaaacacaaaaaattaagaaaattgatgaccttccgcaatttttgatgcaaagagttgaacaggtactagctaaatatttcaccaagtttaatcaaaccgggactagagcagttctgttagttgatgaggcaacaaatttgctagcaactggcgtcaatgaattgcaagaaataggaattactaaggctactcctgcatttaatgggttatacaaacagccgtttactaaggtaagtgtcggtatctccgttgattctggccttttaaagcttgattttggtgatgatcaactaactgctaaagaaatcaagcaaattctaagagatttccggccgcataaacagtactatcaattgggcaagaaaaccttgaagatggatgaaccttcgctaactgaattagttgagacattgcgcaaaatgggaatctcatcacgtgattttactgcggaagaacttaaattgccggtgtatcgtgctctttatcttgatgatcttttatcccaccaagaagcattgaattatcgtactacttcagaattgcaccagctagttactgatgttaaaactccgcagaaagattttaaggtgccggcaaatcttcatgcaacattgcgtccctaccaatatgatggtgtccagtggctaataaccttaatgaagtatcattttggtggactgttagctgatgagatgggactagggaagaccctgcaagttattactgttctgttaagtgaacaaggaaacggacagaatttaattgttgctccagcggcagttatctataattggcaagacgagcttaaaaagtttgcgccagatcttaaagtaaccgtccttgatggtagtaaagctgaacggcggaaacagttcgcacaaagcacagaaagtgatatcattattacttcctatgatgccgctaaacgagatattgatttttatgaagggcatctctttaatattgaagttattgatgaggcccaatacattaaaaatccccaaactgctgccgctaaaacggtcaaagcgatcaatgctaagcagcgttttgctttaaccggaaccccgattgagaaccggttaagcgaactctggagtatttttgactacttgatgccggggttacttggttcctaccagcagttccgcaaacagtatgaaggaccgattattaaaaatcaggatgagcaagctcaggacgacttaaaacgtttggtacaaccattcatgctccgtcgtttgaagcaagatgtccttaatgatttaccgatgaaaaatgaacaggtatttttaacgcccatggttggtaaacaagaacgcctatatcaggcacgtgctcaaagattgataagacagattcaaaaacagaatgataaagagtttcagcagaataaattagcagtcttggcagaaattactcgtcttcgtgaactatgttgcagtcctcaattgttagatagggggtacagtggtccttcgggaaaaattaaggcaactatgaatttaattaaagatgaaatggcagataatcataaaattttactcttctcgcagttcacatcggcattagcaatcttaaaagaaaaacttgctaaagcaggaattaagtactttgtgattgaaggaaagacaaagaaagcagatcgtttacaatttgttgatgaatttaattcctatgatcagccagccgtcttcttaatttctctgaaagcaggaggaacggggttaaatcttacgagtgctgatgttgtcattcattttgacccgtggtggaatattgcggctgaaaatcaggcgactgaccgagctcaccggattggtcaaaagaataacgtgacgatttataaaatgattgcacaaaacacaattgaagagaaaatcattgaaatgcaacagaaaaaagcagctcttgctaattctattctttcaggaaatgagctagcaaatgccgtcatcaacaaggagacactccttaacatcctcaaataatataggttttgtgaagttttgtcctaagtccctataaaatcccgctataacttgctatacttaaaatattaatatgtgaaaaaagggatgagaagaatggtaatggttgatttgcattgtcaccttttgccggggattgatgatggttcaaaaagtatggagatttcattgcgacttgcaaaagaagcaacagaaaacggggttacccatgcacttttgacccctcaccatatgaacggacactatgtaaaccataaacaagatgttttagcgcgaacaaaagaatttcaggaagaactggagaaaaataatattccactaactgtctttcctggacaagaagtgcgaattaatggtcagctaattgaagctcttgataatgatgatattctatttgctgatgagagtggaaagtatatgatgttggaatttccagacaatgatgtccctcattacactaatcagatgatttttaaccttcaacaacgggggattacgccagtggttgttcaccctgaacggaataccaagatcatggctgaaccggacttgctttatcaaatgttggaaaaagggtgcctatcacaaatcactgctagttcctatgttggtacatttggtaaaaaagtcgaaaaattcagtaagaacctgattgcggctggtcaaggatatatctttgcttctgatgctcatgaccttccaggacgaaaatatgaaatgcgacaagcctttgacaaattatcgcgtgaatttggcgctgacgttgcccaagaataccaagataatgcgcgagctatcattaatggggatgaaattggtcgccatcagattaagaaggttcagcaacgtaagaaattatttgggttattttaaaaaactaagattagttcagagactgtgacataaatcaagttacttttgtaaaagataaatagcgcagtacaacaatggccttcagcgtccggcaaagtcgaatgctgaaggcctattgttgcttgcgggggctcgaaaacgaagtcacaagtgacttctgtctcgctcccttctgtaaaatgtaagattttaagtggatttaacgattttttgcgtatatataatattagagacactatttttaggaggaacttatgcgttttttacatacggctgattggcatattggcaagacattaaacgattttagcttgcttgatgatcagctagcaacctttaagcagattgaagcaattgccaaagaccagcaagttgatgcgatagtgattgccggggatttatatgatcggtccgtgcccaatgaagcagcggttggacttttaaaccagatgctgcaagaattaaatttgactgatcattttcctttactggcaatcagtgggaaccatgactcagcggtccgtttgagtacggggactgattggtttgcttaccagtcatttttcttaaatactaacattaatgatgcttttaccccggtcacaatcaaggatacccagtttttcttattgccattctttgggattcaagaagttcgcaactattttaatgacgacaagattaaaaatgtcaatgatgcgatggcacgaattacagctgagatggaaaagcattttgcccctggtaaaaggcatgtccttgtcgcccatttctttgcggctggaagtaagcgaacggctgattctgaaactttgattgaggttggtggattgagtgcagttacgacagatgttttagctccctttgattatgttgctcttggccaccttcataaccgcaatgctttaaatgacgaaaaaattaagtatagtggctcaccaatgaagttttcagtatcggaagccaagcaagaaaaaggcgtttggattgttgatacagcaccttttaaggccgaatgggttccactatcgccagctcatgatattcaccttttgaaagggagttttactgaactggctacaaaacctgaagaagcattacgggaagatttttatgacattgaattgaccgaccaagaacgaatccccgatgtactaaacaagttacgcgaatattatccgaagattgtcagccttcaccggacacatcaggccaagcaggttcaactcaaccttagtaaaaagcgtgctcaggaatcaccccttgatttacttgcggatttttattcccaaacgatgggaaatggtttaactgaccgccaaaagaagtgggcagaaaaggccttgactcaaatcatgaaaggggaggaataggatgcgtccattaacgattgaactacactactttgggccgtatgagcatcaagtgattgactttatgcagttcatagagcattccttatttctggtagcaggaaatactggtgcggggaaaaccacaatttttgatgcaatgtgttatgcactttttggtcaaacaaccaatgatcgtgatcggtcggctgctgctttacgttctgatttcgcaccagctgaccaagaaacaatggtaaagtttacctttgaacaccaagaccttaaatatcaaattatgcgtcgtcctaaacaggttttaaagggacgccgcggcaatttagttgaacataatcaagccgtcgatcttatttacccgcttgaaagcgatcatccccatgaaattactaaaattaaggaagcagacacgtttattactgacctgctcaacctaacccgtgatcaatttaagcagattgttcttctccctcaaggaaagtttcggcagtttctcgattcagatagcaatacgaaggaagctcttttgcgtgacctttttaatacgtcccgttatgagcagtgggcaacgcaactaaaaaatgatttgcgtgaacagaagaagtcattgacgacccaagaaacaaaacttcaatcattaaaggaaacagtaaccgcgattgatgcgcaattaacaactaaagaatggttagcggaagaaaaaaattacttatcccgactaaaagctaatcttgaacacttgggcgatgatgagcagcaacagcaaaagaaagttgatcagcttgatgcccaacttcatactgagcaagagttgaagaagaatattgaggagttagctgaacttatcaaggctggaaaaacactgcaagctcaagcgggagagatccaagaaacaaagcagcaagtaaaagtccttgaatggtaccaagaacaccagacagaatatcaacggtggaaagatggcgaaaaacgtctccaaaaattaacgttagacaataaatttctccatgaggacctgcgcaaccttcaaaagcaacagcaaacaattgaaaccgacctacaacaaacgagtaagcagcaagaagaaattgatcagcttcaaactgaggtcgccgacttgacgaataaactcccattcttcgatgatcgagataagctaaaatcagctgtcgatgaactacaaacacacttaaagcagcaggaaaaacagcaagctgcttcccagaagaagttgcaagacgctcaacagcaattgacggttgttactaataatttaaaagagcatgaaaacttgggtgaggttcaagttcacatagcaaaacaagaaggccttcaggaaaaattaacgactgctggaaaagatttaaagcaattagaaacaaaacttttatctgaaaagaaaaattgcgcgaaattagagcaaaagcagggggatgctgaaaaactcgttcaaaaatcgcaaggtgagttggatgacttgaatgatcgctttgcccgtcaccaaattgccattcttgctcaaaaattaaagccagccaccccttgtccaatttgtggatcgcttgatcatccccatccagcgaatttagcagatgatggtgaattggtaacggaagcacaagttaaagcagcaaccgttaaagttcaacaaaatcgtagtacgtttgaccagttaaaagagcaagttcgccaaagcgtttcccaaattgctaacttaacaacacgggtagaaaccaagcaggtaaatttagccgaactattaggggataatgaattaccgagtgattgggaaggacaaattgaaaatcacgctcaaaaactagcagaaatgaagactgacctcgatagaatagaacaacaggttaaagaatggcaccgagaagaggaagaattggaacaagaatccaagttctctcaagaagaattagataaaatagacgaaagtgtgaaccgctgcaaacaggatttaatcgctaagcagactattctgaaagaaaaaacagccgctttaccagcaaaatttcctactaaagaagctgctgacaagcaaattcaaactgatcaactaacgatcaaagcctttaataaccagcttgaattattgcaacaacaacgacaagaaaatgccgaaaaattagcagggacaaatagtcggatcgaccagactaaagaagaacttgccacccaaacgacgcaacaggataacttacaccaatatcttgtgaaccttttagcccaatatgatgtccaacttaaatggaatttctggcaagaagctagtgaacaagtagcaacattgtcatcattacgtgaacaggtaacgacctttgagaatcaagtccaggataatcagtcccaacaagagcggttgactaaggccatcaataatcatcccatgccagatattacgtcaacgcagaccaaacttaatactgagcgtgaacaacttcggcaatatcagcaagaaatgggtcagttaactgctcagtataagcaattagaagaaacggatcaaaaggttattaaggtagtcgaaaaaaccggaaaacttgatcaagaaattaatgaattacaaacattaacagatgttgtgactggtaatactgaaaaccatgttagcttagaacggtatgtattacaggcatattttcaagaggtcttagtagcagccaatgttcagttagaccggttaactaatggtcgctaccagtttgaattagcaacagaaagtcatggggctggtgccaagtggagtggacttgaagttaatgtatatgatgataatgctggtagaacgcgaagtgcccggacgctttctggtggtgaaagttttatggcttcacttgctcttgctttagctctctgccagattgtccaagagcaaagtgggggaattaagattgatgcgctctttatcgatgaaggatttggttcccttgatcagcaagctcttgaagatgctcttcattcccttcaagaactcgaaggccaccggatgattggaattatcagtcatatcactgaacttgaggagcaaattccagatcagttaattgttcgatcaagaaatggccgtagttatgtcgcataccagcatgaaatataagttcaaaacagtatttaaatttgcgatgatgaaattagataaaaaattaaaaataaaaagtgcaaaaattagtttttttcgtatatatatttataggggaggtgatttgcgagatgaagacttgttcgttcatagactcctttccccattatttgctgtcttcgtctgcaatcacttccctaatgggagctgtgatatgagtcaagttgctttcataatgaggtgacagcgcagtacaacaatggtctatcatcgcttggcaaagctgttggtgactattgatgtttgcgtggcctccaaaggctaggtttgagtcaaaaaacgaagtaacaggtgattcctgtctcgctctctttcttctcccacaaatctcaatgtaaagatctcttatctgctcttttacgaaccaccagataggagatctttattttttaaataaaaagtgcaaatgttatctttttccgtatatatttaagtgaaggcctaaaaaatgcatttaatgctctttaactccatattatcttccacagtcaaatcggccttcatttcaaaagctaggaaattattcttagctttttcttataataaaaaagtcattattgtggggagggcaataatgactttgaaattatttatcttaatgatttacgatatccagcggcttgcgcttctgcttctgagttaaagtaaaccgcatttgctgaattcatatgatagccttgttgatcagacgtatggtagatttttgaacgagcattaccaacgatcataccggcctgatcggttcgcatatcaccgttattcgatggcgcagttgaactgctgcttgtattaactgctgaactttcctcactactgctgctcgatgatatttctgaagatgattcgctttcaacaaggcgcaatgcattttgaaataggaactttgggaaaccatgagttcgatgaaggcttagctgagtatatgcggattgttaatggtgatgaacctactaaacaatataataaagctgagatggcctatcctcatgtgaaaacagggattaatattattaccgccaatgttgtgaataagtctgatggtcagatcccgtttggaatgcaaccatacttgattaaagaaattcatactagtgatggtaaagttgcccggatcggctttattgggattgaaactacttccctaccaattttaaccttatacgataattacaaagattatgatgttttagatgaggctgaaacaattgcaaaatatgatcaaattttacgcaaaaaaggtgttaacgcaattgtagttcttgcccatataggggtttcaactaataaagatggcagcactaagggtaatgctgttgatattattaagaggctttaccaaattgaccctgataattctgtcgacctttatattgccggtcactcccaccaatatgctaatgctactgttggaagtgtaaaattagtgcaagccatttacacgggtaaagcttacgatgatattatcggttacatcgatccaacaactaatgattttgcgcccaatagtctcgtttcacatgtctttccggtactatctgaaaaggatgcgcctaatatcaaaacagatgcaaatgttacagcaattgttgaagatgctaacaatcgagtagcaccaattattaataagaaaataggggaagctgctacaacaggcgatattcttggacgactacataatacccctactcgtgaaaatgccgttggtgaattagttgtcgatggtcaattatatgctgctcataaggtgggcttactagcagattttgcgatgactaatacaggcggcgttcgtgcagatctgcatgttaatcctgatcgttccattacatggggagtgcccaagcggttcaaccatttggtaatattttgcgggtagttgaaatgacaggggcacaaatcgttgaagccttgaatcaacaatacgacgaagatcaagcttattacttacaaatttccgggcttcgttatacttatactgatcaaaacgatcctaaccaaccatataaggtcgttcaagtttatgaccaacataatcaaccgcttgatatgaataagacttacaatgttgttattaatgactttttagcaggtggcggagatggcttttctgcatttaagggtaccaaagttgtcgggattgttggtcaagatacagacgcgtttattgattatattactgatatgactaatgatggtaaaccaattaccgcactaacaatgaaccgtaagatttacttgactgctgaacaattagcaaaagctgactcagattcacagtcacaaacaggaactaatcggaacactcaaaacgatgctaattcccagactgaaggaaatcagcttcaagaggttccaagccaaccggtatctccaacagtaaccttgccaacaacagctggtcaaccagccgaaactgttacattacacggtcaacctaagcaacaaaccgtagctgctgctaataatcaattaattaatttgacgcctacatcaatcaatggccaaaaacaaaaagtagctgaccagcaagcagctttaccacaaactggtaacgatgaggatcttgcattacttcttctcggaagctcattaatggcagtaaccggattgacaattattgatcgcaagcgcaaacatgcttaattacttaaaatagactgttactttcattatttgggagttagcagtctatttttcactattttattttctcgctataatggaaacgataaagtaaaaatggggtaagaacatggcagaaaatatcatcaatattttaaaaaccaataatatgaccgtcgcgtttgtcgctcaagaaagcggcctcgacgttgcgcaggttaacgaaacacttaaacggcccgttgcaacttggtcaattcagattcttaatgcacttgcagatgctttaggagagcgtccaggagaattattagatcggattcaagactttgatttttacctccatactgacgatgatcaattaacgattcagcacgtgcagttccaaacaccttcttcctatcaacaagttcgttttgccgttgaaagtaatgttttagagggatggaaacctacagcaacagaggtaagacaattaaaagagagtgccgaaaatccagatgatgaaattttaatggaaattgagcagctatttggtgatgaagatgactgatgaagaacttcaagcaaaatttttatatgataatggaacgcttagcaataaatttgcaattaaaaatgcagatgaattaagtttaatcgagtatcgtggtgtggcagaaagggaagtggctctcctgcaacaacaaccgaaaattaaaagctttgaagatttacagacaattaataaattcctttttggttggctttatgactgggcgggtgagttacgtaactactacatttcaaaagcaggttttgattttttggaatatggtcgctttgataatgcaattaagtatattaatgatgaaattgggcgattgaataagaaaaagcagcctaccattgaggattatgctgctctcttaaatgatttgaactatattcatccgtttcgtgaaggaaatgggcggtcaactaaattatttatccagttaattgccctccatcatggccaggtaattgattacccagcagacaacgcggaaatgattgccgggttaaaccaatcagatgtcggtattattgccaagaccatggcattacaaaaaagtgctggttaatttagtttactagctgcttgtttatcaagaatcactgttacgtttggatgctgttggagggctgatgccggaacagcagtcgtgattttaccgttgaccattttgttgattgcgtctgctttttgctcaccaaaagcgagtaagatgatatgttttgcttgcaagattgaaccgattcccatcgtgtaggcttctgttggtacatccttgcttgaagtaaagaaacgcgcgttggcattgatagtagcaggggttaactttactttatgggtttggctatcaaaaggggttccaggctcattaaaaccgatatgaccattattaccaattcctaaaatttgcgtatcaatagggtaagtagccaaaatctgattatagtgattaattacttcagtggcattcagattactgccatccggaataaaacttttggcaaatggcttttgagcgaaaagatgatatttcataaagtaatgataactttgcggatcagttgatttaagaccgacatattcatcaagattaatcgaaataaggttagaataatcaacagaactattagtcattttttgataaaggcctagtggagaactccctgttgcaaggccaagtacttgggcaccgttaataatatctgtttggagaaattcaaaggcattttggcttgctacttctttatttttcgttacaagaattttcatcctcatcacctcacgactattgtaattcttttaaggaaaaagaaaagagcaattgctaatgtaatgcttattctttagatttgacaaaaatattattgaatgcgcttacaaaaatatgtaaaataagggtgttgctgaaacaatctgataagaattggggaaagtttaatgaaatttaaaaaattaacagtaatgtgtgctgttttatcaggtttactattagggagctcggcgatgacggtggttccagctactacctatgcagcctctaatgataagcaggtgacaatctatcttacacgtcacggggaaactactggtaatgtaatgcaacgggtacaaggatcgagtgattttccattaaccaaaaatggaattaccgttgctaatgatttgggctatggattaaaggggattaaatttaagcatgcttacacgggtaacttaacacgtcaagaagttactgcgcaacaagcattgaagtattctgccaatccaaatacaaagattacgaccacaccaatgttacgtgaaggcggatacggtagctttgaaggagatagtattgaagctgataaccagaagattgctaatgtttatggttatcaagatggcaagcagttccagcaagcaacgggcaaagattactggaataagctccaagatgcctaccacaaacttgatatggacaattcacaaaataccaagttggctaaaaatgatcgggcagaaagttcagctcaggtgcaaaaacggatgaattcagaattgcttcacattgcaaaaacaactcaaaaacagggtggtggcaatgttttagttgttagttcaggaatgtcaattaatgaatatctttcaaccatttctaaaaaatatgatgggaagccaatgcagaatgcggcagtaaccaagcttgtttataagaatggcaaacttcacgttgatggcccaattggtacgcttcactatgtaaataaaggaaagaaaatagcagcaaataagtaaaatgaattatctttcagcaacacatatgttttttgcaattatcgaattattatttggggactctttgatcagaaatcagggagtctttttttggaagggagatagtaccaatggaaaacttaacggttaagctgtttggagaaattactgaaaagcagcttccgggtttagcattatttgaaaatcgaattggctctgggaaaacaacgggtgccctgcagtgggtaacggacatgctaatgaaaagtaaggaatctgatgtcattatctacataactcccaaccgacagaatcgagatgaagcatggcggggattggttagacaagcatatcgaagaattctttgcgacgaatcagttaaacttaatcgataatcggatcgcaagggatgaaaggatagaagatatcaagatcgcgttggttcagcttctaccaacagttaaaatcaatattagaccgaccgttgaagataaatttggatataatctagtggtgattaataataagcggtatttccaaactcatgaagatgttaaagataattatgcgagagactatcagcaggcaatagtgcaacatttgacaattggaagtacgttaattaattcattaaaagagttgataataaagaaagatttgaaagaaagaagcttaagtctgtatcattaactagattcaatagtgggatgggagttttatcaagttgcaaaggaagcttatggtacccaagcagtctatctatttaaaatgattaatagtgatgagttcgaggtgagacggttagatttacaagaaagctcaaaatttattaattctgatgatacagatcttcagtacctaattaaaactcctgccaatactttctacaatttaaacaggaaaaatatctttactttgcctaatgctgagctttttggcgatatcaacgagatgattagtcatcaaaattgttcatcagtaacaaaagcggaacttaaacgggctttgaatgatttaagtaaaagttaccctaattacagaactaaataccaaaatcttatttctatcattaataaaagagagctaaattcatttaacatcaatgacttaaaagatgaatttaattttattaagaaaaataaaatactaagtccaattgcaattaatttgttattggatgaattatatgaacaatatggactagttttgaaagtgaaaccaaaaataaaatcccatgttcaaaagcatctctctggattaaccgatattaattatttcgttgataacggcgatcaggatgttatttactataatgtaggaaccattagtaaaaatatgaatatatcaattgcaaaggcatcacacatctggcaacttcagcctaacattaaattaaatgagcgtggtttcgctacgattgagaccgaaaatatcttgaagtttcttcaactgatgatggtgaattttgtacgatttcatcaattaacagtaattccttttccatttaaataccttcgagaatttattcaacttgaagaaaagatcagctaaaaaagatgtgacagatttactgaaatgatgagataatactaggagggatggggtgatgatggtgaaaagtactaaaaagaaacgatcacatattgggttaattatatttactatattactggtaatcttgttaggaattttaggggtaaattataaacggtttgctagtaagcaacttaacccagttcgtgacaataaagtagtaaaaaaagattcgcctaaaataacaaagactgcaaagattgttggatcgtatcgagatgatcaagacggtgcagctattgccttaaatgaaaatggaacaggtcagtatgtttatgcagataagaataatccggatacagatgatagcttaacatggcgtaaagaaggagaacactaccttataaatttggaagatcgtgacgtaactaatccccttaccgcaacgcttgataataataaattagttgttacaggtagtaatggctggaataccgaaacattccaaaaagttaatgaagagttaaaccttcaacaatttttgaatgatatgcataaaaaataaaataaatgcttgtaaaggatttagagataggatataataaaatccctgtcagcgatgggagatagataatcgcttgtaacttcttagatttatttaacttagttgcaaagtctcaacaataatttaaaaatattattgacatcccatcgacaacatgatatattaataaagttgctgattgagttatagatctaaaggaattcgaaattgattaaaatttattcttgacaagccaatccgatatatgttataattgctgtgttgggtggctacttaattagccaacaggtagacctttgaaaactgaacaaagtttcgacgaatcaaatgtgtagggtcttcaatcacgatgtgatttgaagcaaaacatttgcgaagtcaattcgcttaataacaaagataatttagagctattcaagttcttatatattttatatgagagtttgatcctggctcaggatgaacgccggcggtgtgcctaatacatgcaagtcgtacgcactggcccaactgattgatggtgcttgcacctgattgacgatggattaccagtgagtggcggacgggtgagtaacacgtaggtaacctgccccggagcgggggataacatttggaaacagatgctaataccgcataacaacaaaagccacatggcttttgtttgaaagatggctttggctatcactctgggatggacctgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccttagagataaggcgttcccttcggggacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcaagctcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgggagtttgtaacgcccaaagtcggtgcctaacctttatggagggagccgcctaaggcgggacagatgactggggtgaagtcgtaacaaggtagccgtaggagaacctgcggctggatcacctcctttctaaggaataaaacggaacctacacatcgaagaaactttgtttagttttgaggggtttaccctcagagcttgtactttgaaaactaaatactatctaatttctttattaacaaaacaataaacgagaacaccgcgttatttgagttttaattaacgaattataatcgctaactcaattaatcagacaatctttgattgtttaggttaagttatgaagggcgcatggtgaatgccttggtactaggagccgatgaaggacgggactaacaccgatatgcttcgggagcggtaagtacgctttgatccggagatttccgaatggggcaacccaatcagcttagtcgctgattacttgactagtgaatacatagctagcaagaggtagacgcagcgaactgaaacatcttagtagctgcaggaagagaaagaaacatcgattccctgagtagcggcgagcgaaaagggaagagcccaaaccaacaagcttgcttgttggggttgtaggactgaacattagagttaccaaagtgcgacgtagtcgcaacagttgggaagctgtgccatagagggtgaaagccccgtagacgaaacgtcacactctctgttcaggatcctgagtacggcgggacacgtgaaaccccgtcggacccgcgaggaccatctcgcaaggctaaatactccctagtgaccgatagtgaaccagtaccgtgagggaaaggtgaaaagcaccccggaaggggagtgaaatagttcctgaaaccatgtgcctacaagctgtcggagcccgttaatgggtgacggcgtgcctcttgcagaatgaaccggcgagttacgattgcatgcaaggttaaggtggaaaaaccggagccgtagcgaaagcgagtctttaaatgggcgtaaggagtatgtagttgtagacccgaaaccaggtgacctacccatgtccaggttgaaggtgcggtaaagcgcactggaggaccgaacccgtgtcagttgaaaatggctggg

SEQ ID NO: 53 - DNA, 12147 bp, Artificial Sequence
  Based on Lactobacillus reuteri
cctttcactgacattaatgcttttttcatctcattcatttcatctgctgtgaaaatatgtttaattccattttcaaaatacatgatatttttcatcaatttttcctcctacaaattaattactccatcttcatcggctgcaatctcatatcggttcatgatactctgcaattcatattctaatcgctgaaaatcggccacaaacttcttcgccatctcaactgacagccgattttctgttggcgtttcttttaataattttcgccaacgttgccgagttgcctttggtgcatcaccataaattgatgggtcaatcatcaatgctaaaatcattgcctgttctcttacggttggcaaatttttatacttgggaataaaaaattgttctaacattttttgaactaatttcggataatcctgcactttattcccccgcaactgcaactcaactcgccaccaactttcaacattaactgtctttccatgacgagcttcttgttcaacttttttgttatactggcgaatctgctgaccggatttcatggatccataataagtcgtttccatttggcctttctggttcataatcacctgtttacccgtcccaaaacgccatacctgataatctttggctgttggttcattaaataaatcaaaggcaatatcacaccgactaaaatgtttatcctgaatcgacgcaattaattttaacaaccactgaccgccctcactttgtaacccatggttggggttaaaatcaattctaattttatctttcaaaaattttggtgagttaataaaggcgacttgttcaggggcaacatacgcatgacggttgccaaaatcatcttgataacaattactgtcatctaccacttgaatcccaccattaacatcttgaataaatgattttctcagccactctcgcatatcattatttaatcgatcactgtcataatgacccacaacggtaatccgatcaatcgatactcgaatatccgctttatgtttaactacttcattgcccataataaaaaggctccttcctaccacgtggtaagtcgggaacctacttgttgtcttttaaatgactacttaatgactacaaatcgatatcgttttcgtgttatactaattacgttaatcaaataatagatttccaactcacgtgtatctgatcgccaaatctttgatacccacgtgggtttttctttttgttttattttcatttacgagtttaattttaccacattcacattcccaaaattttaaaaagtctcagtaatgagtactttagctggctgttagacggagccagctaaaaattcacttttttcaatttcacaaagtgaacatggcaactttacaaaatagtagttagctcatcagctaactgcttagttaatttatcgatttccggtttctgataacccatctgtttcaatcctctctcaaagctagttcgtaatagaccatgcgaaatcgcaagctcatgataaccattaagccaaagtttagttaattccaaatctgtcatttcagcccctcctttgcagatttaatgctcaaacagatactaacccctgtggaccccttgctctttgtcggaaatccagcctattagctggctctccgacccgcaagcttatcacaggggttctctgttttgcgccttaaaacctgcttattaacgttctctgcccttattatgcttgaactgcatctgattcgtgttttcttttgtaggatactgcttagcaatctgattaagtagttctttttgatcttctggcactttcgtatctttagtccaaggtaatttattattatctgcaaaataagcatcaatttgctgccttaattcaaactcactgtttaataacgcatcttcagtagtcacacgatcaaacatctctttcctcaagatttcatcttctggaattctcgaagacaatcctattttgtaagccaactcatagttttgtaatgcctggttttggtcattaatgattttttcataaggctttttaacttctaacttcgttaaagcatcatccaaattcttgtatcctaaatttttactcatttcttcataacgattgattttttgttctcttttaagaagcttttcccaacgctcctttaattttcttacaaattcttttagccattcaaaaacataaggtaatgtacttatctgccgttcattttcttcgtcccagtgtccatatgattccggacttctagataatcgtacttcttcttcaggagaaattgttgggcgatcaggttcgatttcatcagcaacttttgttatctgtctttctaattcatctaacacatcgcctttttcatcaagctctatcttttggaactctaactgctcacgttccccttggactttatcctccatattcttaatatttttgacttgctccattgagcgtccaacatctttagtacccttacgataaaactccaagcccttaaatttatctggatattcttttctaaactcacgctctaaaatgcaagccattttacgatcaaaaaccgaacgataccactttaatgcttctcttccactggcctccttctcacccgtagcacgctcataaaaatttactagggtctggtttaacgaattgcttacacggccattacgggtcttcccagtggcatacagctcataatgaatatgaggtgcccctgcttcgtccacatgaatgctatatgctcctggaacaaaataattaaataactgtgcaccattcattttgtaattagtcgatacaaaatcacctaatgctttttcatataccccataaaattttttagctacttccgaattagtgataacaagtgttttgccatcgggacttgatggaatatcaattgattcatagctacctttcggacaaagctgttcaattaattgattgcgattctccatatcaccaactgtcgccacaacagtaatcttcttttttgatttcaaaaactttttaactgaaccaaatactctctctggatgacgacttttaatcgcattttgatcatgctttcttacatagtcgccaaaatatttttccattttttgatcaatttccgcttgtgaaaaaactcgaccattaacattatattgagttaagttttccaaaatatctttgttcgaatgctcaacatttggatcatgttcaacatgttttttgattcccgaccacccatttgcagtctttgaaaaattaattgtcgatgtaactttcactactcactacctcctaatgccgcaaagtaattaacttcagtataccacaatatttgcgcgcaaatatagctccttagaatttttgcgcaaggcgacaaaaaacggagccctgtctggggattgagtttcactcaaagggaccatttcatggagagtcgcttttgaaaaaagcaacgcaaaataaaaaaagtgcttcgctttagcgagcgcactttttcggttcgtcaatcgagactgcgttcgattttcctcacaaaaataattgctgtttaaacgcaattatttttcacaaagtcggcagcattcatcaacttaatctaaataatccaagaagatcaacttcaaattttgcaaagcttccgaatttcctttcactgacattaatgcttttttcatctcattcatttcatctgctgtgaaaatatgtttaattccattttcaaaatacatgatatttttcatcaatttttcctcctacaaattaattactccatcttcatcggctgcaatctcatatcggttcatgatactctgcaattcatattctaatcgctgaaaatcggccacaaacttcttcgccatctcaactgacagccgattttctgttggcgtttcttttaataattttcgccaacgttgccgagttgcctttggtgcatcaccataaattgatgggtcaatcatcaatgctaaaatcattgcctgttctcttacggttggcaaatttttatacttgggaataaaaaattgttctaacattttttgaactaatttcggataatcctgcactttattcccccgcaactgcaactcaactcgccaccaactttcaacattaactgtctttccatgacgagcttcttgttcaacttttttgttatactggcgaatctgctgaccggatttcatggatccataataagtcgtttccatttggcctttctggttcataatcacctgtttacccgtcccaaaacgccatacctgataatctttggctgttggttcattaaataaatcaaaggcaatatcacaccgactaaaatgtttatcctgaatcgacgcaattaattttaacaaccactgaccgccctcactttgtaacccatggttggggttaaaatcaattctaattttatctttcaaaaattttggtgagttaataaaggcgacttgttcaggggcaacatacgcatgacggttgccaaaatcatcttgataacaattactgtcatctaccacttgaatcccaccattaacatcttgaataaatgattttctcagccactctcgcatatcattatttaatcgatcactgtcataatgacccacaacggtaatccgatcaatcgatactcgaatatccgctttatgtttaactacttcattgcccataataaaaaggctccttcctaccacgtggtaagtcgggaacctacttgttgtcttttaaatgactacttaatgactacaaatcgatatcgttttcgtgttatactaattacgttaatcaaataatagatttccaactcacgtgtatctgatcgccaaatctttgatacccacgtgggtttttctttttgttttattttcatttacgagtttaattttaccacattcacattcccaaaattttaaaaagtctcagtaatgagtactttagctggctgttagacggagccagctaaaaattcacttttttcaatttcacaaagtgaacatggcaactttacaaaatagtagttagctcatcagctaactgcttagttaatttatcgatttccggtttctgataacccatctgtttcaatcctctctcaaagctagttcgtaatagaccatgcgaaatcgcaagctcatgataaccattaagccaaagtttagttaattccaaatctgtcatttcagcccctcctttgcagatttaatgctcaaacagatactaacccctgtggaccccttgctctttgtcggaaatccagcctattagctggctctccgacccgcaagcttatcacaggggttgtctgttttgcgccttaaaacctgctcatttgcgttctcgtcccttctcaggcattttaatctgtgcatgggagaatttatcgtttgaacgttctaaatgctcagcgagcttctcagccggttttataataccttcctcaacttgcattcgataaaattgcggttgcgcaattggacttggtaactcaaaatttttctcaaattccgcaaatgccttttctttcgcagcaatcgttttttcccgctccgagagttcctgatctttttgtttcagcctttcaaagcgccgtttaagctgttggcgaaccatttcaatcacctttcgcaaggattgaaaaacatattcaatatcaaattgcttagctaatttaggaattaattcagcatgttcagaaagctttactcgctcacctttttcgtctttcgccgtaacttccggattaatttctgcaatggttttcagcccttgctcttttaatttagtttcatgctggcggttctgcttaatggtgtcctgtacatgcttatactcgttaactgataattttttccgttgcgaattttctgaacctctcacgacttcatagccttgttcttgcatgtatcggggaaactcggtctggattgttcgcaatgtgttacggtcaaacacttgttttgagcttaactttccgtctttggtcatcgggacaattcccatatgcatgtggggagttgtctcgtcataatgcacgctggcatacatcacattttctgaaccaaatttttgctggaaatatgctaatgctgatttaaaatacccctcatttcgctcagaatgccccgtatcgaagaattccctatctgacgatataatccactcatcgaccattacagcgtctctacggagcttacgtgagcttctacggcgtttattaatataatcaacaatatcttgcttatgaagtttatgatctgcaactaattcaatattctgatctgatttgttcgggtcaatatctttatttttatgatttttagtctctctaaaatcatgacgaagcataccagataagttctcagctttcattttcttcattgtggcgacggcataatgtgacattttaacccctccaaagtctactcaattaaccaacttaaattatatcacctcggatgcagttaactgctatttttttcggtataacttccatgtaaagtataacccactatactttaccaaggtaaagagtgggctctccgcgaggctcgtctgcgacgccgttgcgcgtaagtatacgcgcaagtctccgcattcgctccgacctgttccatctgagactcaatcgaatttcgcctttaggctcattcgagtttcgttcagatttcactctcgtatttttttgagattcgcctttaggctcattcaaaaaattactcacgatttgccaatcaaaaaattggcaaatttcgcttttttcacaaaaaagctcagcaaaaaatcggacagttttgcacccaaattctgaccaatgaccaacgaccacatagggggggtgtcgtagtaccccccaatgagtcgagataaactcttactcccccaagcgttcaagccgtatttcctcaactagagggggggttacacttttaaattttaaaatctctgtattccttggggctgtaagatgaccaacgaaagcaaaaaagtgtaaccccggttacacttttttgctttctatttctttaaatatttatttgaactactcccacttagctaaacctacggtttaatgcttgaagtgggagattctggaaacatcgcatacttaccctaccgattctgaacgaaccttcaagcagaggttacgactattagccaaggctcgtcccgagcctagtagtttcatcggactaccgcctaagtacgtgttcaaaatacatactggcttggttttcgccagctatttttagcctgattgcaactcgtggcgttgtctcagcacaaactcgaagttactctatacgaaattactcagtgtcctcatggtgaagcaatgttaacagctttattttcgatgcattagaaccagtttaattagttgaattatatcatatcagagggctattcatcccccacttgtcgaagtgggggtattctcgccaattatggataaattgacagcatcaatcaacttaatctaaatattctaagaaaattaattttaagttttgcaaagcttccgaattgcctttcactgacattaatgcttttttcatctcattcatttcatctgctgtgaaaacatgtttagttccatcttcaaaatacatgatatttttcatcaaattttcctcctacaaattaatcgtatcgtcttcatcggcggccacattaaagcgattcatgatactttgcaattcatattccaatcgctgaaaatcttccacaaacttctttgccatcgccaccgacaatcgattatccttttgtacttctttcatcatcttacgccaccgttgttttgttttaggtgatccactggcataaatagatggttcgtacatcatcgcaaaaaccattgcttgttggctaggatttttcaatgacttatattctggaacgtaaaattcctccaacatttttcggactaagcttggataatctgcaatcttatttccgcgtaattgcaattcaacccgccaccaactatcaacattcactaactttccatgacgggcttgttgttccaactttttattatactgacgaatctgttgccccgatttcatcgacccataataagtagtctgcatcttcccatcgggtcccataataatttgttttcccgtgccaaatcgataaacttgataatcttgggcagtgggttcattgaaaatatcaaaggcaatatcacaccgactaaaatgcttattttgcaacttggcgatcaattgcaaaacccactgaccaccctcgctatccaagccatgattggggttaaaatcaatccgaatcttatccttcaaaaatctaggcgagttaataaaggcgacttgttcgggtgccacatacgcatgccgattaccaaaatcatcttggtaacaattgctatcatcaacaacttggatgccatcactaatatcttgcacaaacggcttcttcagccactctcgcatatcatggtccaacctgtcacttggataagctgctactactgttaatcggtcaatcgataccttaatttctggtgctttctctacaacttccttacacataataaaaacaggctccctcctgccacgtggcgagttaaaacctgtttctcttatgtgcatcattttgtcatcactatttattttattaatatcattttcatgctatactaataacgttaacaaaataacatacaggttttaactcacgtgttcctagtcggccaaaactatgaactgcacgtgggttttcttttttgatttatttaatttacgagtctaattttaccacattcactaactggaaattttaaaaaatggtcatatgtgactattttagctggctgttagattgagccagctaaaaaatcatgttttttaaatttcacaaacttttgtcattctactctctatccaaaactgacaaaatataatcccgaatcagattttttgtccacgccggaacttttttcttttctgtcaactcattcaaaatcaaatacgcacttcgcaaatcactgatggttgcatccaacttttcttgttcttctgccgttaaatcaccaagctcccaatctgtctgaatgtcctcaacttgcttcccaaaaaccttttggtacctcaacccacttttcgcatagtccgaaatcgtcattccttgacgagtagaatttaaatccaacctcatcttttcctcacgagttaatcgtacccgtaaataatctgtttttgtttccatttttctacctcctttctgtttgttaccacatttatttattgatatattaacatttatttgtggtaacgtcaaaacaaaaaggcgagaattctatttaaatcctcgccaataatcgctataataaaaatgtgcactggcaaccaccaatgcacaagttagtcttaggagctgatacctcttgaaggtgtactcttttgcgcttggctggtggtgtattgctgtacaccagaacaagagcgctaccgttaagctatcagcctaattgttgaatataatatattcttctaggtgtttatattatagcatggtttagcgacttggacgaccgtctagctatctggctaggcggtttttctgttaactggcagatttaatgctcaaacagacactaacccctgtggaccccttgctttttgtcggaaatccagcctattagctggctctccgacccgcaagcttatcacaggggttgtctgttttgcgccttaaaacctgctcatttgcgttctcgtcccttctcaggcattttaatctgtgcatgggagaatttatcgtttgaacgttctaaatgctcagcgagcttctcagccggttttataataccttcctcaacttgcattcgataaaattgcggttgcgcaattggacttggtaactcaaaatttttctcaaattccgcaaatgccttttctttcgcagcaatcgttttttcccgctccgagagttcctgatctttttgtttcagcctttcaaagcgccgtttaagctgttggcgaaccatttcaatcacctttcgcaaggattgaaaaacatattcaatatcaaattgcttagctaatttaggaattaattcagcatgttcagaaagctttactcgctcacctttttcgtctttcgccgtaacttccggattaatttctgcaatggttttcagcccttgctcttttaatttagtttcatgctggcggttctgcttaatggtgtcctgtacatgcttatactcgttaactgataattttttccgttgcgaattttctgaacctctcacgacttcatagccttgttcttgcatgtatcggggaaactcggtctggattgttcgcaatgtgttacggtcaaacacttgttttgagcttaactttccgtctttggtcatcgggacaattcccatatgcatgtggggagttgtctcgtcataatgcacgctggcatacatcacattttctgaaccaaatttttgctggaaatatgctaatgctgatttaaaatacccctcatttcgctcagaatgccccgtatcgaagaattccctatctgacgatataatccactcatcgaccattacagcgtctctacggagcttacgtgagcttctacggcgtttattaatataatcaacaatatcttgcttatgaagtttatgatctgcaactaattcaatattctgatctgatttgttcgggtcaatatctttatttttatgatttttagtctctctaaaatcatgacgaagcataccagataagttctcagctttcattttcttcattgtggcgacggcataatgtgacattttaacccctccaaagtctactcaattaaccaacttaaattatatcacctcggatgcagttaactgctatttttttcggtataacttccatgtaaagtataacccactatactttaccaaggtaaagagtgggctctccgcgaggctcgtctgcgacgccgttgcgcgtaagtatacgcgcaagtctccgcattcgctccgacctgttccatctgagactcaatcgaatttcgcctttaggctcattcgagtttcgttcagatttcactctcgtatttttttgagattcgcctttaggctcattcaaaaaattactcacgatttgccaatcaaaaaattggcaaatttcgcttttttcacaaaaaagctcagcaaaaaatcggacagttttgcacccaaattctgaccaatgaccaacgaccacatagggggggtgtcgtagtaccccccaatgagtcgagataaactcttactcccccaagcgttcaagccgtatttcctcaactagagggggggttacacttttaaattttaaaatctctgtattccttggggctgtaagatgaccaacgaaagcaaaaaagtgtaaccccggttacacttttttgctttctatttctttaaatatttatttgaactactcccacttagctaaacctacggtttaatgcttgaagtgggagattctggaaacatcgcatacttaccctaccgattctgaacgaaccttcaagcagaggttacgactattagccaaggctcgtcccgagcctaactttatctatcggatagctaatcctttttgcaagatgacttgtgcagcgttaatatcacgatctaaatgtttaccacagtttggacaatcccactcacgtaccgctaaccattccgatttattcaatcctaaccgatgattattcttcccacaattagcacaaatttggctagtatatgacggattgacctgaataagctttttaccgtaccagtcacacttatattgcaacatatctactaattttgaccagctagcgttagcgattgctctagctaaatggtgattcttcatcattcccttagtattaagtttttccaacacaatgatgtcgtactttttgaccaatttagtagtgaatttttgtagctgatccaaccgttggttggcaatcttttgtcgatacttcgccaccataatacgagctttctgataattcttaaaatcatctaattgccgtggaactaacactttattatgatgatcccaggcgatttcctgctgggcctttaagaaccgacgactacgcaatttctcccaacgatacaactttttacggtatttgtcttcaaaatg

SEQ ID NO: 54 - DNA, 11403 bp, Artificial Sequence
  Based on Lactobacillus reuteri
atgctagctaacgctagtcctagtgataaattgtctaaacgcttgcaagcaatctttgcccaagcatctatttctcggcgtgatatgttgggtgcaatgattggcgccggtatgaatattgctacagcaaaaagtgaatcatttgcagtgaatgaactcaaacagcagtatatcgatggctataataattcaagccctaataaactatcaacagttccagataaagtagccaaccaagctgagtattctcaacgaatttgggtgcatggcgacgtcatgacgacacgaatgaaagaaaccctgaacaagggtttgagtcgccgcatgaagaaatcagacatcaataaaatgacccgcagtattcctcaaagcggtgatcgaattgatgacaatttaacaacgcctatgaaccaaatgctatccagaattcatacgttaacaactaatgaagctatacgcaatagcaacggtggtaagaatagagcgtatgatgaacagaatgttcagtatgtgatgtggttaaccgaggaagatgatcgtgtttgtgatatttgtgaaccacttgatagacaaacatttgcctatggacaagcaccgattccagtcacggatactcatccaaggtgtcgttgccagctggtagcctgtgatgaagatgggaatctgctgtctggtgaacttgatagggtatttaaggaacaaaaaaagcccacttagtttaaaactaagtgggtcaggaatattattaattggctccgctcacaacaaagtcgaggggtgctaactaagttagcatctataattagcgatgcgttcatgactatggacagtaagattaacatcttttagtacaggcttagaaaagctttttgatacatgacttaaagttaataataatgaatttggattagatgatcctgtaatcaaattttctagactaacgtttaagatccttgctaaagcaattaaattgtccaaattaggttctgtatcaccattttcccattttgatactgcctgacgagatacaaaaagtaaattagcaatatctgtttgagaaagttgctgctcagttcgtaatttgagtagctgatgagcaaaagcattgtgcatattaatctccccgttctattaaaattgcatagtttatttctactaacatttttgttttacgtcaatataatccctagataataatgtttgcgtaactagcaactaaatgttgctagcatacagacgtaaagctagcagatacttaaatcaaagtatgaggggaatatggagttgtaatgattaaccagattgataagaattaggctagggtctaatggaatattttccaaaagaagctatgaccaatattatctgtttcttcttttggtagtttagctggtaatgatttttgctgttgatgtgtggttaaatctaattgttgagcctgatcagcaagcttattagcggtagcaatttgttcatctttaatagttaattgcttctttaacagtttgattatctcagcttgttcattaactctggccgttaattgattgatgatatcgtctttagttgcatttttgtgctgttttacctcagaattaggtttaaactgataatattttttcatttcctgataaacgctgttactgtagtatttagcgttgtgatttccagttttaacaggcttaaaatgatgtttttggataaaacgagaggctgaaactactgaaatgctgaattcccttgctaaatctgaggttgtatatgttttagttttacttttatccatgttttagcctcctttagcctaattctagcatataattgttattgctatttgataggaattaagtttatacttaacaagtaagcgttatacgcctactaacagtttaataaatttagagtaaagaaaaagcccgttaaagtactccaatactttaacgagctaccgattaactaggacaagtagtaaatcggggttgtctatttctttaatacaattattgtaggggaaatagatggatatttcaagatataacactataaaactattactgaaatcaaaccctaaaatactaaaccgactagttaatcgctagtcgtttttttcttttggttcgcaaccggtaaactcaaaagcggcggcaccgcatcgtagtagcatctcgaaaacgcccgtgacctcttggatgtatagaggttgtagtcaacatcatgggaaagccaatcccgtacgctttacaaacgtcaaaagagcggctataggaagccttggaaatgcttcagataacccataacattatttagtgagtctttatgatggtttctcacagttgcgacagcttaatttgctgcctagcggacaaaaagaaccagcccgctgaacagggtataggtggaaacacaagagcagaatgttattgggacaagggcagggtgcgtttaaactatctgcattgcaattattaatgagcttagtagtgttaaattactgagttgatcaataattgcgatgagtcgactgagagaacaatgctctctcgagacttagccactgacaggctaagtctcgagagagcaagctggagcaagttctttgcggaagcttgctcttcctttaataggttaaggataagtgggtaaaacttatagttaaaactgtctttcatcgtctttgttaaggcgtttgttcattgcattggtaatttgctgagtagctttttgtctttgtttttgattagcaaatagaattgccttttgtaatttaaggatggggtcattattgagcttgttcattagctgtttttctctttggtaatcaaatggatgtttagaagcttgaattgtagatggatctagataccttgattttaggtttggtttgggttgattggggttcgttggagttgttagagttttggtgatttggtcaacgaatttgagtgcttcttcttttactttttgaagagctttagcagcaaccttaatcaggtatttgatgttttgtttgaggtgttgttgacgaccaggatcagtgttaactggttgagggcgttcattgttgtttagtaatgattgttcgacttgatgtgatggatcgttttgggcaattgaatcgacaagttggtttttgtaggagttaatgttatcttgaatggcttggttagatgttgttaattgatcattttgggtttgcaggtctttattgtcattaataagcttagtgtgtttggtttgatctgtttgccattgttgccgttgatcattgcgccattggtcgatggaggcttcaacatcgttgatattgtctgcggttattggttcattatcaccgtacattaggttattacggtcaaattcctgttgagcttccttaacgcgctgtaatttgcgttgctttaattgttcgtcagcatcgttaatttggttttgtaaagtttgtagttgttgtcgctgttgatttagtagctgttcttgttgttcttgctgctgtttggcagctttttctttttcttgagtagctaccatgtctttatctgcttgttctttattgctttgagaggccctagcagcgtgtgtaatgccatttgccatttctaagggtgttagatcatttccgtccttatcaactgcctggtggcctgtggtggcctcatagatggctttgagattcttagtaacagtttcaacctgatgtttgacattattattctgattggtaaggtcgttagtttgcttttgcagtgattggatagcttctttgtgttcagcaatttcttggtgttgagcttttagttgttccattgaaagtccggtttgaagcgatttgtcagtctcagttttacgttcaaactcaagaatttttttattttgggggactttataagttttatgcagctcggtttccaagcatttaagggcaaatttatctatgctagcccggtaccatttggtagctgctcggcctgagcaatattgacctgttaccgcatggtgtaggctgactaatgcttgattgagtgagttagtcgcatgggcaggtcgctttttaccgccacgtgtcatgccaaaggttgctatctcgtaatggatatgtgagattcccatttcatcgttgttagtagcatagcggccgcgatgtaaataatcgccaatatttactcgttttcctgatttgagattccaaccaacattgttattagtagcagtaattaaagtgcgattgaagcaatcgtaaaatcgtttagcgacagcaatgttatttttaatcggctgctcgtgttcgtcttttagcttaaaaacaagatgagtagttccatcgggaagcttttcctctacgtacgaagaagccgggcaaaactctttcatcaattgactttgaacttccatattgccaatggtcaaaactgcagtagcttttttcttcctcttgagaaagttttttacacttccgtattgtcgttcagcatgacctttttctcgttgatgttggtcgtgctgttccacgtagttatggaagtgttgctcattccaatcgtcaatagcttgacgggtggcagttgattcatcatatacgttaaattgagtttcactgaatacaatatccttgtttgaatggttaatactctggtcatgttccacgtgcttttgaataccagaataaccattagtatcttttgcctgtaagtctgttgttactgtacatttcaatgccattatttcatcaccagcgttcatagttttacattttaattgtagcacgttcagtaatgagtaaagtggataacttatccaatttactagctccctagtcaaaatggagtaatcccattttgtcggtcgctcttccgagggaattaggaacacatttcctaataaccattgatttaattttcaagattgtatttgaaaattaaatattaccttttaatcaaaaggtaataccaaaataaaaaattcccaatgtctttcgacaaagggaattttttacaatccagctttaacatttagttaatctggattgttcccattgggaaattcattatcatgtaatggattctttcccaatggttttgcgtgactttgttcctgctgctcttgttttattttagccacaaatgcagtcacaaaatcatgcaaatcttttttcgcaaatggcttttgatcatcaccaatttgcgaatcaataatgctgtttaagcgttgcattaagtcatcattattgctggccgaagttagcatagcttcggccaattccgctttccattttagttcgtttaaggctaaaacatcagcgttatgtttcatctggagcttcttatactccatatcttcaggaacagtacgaccactcagttttttggctttaagttcttgccaacgggcaattgatttaggggacatcatgataaaaacttctttctattaagtaattagattaactattatgagaagttaacagtcaatctcttgcccaaagcgttagcaattttggttaaagtatcaatactggtgttggcgccgctttcaattcgtgcaattgttgattgaggaacatcagaaacagtagctagatctcgttgagaaaggcctgattcttttctaaccttagttaatgcaatggcactctctaacttagttgtttcgttttcaaattcctttttaaattccggatcctttaattgttcatttaagtagtctttaaaattaatgttgctcataattattgctcctttcggttggcaaagtattcgtcacgtaatttcttagcatgattaatttctcgtggcggtgttttctgggttttcttagtaaagccatgggtaataacgtagtgaacgccatcaacgtgaaaataaaggccacgttgttgattattactaacccgagagcgaatttcatagaggttcttctccagtggcttaacccagttatgttgaattccagcactaagtccataagttgcgaccatgttaatccgtgctaataactttgctttagctttaacgtcaagactatctaaatattctgcaaattcagtatggccattagggcgagtataaaattcaaattctaaatcttccatgccctaatgatagcatatattgtattaattatcaatatatgctatctagaacaactaccgtgcttcgcttgctggactcgttaatcagaacggtttatgactaaacctaacctgattaacgagtgaatttttttgggggggagtgcttaatcgaacttaacttcatcgagcatttgttctcggctgacttgatccagacctaaatattttaaggtcatggcttctgaggaatgattaagcagcgacatcactggggggagtgcttaatcgaacttaacttcatcgagcatttgttctcggctgacttgatccagacctaaatattttaaggtcatggcttctgaggaatgattaagcagcgacatcactaaaccgatattgtaatgagtttgtgtgtagacccggtaagccccagtttttctcattgtgtgagtaccgaggtagttaatcccaagtaaatcgccagttttagccatgattttgtaaaactgtttttcagtgatgtgccgatcggggtgtttagtcgatggaaaaagccaatctgagtggagattttgttggtttagccactgaaaatagtcttttaggtcttgtttaactggttttaggtacaaagtattgggctttccggtctttttatcccgaatataagcatttttagcgatagtcccatcgttattgaagatctcattgcgtctgagagctaataaatcggacactcggagtaacgttgccttgccaacttggaaaattgtgtaatttcggcggccagctttaaaattatgtaggagagtatcttcgacttcatgcaggatattggaatctttgatgggtaaaacgagttgtttcatgattaattgctccttatttaggggctactttttgtatatataaattaaaagcccctatattctgattgtagaatacaggggcttgacatatcaacattctataggggctatttatcacaaatagaccctattatgaactggtttcagtcaatcttttttattaatctttcaatttgataataattaattgttattacgaataagtcttacagcaataatcaaaagaaatgggattaaagttagcacaaaactaacggtaaatatacttaaatttttgatggtatctttagattgggtcatgaagtccgtcctaacttattggttttgtcacttataagtttaaggcttcatggcctttttggtctagttatttaggtgttgcacttacattgtaaatccggcgtcacaaaaaaattgactgacgagtcaataattcgttgactcgtcagtcaatcgcgactatactggaaaaggttgatcagataccgacatattaaaacgtgtttcaagtttgaccttaaggaggatgacaaaaatgacaacagctattatcgaacttgaccatcttcaaaaaaactttggcaagtttgccgcattaaaagatgtcagtttcacgttggcacccggtcaggttctgggttttctaggacctaatggggccggcaaatccacgaccattcgagttattttaggcttattaaaaaagagtggcggctcagtgaccgtcttcggcaaagatgcctggcgggatgatgcggcgattcatccacgcatcgcctatgttcctggggacgtttatttatggccaaatctttctggcggcgaaattatcgacctattgctacgtttaaatggccgccagcataatcaaaagaccgatgaactaatcaaggcctttgaatttgatccgaagaaaaaagctcgtacctattcaaaaggcaatcgtcaaaaagtagcgttaattgctgcgttttcgcaagatgccgatttgtatatttttgatgaacccacttctgggcttgatccattaaatgaacagactttccagcaagaagttttaaaactgaaaagagccggtaaaagtgtgctgctatcaagccacattttgtccgaagtcgagcgaatgtgtgattcaattgttatcatccgtgatggtagtgtgattgagagcggcaatcttgatcaattacggcatctatcgcggatcaaaattgaagtcaccaccgctaccccaatgactgctttggcaaagcaagctggcgttcacgacctcacttatcgcgattccgagcacaccaaggcggttttcaccgctgatcgagacgcgcttggcaccatcatgaccacactggccgccaacaccgtggtcgacatgcaatcaacgccgccaacgctggaagagttattcctgcgttattatggaaagcaaggtgagactcatgcggcacagtaatcggaacgcaggttatctgcttcgggcaaacctcaaacaaaatctaaaattttcactcatctggcttgtcattttgatcatgatgattgccagtggtgctggcaaattggaagcagactttgcaggcggggcctcgggctctaaagagattgtcaaaatgctgcaagcgccgggcatggcggcaatgtttggcgcgatgccaaaggtggacacgtataacacagcgattgtgtttgctggtgtgatggtcgtcttcatgattattttgcaggccttatgggttatgccgctgatgattcgcaacacccgcggtcaagaagaaagtggcttgctcgaaatggttcgcgctcgcaatgttgggcgaacggctgccatcaccgccgcttcgcttgagcttctcatcgacagtgccataatgggtatcctctattttgtctcgttggccgctgtcaacatgggtggtactgacttgtacggtgacttcctgttttcactggggatggtgatcgccaacttgctattcggagccattgcgttgctattcgcgcaactaaccaataacacacgtacagccaatatgttgagctacatggtgctgactgccgcttatttggttcggctggtcaccgatatccagcatcaaaatctgacgtggttatcaccaattggttggttcgaaaaagcaaacttctatactgataacaacgtctgggctttaggtttggccttactggtcagcattctgcttgcggccagcgccaccatgattgcccgcaaccgcgatctgggcgccgggattattgctgaacgcaccggccgagccaaagctgccggctggcttcgctcgatccctgccttactgtggcgaactgagcgcggattatttgctgggtggttaatcggcgccgtggtgtttggcggcgtcatgggtagtgtgctcggcggcgttggcgacattcttaaaacgaatccgctttatcgtaaaatactagatgttggccaaatcaacgctgccaatcagaccatggtcctgtcattcttaggcatgtatctcggcattttcgtcgcattagccgtgactgctggcgtccaagtggcattccgactcaaacgcgatgacaaccttggttacttgagcgtcattcatgccgaaaagccaacgcgaaccacgatcagtgtcagctactattgctttggtctgctggcaggcgtgttcgtcctttctgctgggctgctggccttgttcttcactgggaacactgttctcagtcacccgttgccgctcaagtacctcggtcgcctattcgtggctagcgttccggctgtgatatcgtttatcgcccttggcatcgcactagtcggtctgtggccacgcttaagcagtctattctggctgtatatgggagccggtctgatcgttcaaattttccggggattgtttgatttgccaaaacacgcaggcaacttcacaccttttggctggattgccaatgtaccggttgaaaacgttgatcaaacatggctaatcgtgatggttgttagcgctatagtattatttattcttggcattgctggttatcgccgtcaggatttgagcctatgaaaaatgttgtgacagatcctgaaaaggtcacccgaatcctcaaaacagcgacggaaattttcggccagcaaggcttcatcaagagcaaaaccgatcagattgccaaccaagcacaagtatctaagggcttgctcttccattattttggcaataaacaagcgctgtatcttgacgctttcaaatatgcctatcatcgaatttatgatcacatggaccctaaaaagtggcagaatgcccctggcttggctgccatgatgaccactgcagttaagtatgagttgaaactacaattcaaattcccagctgaataccgcttgattatgcaagcctatgctgatttaccgcattttcccgaaccgttgcgacaacaagtgcagcaagaaacaactgccatatccgctgaaatcgatcgcatttttcgcgagaaaattgaacagctgcctcgtcgtgagggcctgtcagtcgatgacgttttcggtgtcgtttctgccttaatcgcccaacaaacggcggtcaccatcagactcattgccagtggccattatcgcaagtttgaagatctgcagtccgtggttgagacgatagcacgccagttattgattgtcgaacacggctttttaccagatgaaagttgacgtcagctgatagatcaaaaaaggtcattagggtataccctagtggccgtttttatttctgtgctatactaggaattacaatcgttcattagaactgtccaaaaggagaattggaaatggctaaaatcggttatgcgcgtgtgagttccaaggagcaacatttagatcgacagttagcggctttaaaagacgttgataaattatttacggataaattaagtggggctaacactaatcggccagaactgcaaaaaatgctggcctatattcgtgagggtgatattgtaatggtcactgaattagatcgcttaggcagaaacaaccatgatttgactaagatcatgaactccattcaaaataagggtgccaccctagatgtgttaaatttgccgtccatgacagggattgctgacccaaatttacgtcaactgatgaccaacttgattattgaactctataagtatcaggccgaaagtgaacgtaagcgaatcattgagcgccagcaacaagggattgccttagctaagcagcagggtaaatatcatgggcgcaaaccccaatatgccaaagatgatccccgtttgcaacatgcttttaagctttatcgagctggcatgagtgacattgatgtgtcccgaaatacaggtattaaacggacgacctttattcgataccgtgtgaaatacggtattaaaagaaaatagggcgcccttttggttagcacatgttaactgaaagggtccctattttctttacttaaaaggtagattgatgaa

SEQ ID NO: 55 - DNA, 4653 bp, Artificial Sequence
  Based on Lactobacillus reuteri
ttggcaatctttcacctatcagcaaaaatcattagtcgaggaaaagggcaatcagcaattgcctcggctgcttatcgttcagggaacaaacttcacgatgaacgatacgacgaaacacaagattacacaaacaaacgtttcatcgaacactcagaaatccaacttccagagaatgccccagctaagtatcaagatagggcaaccctttggaacagcgtagaaaaggcagaaaaagctaagaattcgcagttagctagagaaattgaaatagccttaccacgagagctaacaccagaacaacgagttaaattagtccacgattacgttcagaaaacctttgtcgataagggaatggtagccgattggtctattcacaacccacaaccagataaggataatccagaaaagccagcaaacccgcacgctcatatcatgctcacactgcgtagcttgcgttctaacggctcttgggcaccaaagaagacaagtcactatgaactagacgaaaacggccagaaggtgcctgtaatcgatcctgagacaggcaaacagaagttaggggcgaaaaaccaaaaaatctggaaacgagtaattaccccaactaatgactggaataaccccaaaaacgttgaaaaatggcgggctgaatgggcgaagacttgtaataagtacttggctcctgaccaccagattgaccaccgcagttataaacggcagggcaaaaaacaaattccaacaatccatgagggctatgttgctcgtaaaatggaacgagaagccacaggaagctcagagagggcttcttttaaccaaatcgtaaaatatatcaacaacgagttaaaatcgcttagaaagcaaattaggggcattatacgcgaaatacggaatctagaaaaaggacgtgaccaagatgagaaagttcgacttcagcaagacacccgagcaaatcaaacaagaacaagcagagatcaagcgctgggaggaggagttcaacgcacgattacagacaatcgggagcaatccggaaacggtagagccaacggaactgccgaagaagcccaacgaacagatcctaatcaacttcatcaacagtctttcggagaaacagcaagaagaattttccgagatttccggctatttgcggagcgtcaacgagaagctcgacagcgacaacgccgacttagccaaggcttacaacatcatcaagaaacagaaaaacgacttgaagcagggcaacaacaacttactcgaacaaaacatacagctgacgaacgaaaacaacagcttacagaacgacaaattcgagttagaaaagcttttagcgacgcttctaagtccaaagtcttggaacgatactacactcacttccgtcaaacaaaaactcaagcaaatcatgcaaaaggattagactaccaaggaccaattctgggacattcccgaggacgctcaaggtagttatgctagaatgattaagccgtccgtggcaactcctacgtaaaggaggtggcaacatggcacatatactcctctcagcagttttgagccttctgggttccttgataactgcactgttcgctgattggcttcgtcggcgaaaatagtttttgacggcatgaagcgcaaattaaaagccactcaactattcgcactagttgggtggcttttttgcaacgtggcaatatacttctctcggttaaattataacatggttgttccagaagtgcattaggtaggcggtttgtccccccccatgggttttggcttcgaaaatcaatcgttgaagtgaccagcgaagctcagctgatggagccctcatattcaagaagcaggtcaacgaatgccaattccaacatgagggccatgacttaggccactgatactcgcaaatgactgtcacaccaacggtattagccattctgataagcgagtctaacgacttttgacgcataatcgaccacctaccttattttcaaagcgcctcagagctaattagagtattcttcaaggagcttagcgaggattatagacgcttggcggacttcactttcggcttgattgacccgtttagcgatcttgtcatcatggcgagccaccttttccaagtcatggagattatcagcgatttggtcagtcatgacggagtagttcttaatacccgacagcaggctttcaacgttagtattctcaaggttttcgttgaatatcatggttattcctccttatcctcaaacttagtcatcttctgtctcctgttttagagaattttcaatcatgtctaataatgttgacatgtcaatgttaaatgaatcaaggctaccataccgcttgatttgagttttaacactatccaatccatattcttcaagtaatgcttttaatttaccagtaactttttcacctaaatgcccaaaatactgaagccagctcttaagtaattctcggtactggtcaaatttttctttttcagtaagctgtttctcaacttcttcttggtcctcagaaccgttaactactttccagaggtcagggtcagtagtacccaacttataaccaagtacccgatcatatgctctggccttttcctttggagtcaaatcaggattaaggtcaatattatctagcttcatacgttggtcagcataacgacctttttcaaagtcatcggcattcttggcttcaggttgccaagtgaactcatagccaacaacaggacgtcctctaccagctcctcgaatagtttttacggttaagccacgaataacaggggttagctcttctttaattggacgtaacactctttttcttacgttaccctggtctttcttgtagctcttgggtagatctagttgcttaaataattcgtcactggttaacttcaaccgccctactgttcgatattgtttaattaacactctttttcttacgttaccctggtctttcttgtagctcttgggtagatctagttgcttaaataattcgtcactggttaacttcaaccgccctactgttcgatattgtttaatcaagcgaaacatgttcttagcataagcagattgaagactattaaactgagctagttgaaatcttgtccaatgacttaaatcattgaatagcttctgaaatagagggttaacttgaacagtcagaatctgtttactcctctgaatctgaaatacattccaacaagcaaattgagtaatggtgtctccatcatcggtgtaggcattaatctctaatagctttttattagttttcatcaaatcttttacaaaattagatgtactccgttcatacttactaagactttgtagttgcgtaaatgaaaactttaatttctgagtacccttttgatacgactgctgaactagtgtaataaatagatttagctcattagagttcagtcggccaagtggaatagtattaagccgattactatacttcacaatttcattactcaattttctcacctcaaatatattataacattttatcgtacacaatcaagagtacgtacttatagcacacgtacagtattagcgcgtatattaagacaaaaatttagacaaaatgtaccttataacggacaaaatgtaccttataaaccggacaaaatgtaccttataacggacaaaatgtaccttataaaaaacgaaactcttactctcccaaggagtttcaaacccctaaagagtatttaaagaatatatataaagatatttaaagaggcaccatacggaaaatctcctttctgatttcaatttcagagaggagattatcactaaatttcaaaattcaatttttcgccaaaaacttttttagtagttttcggtaactagcaaaatcaacttcgttgattattttgactatttcgaaattcatcaaaaactgaatgcccgtctttatagtgaatttgtttagtgaagttcactaactgcttcagcatattcagttgaccacgtaaccattgttcactatcagcaggactaatttgttctgataattgctctttttggtggttataagccttataagcctgatatttagcataaccttgtgggtcatctgatttagccactctagccactttaggtacttttctaagccccttagcttgagcttgaatatcttctaaaaccgcccctttttcgatgagacgcttatttcgttgctttctcttttcagtattgatgcgagccatttgacgctctcgacgagccttaaacactgcttccttttcttgaaggcgttcaagttctgctttcattttttcaatatcagccataacaaatcctcctaatgtgaataatgttttctgaaattcaaatgttatctagattatatgatgttacaattgatttaaccactacgtttggtctccctgttaagggcgcacttatacacattcaaagaatgtaattacgcctgacggcgacgtgcgctctccgaggggacttacccagtcggggcgacttcatcgagaccatgtcatggagattcagtttcaccgaaacggaccactaaccccgtggaggggagaagtttcacttctagggaccattccatggagggtcgctttttacaaaagcaacgcaaaacaaaagactagctcccaagcttacgcaaggtcgttagtccctaaggaggcagcacaga
